United States Patent
Jones et al.

(10) Patent No.: US 12,227,565 B2
(45) Date of Patent: Feb. 18, 2025

(54) METHOD OF FORMULATING A PHARMACEUTICAL COMPOSITION COMPRISING ADMINISTERING AN IMMUNE MODULATOR TO THE SMALL INTESTINE

(71) Applicant: Biora Therapeutics, Inc., San Diego, CA (US)

(72) Inventors: Mitchell Lawrence Jones, La Jolla, CA (US); Christopher Loren Wahl, San Diego, CA (US); Sharat Singh, Rancho Santa Fe, CA (US); Kevin David Howe, London (GB); Arana Perera, San Diego, CA (US)

(73) Assignee: Biora Therapeutics, Inc., San Diego, CA (US)

( * ) Notice: Subject to any disclaimer, the term of this patent is extended or adjusted under 35 U.S.C. 154(b) by 1023 days.

(21) Appl. No.: 17/253,804

(22) PCT Filed: Jun. 19, 2019

(86) PCT No.: PCT/US2019/038063
§ 371 (c)(1),
(2) Date: Dec. 18, 2020

(87) PCT Pub. No.: WO2019/246317
PCT Pub. Date: Dec. 26, 2019

(65) Prior Publication Data
US 2023/0009902 A1    Jan. 12, 2023

Related U.S. Application Data

(60) Provisional application No. 62/687,766, filed on Jun. 20, 2018.

(51) Int. Cl.
*C07K 16/24*    (2006.01)
*A61K 9/00*    (2006.01)
*A61K 39/00*    (2006.01)
*A61P 1/00*    (2006.01)
*A61P 37/06*    (2006.01)
*C07K 16/28*    (2006.01)

(52) U.S. Cl.
CPC .......... *C07K 16/241* (2013.01); *A61K 9/0053* (2013.01); *A61P 1/00* (2018.01); *A61P 37/06* (2018.01); *C07K 16/244* (2013.01); *C07K 16/2842* (2013.01); *A61K 2039/505* (2013.01)

(58) Field of Classification Search
CPC .......... C07K 16/241; C07K 16/244; C07K 16/2842; A61K 9/0053; A61K 2039/505; A61P 1/00; A61P 37/06
See application file for complete search history.

(56) References Cited

PUBLICATIONS

Madahevan U (2004) Clinics in Colon and Rectal Surgery. 17(1):7-19.*
De Jong EC, et al. (Aug. 1999) Journal of Leukocyte Biology. 66:201-204.*
Luo J-Y, et al. (2011) Biomedicine & Pharmacotherapy. 65:111-117.*
Murthy SN et al. (Sep. 1993) Dig Dis Sci. 38(9):1722-34. (doi: 10.1007/BF01303184).*
Caffarel-Salvador E, et al. (Oct. 2017) Curr Opin Pharmacol. 36:8-13. (doi:10.1016/j.coph.2017.07.003).*
Munoz-Navas M (Apr. 7, 2009) World J Gastroenterol. 15(13):1584-1586. (doi:10.3748/wjg.15.1584 ).*
Monteleone G, et al. (2015) N Engl J Med. 372:1104-13. (doi: 10.1056/NEJMoa1407250).*

* cited by examiner

*Primary Examiner* — Robert S Landsman
(74) *Attorney, Agent, or Firm* — Procopio, Cory, Hargreaves & Savitch LLP

(57) ABSTRACT

This disclosure features methods and compositions for treating inflammatory disorders or conditions that arise in a tissue originating from the endoderm using an immune modulator.

15 Claims, 82 Drawing Sheets

Specification includes a Sequence Listing.

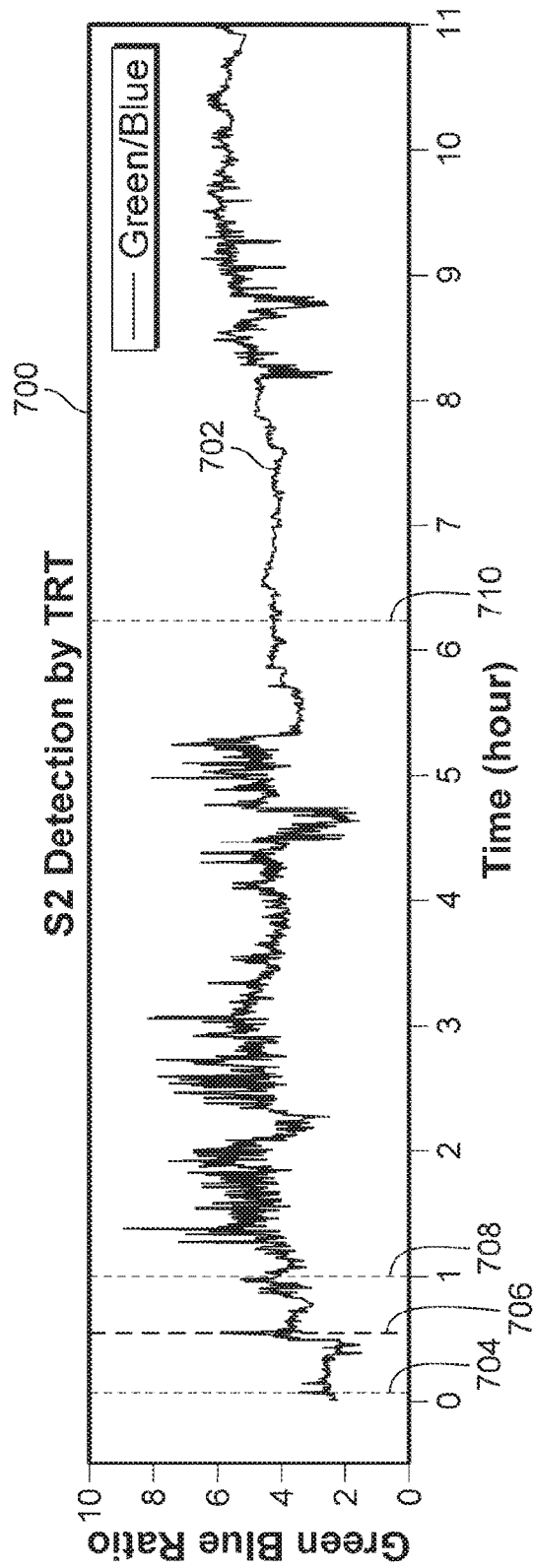
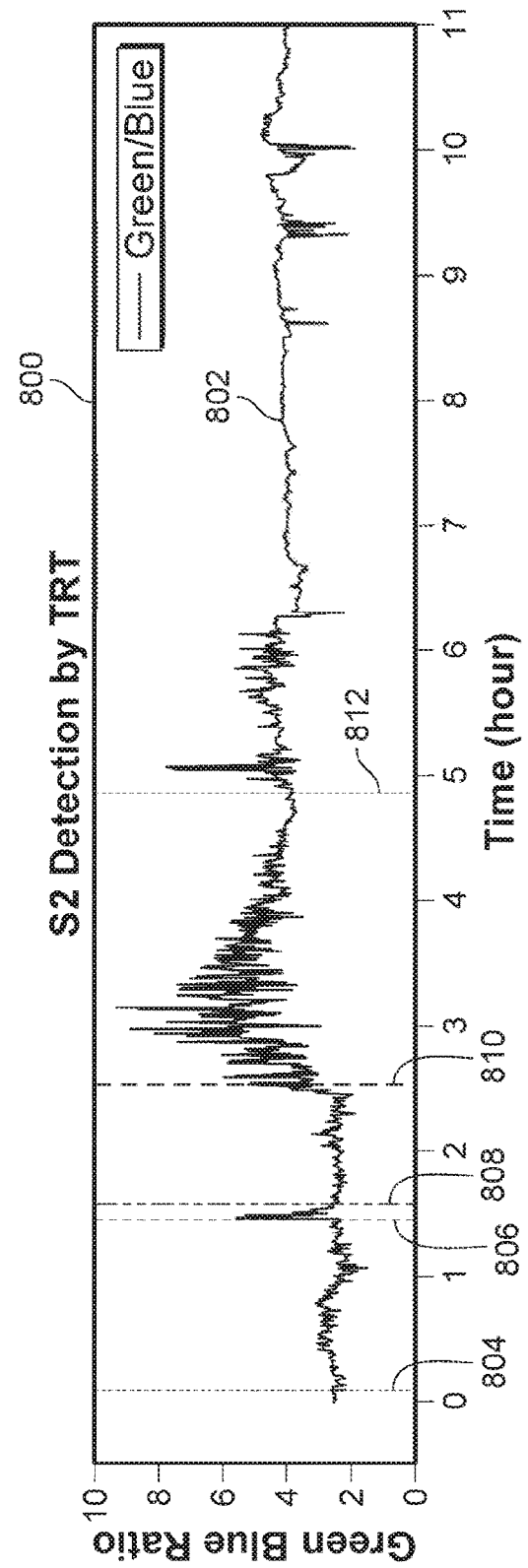

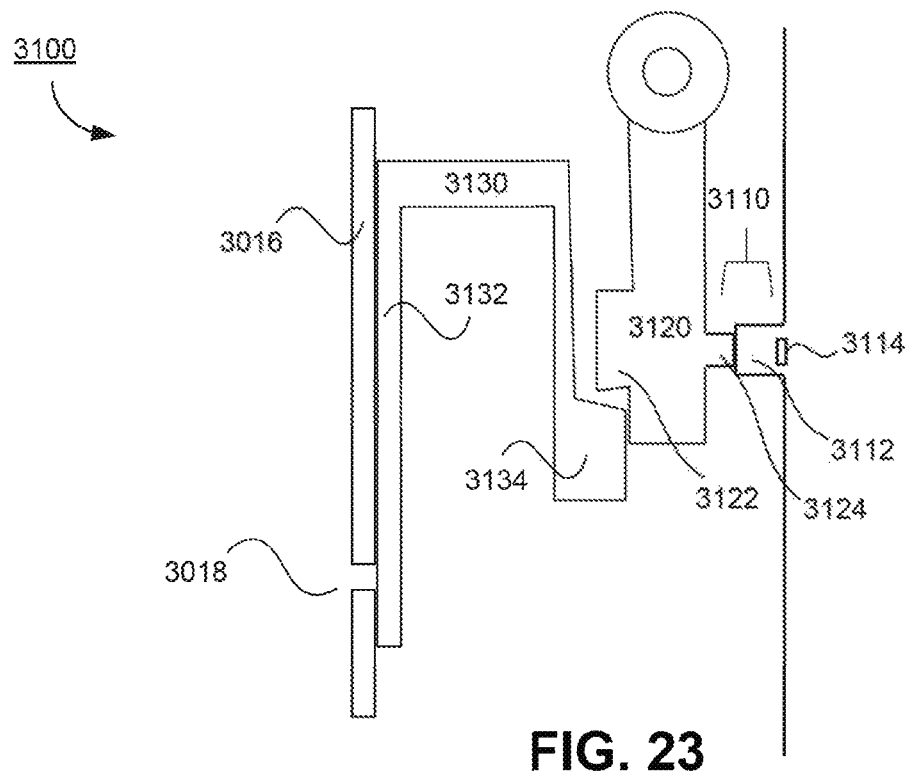
FIG. 23
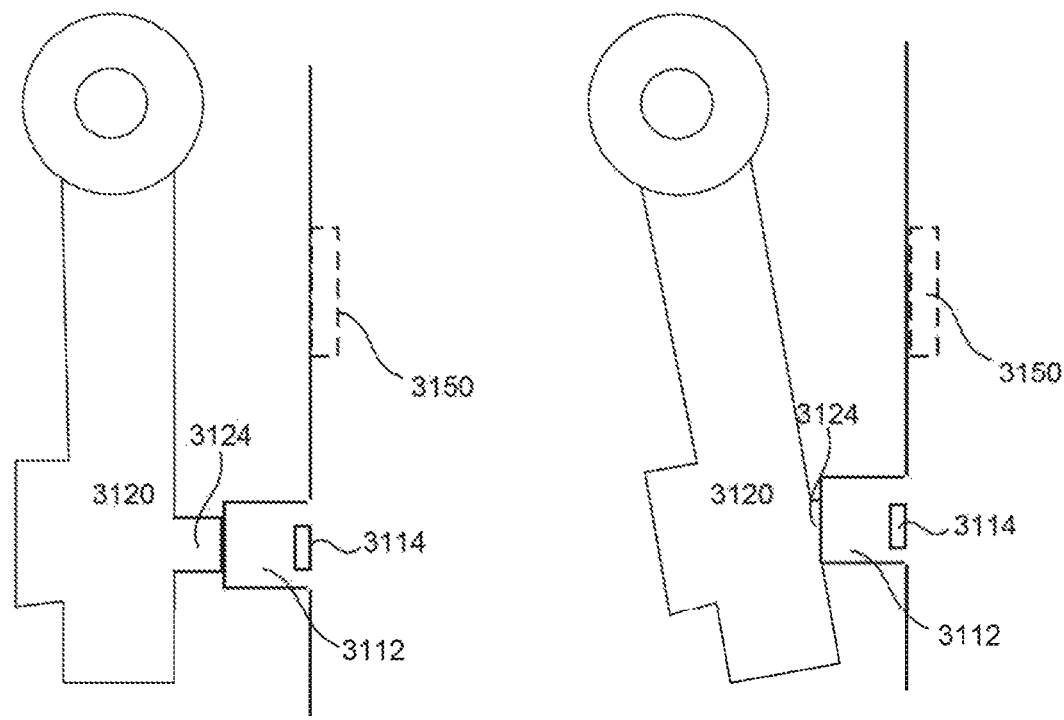
FIG. 24A     FIG. 24B

| Time | SQ Adalimumab Plasma concentration μgs/ml | Topical Adalimumab Plasma concentration μgs/ml |
|---|---|---|
| 6hrs | 16 +/-8 | 0.01 |
| 12hrs | 13 +/-4 | 0.01 |
| 24hrs | 13 +/-3 | 0.01 |
| 48hrs | 16 +/-5 | 0.01 |

FIG. 52

| Route | PO | IC | IC | IC |
|---|---|---|---|---|
| Dose (mg.kg) | 0.09 | 0.02 | 0.04 | 0.09 |
| Tmax | 1 | 1 | 1 | 1 |
| Cmax | 3.531 ± 3.84 | 2.39 ± 0.565 | 9.197 ± 3.30 | 21.8 ± 4.73 |
| Trough (12hr) | 0.568 ± 0.291 | 0.746 ± 0.038 | 1.96 ± 0.491 | 4.35 ± 0.516 |
| AUC 0-12hr (ng*h/ml) | 16.83 ± 3.641 | 15.29 ± 2.356 | 51.35 ± 4.04 | 129.6 ± 7.827 |

Quantitative histological grading of colitis.

| Feature graded | Grade | Description |
| --- | --- | --- |
| Inflammation | 0 | None |
| | 1 | Slight |
| | 2 | Moderate |
| | 3 | Severe |
| Extent | 0 | None |
| | 1 | Mucosa |
| | 2 | Mucosa and submucosa |
| | 3 | Transmural |
| Regeneration | 0 | Complete regeneration or normal tissue |
| | 1 | Almost complete regeneration |
| | 2 | Regeneration with crypt depletion |
| | 3 | Surface epithelium not intact |
| | 4 | No tissue repair |
| Crypt damage | 0 | None |
| | 1 | Basal 1/3 damaged |
| | 2 | Basal 2/3 damaged |
| | 3 | Only surface epithelium intact |
| | 4 | Entire crypt and epithelium lost |
| Percent involvement | 1 | 1-25% |
| | 2 | 26-50% |
| | 3 | 51-75% |
| | 4 | 76-100% |

FIG. 93

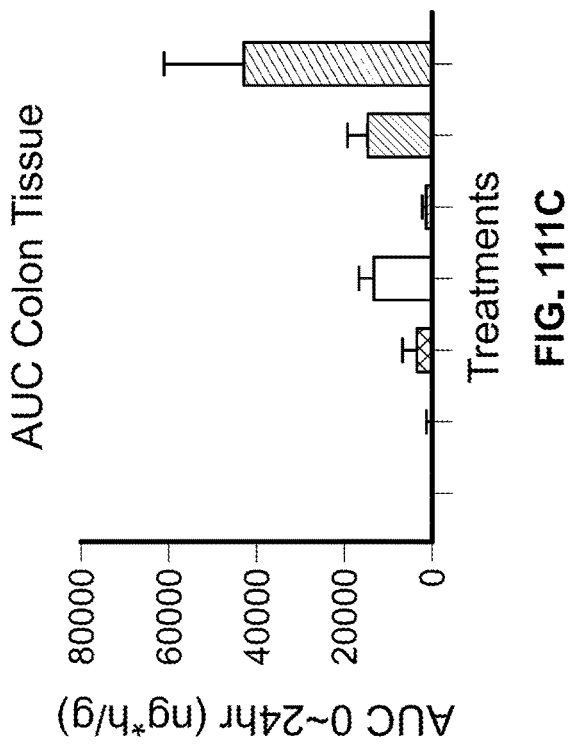
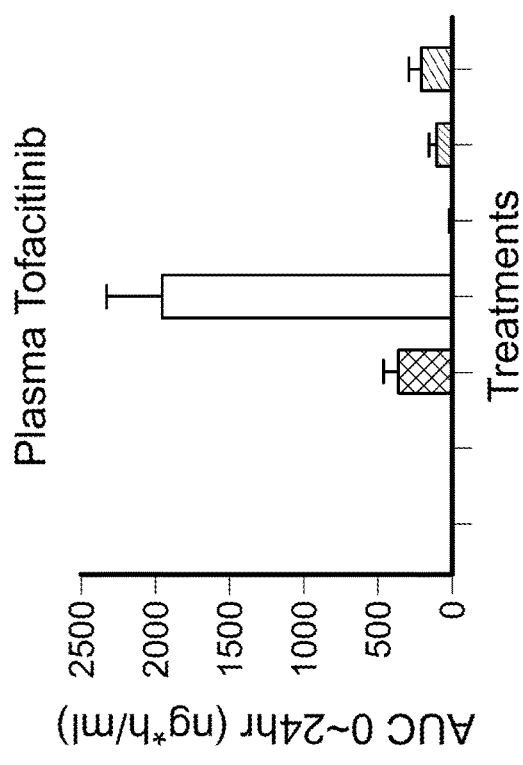
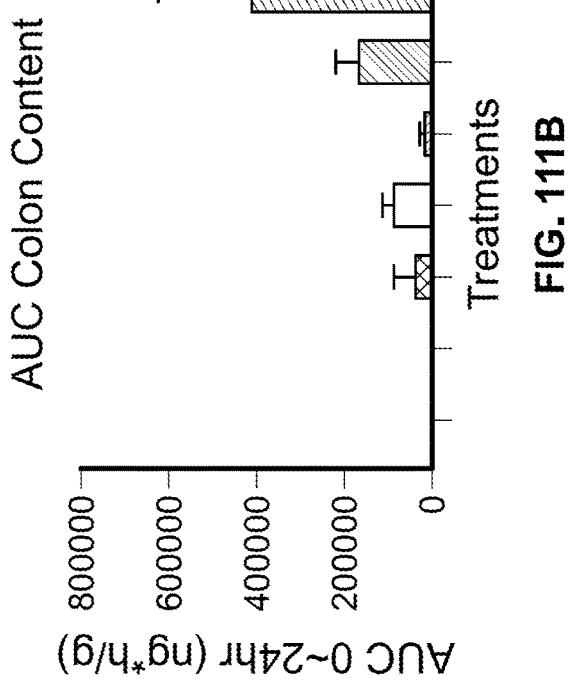
FIG. 111A
FIG. 111B
FIG. 111C

METHOD OF FORMULATING A PHARMACEUTICAL COMPOSITION COMPRISING ADMINISTERING AN IMMUNE MODULATOR TO THE SMALL INTESTINE

RELATED APPLICATIONS

This application claims the benefit of U.S. Provisional Application No. 62/687,766, filed Jun. 20, 2018, which is incorporated herein by reference in its entirety.

INCORPORATION BY REFERENCE OF SEQUENCE LISTING FILED ELECTRONICALLY

The instant application contains a Sequence Listing which has been submitted electronically in ASCII format and is hereby incorporated by reference in its entirety. Said ASCII copy, created on Jun. 14, 2019, is named 44090-0094WO1_SL.txt and is 724,256 bytes in size.

TECHNICAL FIELD

This disclosure features methods and compositions for treating a disease or condition in a tissue originating from the endoderm.

BACKGROUND

The tissues that originate from the endoderm are linked by, e.g., a lymphatic system. For example, the gastrointestinal tract, gallbladder, pancreas, and liver (all of which originate from the endoderm) drain into the mesenteric lymph system. Although the tissues that originate from the endoderm are susceptible to different inflammatory diseases or conditions, immune modulators that preferentially suppress immune response of the mesenteric lymph system may represent a new way to treat inflammatory diseases or conditions of tissues that arise from the endoderm.

SUMMARY

The present disclosure is based on the discovery that local, topical delivery of an immune modulator to the gastrointestinal tract can significantly reduce the mean number of pro-inflammatory T cells found locally within the mesenteric lymph nodes when compared to systemic and vehicle treatment. In some embodiments, fewer α4β7-expressing T cells were found in adjacent inflamed tissues proximal (small intestinal Payer's Patches) to where the drug was delivered (cecum).

The traditional immune modulator mechanism of action for systemically administered immune modulators is a systemic blockage of immune cell activation (e.g., T-cell activation), a systemic decrease in the secretion and/or expression of pro-inflammatory cytokines, and/or a systemic increase in the secretion of anti-inflammatory cytokines (e.g., systemically blocking T cell surface α4β7 integrin/MAdCAM-1 interaction, which leads thereby to reduced trafficking to inflamed tissues). However, when an immune modulator was applied topically (e.g., locally) to the gastrointestinal system (using any of the devices described herein), a significant, profound, and unexpected reduction in T cell number was observed in inflamed tissues, draining lymph nodes, as well as tissues adjacent and upstream of the topical site of drug delivery. Without wishing to be bound by any particular theory, these results suggest that blocking local α4β7 integrin interactions and T cell recruitment may be responsible. It is possible that blocking local α4β7 integrin interactions and T cell recruitment using immune modulators, may be reducing immune cell trafficking or reducing the "imprinting" of T cells to express α4β7 and become "gut homing." It is possible that topically-applied immune modulators are moving in the extracellular or lymph spaces including from distal to proximal gut. It is also possible that reduced trafficking of these immune cells through the lymph structures is resulting in reduced levels of immune cells in tissues that are not in areas directly treated with an immune modulator.

The observation of the pharmacodynamic effects of gastrointestinal-delivered immune modulators extends to the mesenteric lymph nodes (MSN), and the organs and tissues that drain into the MSN (a tissue originating from the endoderm), which suggests that locally-delivered (gastrointestinal tissue-delivered) immune modulators may have anti-inflammatory effects for a range of indications beyond the site of delivery. In some embodiments, the compositions and methods of the present disclosure are used to treat diseases and conditions that arise in a tissue originating from the endoderm. The endoderm forms the gastrointestinal tract, respiratory tract, endocrine glands and organs, auditory system and urinary system; therefore, the present disclosure includes compositions and methods for treating diseases and conditions found in the following tissues: the stomach, the colon, the liver, the pancreas, the gallbladder, the urinary bladder, the epithelial parts of trachea, the lungs, the pharynx, the thyroid, the parathyroid, the intestines, and the gallbladder.

Provided herein are methods of treating an inflammatory disease or condition that arises in a tissue originating from the endoderm in a subject, that include: releasing an immune modulator at a location in the gastrointestinal tract of the subject, where the methods include administering to the subject a pharmaceutical composition that includes a therapeutically effective amount of the immune modulator.

In some embodiments of these methods, the pharmaceutical composition is an ingestible device and the method includes administering orally to the subject the pharmaceutical composition. In some embodiments, the method comprises releasing at least 80%, 85%, 90%, or 95% of the immune modulator at a location that is proximate to the intended site of release. In some embodiments of these methods, the method provides a concentration of the immune modulator at a location that is an intended site of release that is 2-100 times greater than at a location that is not the intended site of release.

In some embodiments of any of the methods described herein, the method provides a concentration of the immune modulator in the plasma of the subject that is less than 3 μg/mL, less than 0.3 μg/mL, or less than 0.01 μg/mL.

In some embodiments of any of the methods described herein, the method provides a $C_{24}$ value of the immune modulator in the plasma of the subject that is less than 3 μg/mL, less than 0.3 μg/mL, or less than 0.01 μg/mL.

In some embodiments of any of the methods described herein, the immune modulator is an inhibitory nucleic acid. In some embodiments of any of the methods described herein, the immune modulator is a small molecule. In some embodiments of any of the methods described herein, the immune modulator is an antisense nucleic acid. In some embodiments of any of the methods described herein, the immune modulator is a ribozyme. In some embodiments of any of the methods described herein, the immune modulator is a siRNA.

In some embodiments of any of the methods described herein, the immune modulator is present in a pharmaceutical formulation within the ingestible device. In some embodiments of any of the methods described herein, the formulation is a solution of the immune modulator in a liquid medium. In some embodiments of any of the methods described herein, the formulation is a suspension of the immune modulator in a liquid medium.

In some embodiments of any of the methods described herein, the tissue originating from the endoderm is selected from the group of: the stomach, the colon, the liver, the pancreas, the urinary bladder, the epithelial parts of the trachea, the lungs, the pharynx, the thyroid, the parathyroid, the intestines, and the gallbladder. In some embodiments of any of the methods described herein, the inflammatory disease or condition originating from the endoderm is selected from the group of: gastritis, Celiac disease, hepatitis, alcoholic lever disease, fatty liver disease (hepatic steatosis), non-alcoholic fatty liver disease (NAFLD), non-alcoholic steatohepatitis (NASH), cirrhosis, primary schlerosing cholangitis, pancreatitis, insterstitial cystitits, asthma, chronic obstructic pulmonary disease, pulmonary fibrosis, pharyngitis, thyroiditis, hyperthyroidism, parathyroiditis, nephritis, Hashimoto's disease, Addison's disease, Graves' disease, Sjögren syndrome, type 1 diabetes, pelvic inflammatory disease, auditory canal inflammation, tinnitus, vestibular neuritis, otitis media, auditory canal inflammation, tracheitis, cholestatic liver disease, primary biliary sclerosis, liver parenchyma, an inherited metabolic disorder of the liver, Byler syndrome, cerebrotendinous, xanthomatosis, Zellweger's syndrome, neonatal hepatitis, cystic fibrosis, Alagilles syndrome (ALGS), PFIC (progressive familial intrahepatic cholestasis), autoimmune hepatitis, primary biliary cirrhosis (PBC), liver fibrosis, portal hypertension, general cholestasis, such as in jaundice due to drugs or during pregnancy, intra- and extrahepatic cholestasis, such as hereditary forms of cholestasis, such as PFIC1, gall stones and choledocholithiasis, malignancy causing obstruction of the biliary tree, symptoms (scratching, pruritus) due to cholestasis/jaundice, chronic autoimmune liver disease leading to progressive cholestasis, and pruritus of cholestatic liver disease, duodenal ulcers, enteritis (radiation-, chemotherapy-, or infection-induced enteritis), diverticulitis, pouchitis, cholecystitis, and cholangitis. In some embodiments of any of the methods described herein, the inflammatory disease or condition that arises in a tissue originating from the endoderm is inflammation of the liver.

In some embodiments of any of the methods described herein, the immune modulator is released at a location in the large intestine of the subject. In some embodiments of any of the methods described herein, the location is in the proximal portion of the large intestine. In some embodiments of any of the methods described herein, the location is in the distal portion of the large intestine.

In some embodiments of any of the methods described herein, the immune modulator is released at a location in the ascending colon of the subject. In some embodiments of any of the methods described herein, the location is in the proximal portion of the ascending colon. In some embodiments of any of the methods described herein, the location is in the distal portion of the ascending colon.

In some embodiments of any of the methods described herein, the immune modulator is released at a location in the cecum of the subject. In some embodiments of any of the methods described herein, the location is in the proximal portion of the cecum. In some embodiments of any of the methods described herein, the location is in the distal portion of the cecum.

In some embodiments of any of the methods described herein, the immune modulator is released at a location in the sigmoid colon of the subject. In some embodiments of any of the methods described herein, the location is in the proximal portion of the sigmoid colon. In some embodiments of any of the methods described herein, the location is in the distal portion of the sigmoid colon. In some embodiments of any of the methods described herein, the immune modulator is released at a location in the transverse colon of the subject. In some embodiments of any of the methods described herein, the location is in the proximal portion of the transverse colon. In some embodiments of any of the methods described herein, the location is in the distal portion of the transverse colon.

In some embodiments of any of the methods described herein, the immune modulator is released at a location in the descending colon of the subject. In some embodiments of any of the methods described herein, the location is in the proximal portion of the descending colon. In some embodiments of any of the methods described herein, the location is in the distal portion of the descending colon.

In some embodiments of any of the methods described herein, the immune modulator is released at a location in the small intestine of the subject. In some embodiments of any of the methods described herein, the location is in the proximal portion of the small intestine. In some embodiments of any of the methods described herein, the location is in the distal portion of the small intestine.

In some embodiments of any of the methods described herein, the immune modulator is released at a location in the duodenum of the subject. In some embodiments of any of the methods described herein, the location is in the proximal portion of the duodenum. In some embodiments of any of the methods described herein, the location is in the distal portion of the duodenum.

In some embodiments of any of the methods described herein, the immune modulator is released at a location in the jejunum of the subject. In some embodiments of any of the methods described herein, the location is in the proximal portion of the jejunum. In some embodiments of any of the methods described herein, the location is in the distal portion of the jejunum.

In some embodiments of any of the methods described herein, the immune modulator is released at a location in the ileum of the subject. In some embodiments of any of the methods described herein, the location is in the proximal portion of the ileum. In some embodiments of any of the methods described herein, the location is in the distal portion of the ileum.

In some embodiments of any of the methods described herein, the location at which the immune modulator is released is 10 cm or less from an intended site of release. In some embodiments of any of the methods described herein, the location at which the immune modulator is released is 5 cm or less from an intended site of release. In some embodiments of any of the methods described herein, the location at which the immune modulator is released is 2 cm or less from an intended site of release.

In some embodiments of any of the methods described herein, the immune modulator is released by mucosal contact. In some embodiments of any of the methods described herein, the immune modulator is delivered to the location by a process that does not comprise systemic transport of the immune modulator.

Some embodiments of any of the methods described herein further include identifying an intended site of release of the immune modulator using a method that includes imaging of the gastrointestinal tract. In some embodiments of any of the methods described herein, the method includes identifying an intended site of release of the immune modulator, prior to administering the pharmaceutical composition. In some embodiments of any of the methods described herein, the method includes releasing the immune modulator substantially at the same time as identifying the intended site of release of the immune modulator.

In some embodiments of any of the methods described herein, the methods include (a) identifying a subject having an inflammatory disease or condition that arises in a tissue originating from the endoderm, and (b) evaluating the subject for suitability to treatment.

In some embodiments of any of the methods described herein, the releasing of the immune modulator is triggered by one or more of: a pH in the jejunum from 6.1 to 7.2, a pH in the mid small bowel from 7.0 to 7.8, a pH in the ileum from 7.0 to 8.0, a pH in the right colon from 5.7 to 7.0, a pH in the mid colon from 5.7 to 7.4, or a pH in the left colon from 6.3 to 7.7, such as 7.0.

In some embodiments of any of the methods described herein, the releasing of the immune modulator is not dependent on the pH at or in the vicinity of the location.

In some embodiments of any of the methods described herein, the releasing of the immune modulator is triggered by degradation of a release component located in the device. In some embodiments of any of the methods described herein, the releasing of the immune modulator is not triggered by degradation of a release component located in the device. In some embodiments of any of the methods described herein, the releasing of the immune modulator is not dependent on enzymatic activity at or in the vicinity of the location. In some embodiments of any of the methods described herein, the releasing of the immune modulator is not dependent on bacterial activity at or in the vicinity of the location. In some embodiments of any of the methods described herein, the composition includes a plurality of electrodes including a coating, and releasing the immune modulator is triggered by an electric signal by the electrodes resulting from the interaction of the coating with an intended site of release of the immune modulator. In some embodiments of any of the methods described herein, the release of the immune modulator is triggered by a remote electromagnetic signal. In some embodiments of any of the methods described herein, the release of the immune modulator is triggered by generation in the composition of a gas in an amount sufficient to expel the immune modulator. In some embodiments of any of the methods described herein, the release of the immune modulator is triggered by an electromagnetic signal generated within the device according to a pre-determined drug release profile.

In some embodiments of any of the methods described herein, the ingestible device includes an ingestible housing, wherein a reservoir storing the immune modulator is attached to the housing. Some embodiments of any of the methods described herein further include: detecting when the ingestible housing is proximate to an intended site of release, where releasing the immune modulator includes releasing the therapeutically effective amount of the immune modulator from the reservoir proximate the intended site of release in response to the detection. In some embodiments of any of the methods described herein, the detecting includes detecting via one or more sensors coupled to the ingestible housing. In some embodiments of any of the methods described herein, the one or more sensors include a plurality of coated electrodes and wherein detecting includes receiving an electric signal by one or more of the coated electrodes responsive to the one or more electrode contacting the respective intended site of release. In some embodiments of any of the methods described herein, the releasing includes opening one or more valves in fluid communication with the reservoir. In some embodiments of any of the methods described herein, the one or more valves is communicably coupled to a processor positioned in the housing, the processor communicably coupled to one or more sensors configured to detect the intended site of release. In some embodiments of any of the methods described herein, the releasing includes pumping the therapeutically effective amount of the immune modulator from the reservoir via pump positioned in the ingestible housing. In some embodiments of the methods described herein, the pump is communicably coupled to a processor positioned in the housing, the processor communicably coupled to one or more sensors configured to detect an intended site of release of the immune modulator. In some embodiments of any of the methods described herein, the therapeutically effective amount of the immune modulator is stored in the reservoir at a reservoir pressure higher than a pressure in the gastrointestinal tract of the subject.

Some embodiments of any of the methods described herein further include anchoring the ingestible housing at a location proximate to the intended site of release in response to the detection. In some embodiments of any of the methods described herein, the anchoring the ingestible housing includes one or more legs to extend from the ingestible housing.

In some embodiments of any of the methods described herein, the amount of the immune modulator that is administered is from about 1 mg to about 500 mg. In some embodiments of any of the methods described herein, the immune modulator is an antibody or an antigen-binding antibody fragment. In some embodiments of any of the methods described herein, the antibody is a humanized antibody.

In some embodiments, the subject is administered the dose of the immune modulator once a day. In some embodiments, the subject is administered the dose of the immune modulator once every two days.

In some embodiments of any of the methods described herein, the amount of the immune modulator is less than an amount that is effective when the immune modulator is administered systemically. In some embodiments of any of the methods described herein, the methods include administering (i) an amount of the immune modulator that is an induction dose. Some embodiments of any of the methods described herein further include (ii) administering an amount of the immune modulator that is a maintenance dose following the administration of the induction dose. In some embodiments of any of the methods described herein, the induction dose is administered once a day. In some embodiments of any of the methods described herein, the induction dose is administered once every two days. In some embodiments of any of the methods described herein, the induction dose is administered once every three days. In some embodiments of any of the methods described herein, the induction dose is administered once a week. In some embodiments of any of the methods described herein, step (ii) is repeated one or more times. In some embodiments of any of the methods described herein, step (ii) is repeated once a day over a period of about 6-8 weeks. In some embodiments of any of the methods described herein, step (ii) is repeated once every three days over a period of about 6-8 weeks. In some embodiments of any of the methods described herein, step (ii) is repeated once a week over a period of about 6-8 weeks.

In some embodiments of any of the methods described herein, the induction dose is equal to the maintenance dose. In some embodiments of any of the methods described herein, the induction dose is greater than the maintenance dose. In some embodiments of any of the methods described herein, the induction dose is 5 times greater than the maintenance dose. In some embodiments of any of the methods described herein, the induction dose is 2 times greater than the maintenance dose. In some embodiments of any of the methods described herein, the induction dose is the same or nearly the same as the maintenance dose but it is administered more frequently (e.g., daily).

In some embodiments of any of the methods described herein, the method includes releasing the immune modulator at the location in the gastrointestinal tract as a single bolus. In some embodiments of any of the methods described herein, the method includes releasing the immune modulator at the location in the gastrointestinal tract as more than one bolus. In some embodiments of any of the methods described herein, the method includes delivering the immune modulator at the location in the gastrointestinal tract in a continuous manner. In some embodiments of any of the methods described herein, the method includes delivering the immune modulator at the location in the gastrointestinal tract over a time period of 20 or more minutes. In some embodiments of any of the methods described herein, the method does not include delivering an immune modulator rectally to the subject. In some embodiments of any of the methods described herein, the method does not include delivering an immune modulator via an enema to the subject. In some embodiments of any of the methods described herein, the method does not include delivering an immune modulator via suppository to the subject. In some embodiments of any of the methods described herein, the method does not include delivering an immune modulator via instillation to the rectum of the subject. In some embodiments of any of the methods described herein, the method does not include surgical implantation.

In some embodiments of any of the methods described herein, the immune modulator is an IL-12/IL-23 inhibitor. In some embodiments of any of the methods described herein, the immune modulator is a TNFα inhibitor. In some embodiments of any of the methods described herein, the immune modulator is a IL-6 receptor inhibitor. In some embodiments of any of the methods described herein, the immune modulator is a CD40/CD40L inhibitor. In some embodiments of any of the methods described herein, the immune modulator is a CD3 inhibitor. In some embodiments of any of the methods described herein, the immune modulator is a JAK inhibitor. In some embodiments of any of the methods described herein, the immune modulator is a IL-1 inhibitor. In some embodiments of any of the methods described herein, the immune modulator is a PDE4 inhibitor.

In some embodiments of any of the methods described herein, the composition is an autonomous device. In some embodiments of any of the methods described herein, the composition includes a mechanism capable of releasing the immune modulator. In some embodiments of any of the methods described herein, the composition includes a tissue anchoring mechanism for anchoring the composition to the location. In some embodiments of any of the methods described herein, the tissue anchoring mechanism is capable of activation for anchoring to the location. In some embodiments of any of the methods described herein, the tissue anchoring mechanism includes an osmotically-driven sucker. In some embodiments of any of the methods described herein, the tissue anchoring mechanism includes a connector operable to anchor the composition to the location. In some embodiments of any of the methods described herein, the connector is operable to anchor the composition to the location using an adhesive, negative pressure and/or fastener. In some embodiments of any of the methods described herein, the reservoir is an anchorable reservoir.

In some embodiments of any of the methods described herein, the pharmaceutical composition is an ingestible device, that includes: a housing; a reservoir located within the housing and containing the immune modulator, a mechanism for releasing the immune modulator from the reservoir; and an exit valve configured to allow the immune modulator to be released out of the housing from the reservoir. In some embodiments of any of the methods described herein, the ingestible device further includes: an electronic component located within the housing; and a gas generating cell located within the housing and adjacent to the electronic component, where the electronic component is configured to activate the gas generating cell to generate gas. In some embodiments of any of the methods described herein, the ingestible device further includes: a safety device placed within or attached to the housing, where the safety device is configured to relieve an internal pressure within the housing when the internal pressure exceeds a threshold level.

In some embodiments of any of the methods described herein, the pharmaceutical composition is an ingestible device, that includes: a housing defined by a first end, a second end substantially opposite from the first end, and a wall extending longitudinally from the first end to the second end; an electronic component located within the housing; a gas generating cell located within the housing and adjacent to the electronic component, where the electronic component is configured to activate the gas generating cell to generate gas; a reservoir located within the housing, where the reservoir stores a dispensable substance and a first end of the reservoir is attached to the first end of the housing; an exit valve located at the first end of the housing, where the exit valve is configured to allow the dispensable substance to be released out of the first end of the housing from the reservoir; and a safety device placed within or attached to the housing, where the safety device is configured to relieve an internal pressure within the housing when the internal pressure exceeds a threshold level.

In some embodiments of any of the methods described herein, the pharmaceutical composition is an ingestible device, that includes: a housing defined by a first end, a second end substantially opposite from the first end, and a wall extending longitudinally from the first end to the second end; an electronic component located within the housing, a gas generating cell located within the housing and adjacent to the electronic component, where the electronic component is configured to activate the gas generating cell to generate gas; a reservoir located within the housing, where the reservoir stores a dispensable substance and a first end of the reservoir is attached to the first end of the housing; an injection device located at the first end of the housing, where the jet injection device is configured to inject the dispensable substance out of the housing from the reservoir;

and a safety device placed within or attached to the housing, where the safety device is configured to relieve an internal pressure within the housing.

In some embodiments of any of the methods described herein, the pharmaceutical composition is an ingestible device, that includes: a housing defined by a first end, a second end substantially opposite from the first end, and a wall extending longitudinally from the first end to the second end; an optical sensing unit located on a side of the housing, where the optical sensing unit is configured to detect a reflectance from an environment external to the housing; an electronic component located within the housing; a gas generating cell located within the housing and adjacent to the electronic component, where the electronic component is configured to activate the gas generating cell to generate gas in response to identifying a location of the ingestible device based on the reflectance; a reservoir located within the housing, where the reservoir stores a dispensable substance and a first end of the reservoir is attached to the first end of the housing; a membrane in contact with the gas generating cell and configured to move or deform into the reservoir by a pressure generated by the gas generating cell; and a dispensing outlet placed at the first end of the housing, where the dispensing outlet is configured to deliver the dispensable substance out of the housing from the reservoir.

In some embodiments, provided herein is a method of treating a disease as disclosed herein, comprising:
administering to the subject a pharmaceutical formulation that comprises a therapeutic agent as disclosed herein, wherein the pharmaceutical formulation is released at a location in the gastrointestinal tract of the subject, such as a location that is proximate to the intended site of release.

In some embodiments, provided herein is a method of treating a disease as disclosed herein, comprising:
administering to the subject a pharmaceutical formulation that comprises a therapeutic agent as disclosed herein, wherein the pharmaceutical formulation is released at a location in the gastrointestinal tract of the subject, such as a location that is distal to one or more sites of disease.

In some embodiments, provided herein is a method of treating a disease as disclosed herein, comprising:
administering to the subject a pharmaceutical formulation that comprises a therapeutic agent as disclosed herein, wherein the pharmaceutical formulation is released at a location in the gastrointestinal tract of the subject, such as a location that is proximal to one or more sites of disease.

In some embodiments, provided herein is a method of treating a disease as disclosed herein, comprising:
administering to the subject a pharmaceutical formulation that comprises a therapeutic agent as disclosed herein, wherein the pharmaceutical formulation is released at a location in the gastrointestinal tract of the subject and the disease is present in an organ or tissue that originates from the endoderm in a subject. In some embodiments, the tissue originating from the endoderm is selected from the group of: the liver, the pancreas, and the small intestine. In some embodiments, the disease is an inflammatory disease or condition. In some embodiments, the disease is an autoimmune disease that results in inflammation. In some embodiments, the disease is a metabolic condition selected from the group of: diabetes, obesity, NAFLD, and NASH. In some embodiments, the pharmaceutical formulation is released at a location in the gastrointestinal tract selected from the group of: the duodenum, the jejunum, the ileum, and the cecum.

In some embodiments, the pharmaceutical formulation is administered in an ingestible device. In some embodiments, the pharmaceutical formulation is released from an ingestible device. In some embodiments, the ingestible device comprises a housing, a reservoir containing the pharmaceutical formulation, and a release mechanism for releasing the pharmaceutical formulation from the device,
wherein the reservoir is releasably or permanently attached to the exterior of the housing or internal to the housing.

In some embodiments, provided herein is a method of treating a disease as disclosed herein, comprising:
administering to the subject an ingestible device comprising a housing, a reservoir containing a pharmaceutical formulation, and a release mechanism for releasing the pharmaceutical formulation from the device,
wherein the reservoir is releasably or permanently attached to the exterior of the housing or internal to the housing;
wherein the pharmaceutical formulation comprises a therapeutic agent as disclosed herein, and
the ingestible device releases the pharmaceutical formulation at a location in the gastrointestinal tract of the subject, such as a location that is proximate to one or more sites of disease.

In some embodiments, provided herein is a method of treating a disease as disclosed herein, comprising:
administering to the subject an ingestible device comprising a housing, a reservoir containing a pharmaceutical formulation, and a release mechanism for releasing the pharmaceutical formulation from the device,
wherein the reservoir is releasably or permanently attached to the exterior of the housing or internal to the housing;
wherein the pharmaceutical formulation comprises a therapeutic agent as disclosed herein, and
the ingestible device releases the pharmaceutical formulation at a location in the gastrointestinal tract of the subject, such as a location that allows for greater efficacy of the pharmaceutical formulation, wherein greater efficacy of the pharmaceutical formulation provides improved pharmacodynamic effects in a target tissue originating from the endoderm as compared to the pharmacodynamic effects in the same target tissue when the pharmaceutical formulation is administered via traditional administration. Examples of traditional administration include, but are not limited to, oral administration of a solid dosage form with a non-device capsule or tablet, subcutaneous administration, and intravenous administration.

In some embodiments, provided herein is a method of treating a disease as disclosed herein, comprising:
administering to the subject an ingestible device comprising a housing, a reservoir containing a pharmaceutical formulation, and a release mechanism for releasing the pharmaceutical formulation from the device,
wherein the reservoir is releasably or permanently attached to the exterior of the housing or internal to the housing;
wherein the pharmaceutical formulation comprises a therapeutic agent as disclosed herein, and
the ingestible device releases the pharmaceutical formulation at a location in the gastrointestinal tract of the subject, such as a location that allows for an improved safety profile of the pharmaceutical formulation, wherein improved safety of the pharmaceutical formulation provides fewer side effects as compared to the side effects when the pharmaceutical formulation is administered via traditional administration. Examples of traditional administration include, but are not limited to, oral administration of a solid dosage form with a non-device capsule or tablet, subcutaneous administration, and intravenous administration. In a related embodiment, in addition to an improved safety profile, the method of treating also yields equal or greater efficacy when compared to the efficacy of the pharmaceutical formulation administered via traditional administration. In some embodiments, the housing is non-biodegradable in the GI tract.

In some embodiments, the release of the formulation is triggered autonomously. In some embodiments, the device is programmed to release the formulation with one or more release profiles that may be the same or different at one or more locations. In some embodiments, the device is programmed to release the formulation at a location proximate to one or more sites of disease. In some embodiments, the location of one or more sites of disease is predetermined. In some embodiments, the device is programmed to release the formulation at a location that provides greater efficacy in a tissue originating from the endoderm as compared to delivery via traditional means (e.g., a non-device capsule or tablet, subcutaneous administration, or intravenous administration).

In some embodiments, the reservoir is made of a material that allows the formulation to leave the reservoir, such as a biodegradable material.

In some embodiments, the release of the formulation is triggered by a pre-programmed algorithm. In some embodiments, the release of the formulation is triggered by data from a sensor or detector to identify the location of the device. In some more particular embodiments, the data is not based solely on a physiological parameter (such as pH, temperature, and/or transit time).

In some embodiments, the device comprises a detector configured to detect light reflectance from an environment external to the housing. In some more particular embodiments, the release is triggered autonomously or based on the detected reflectance. For a description of systems and methods for device localization see US Patent Publication Nos. US20170296092 and US20180279908, the disclosures of which are incorporated herein by reference in their entirety.

In some embodiments, the device releases the formulation at substantially the same time as one or more sites of disease are detected. In some embodiments, the one or more sites of disease are detected by the device (e.g., by imaging the GI tract).

In some embodiments, the release mechanism is an actuation system. In some embodiments, the release mechanism is a chemical actuation system. In some embodiments, the release mechanism is a mechanical actuation system. In some embodiments, the release mechanism is an electrical actuation system. In some embodiments, the actuation system comprises a pump and releasing the formulation comprises pumping the formulation out of the reservoir. In some embodiments, the actuation system comprises a gas generating cell.

In some embodiments, the device further comprises an anchoring mechanism. In some embodiments, the formulation comprises a therapeutically effective amount of the therapeutic agent as disclosed herein. In some embodiments, the formulation comprises a human equivalent dose (HED) of the therapeutic agent as disclosed herein. In some embodiments, the therapeutically effective amount of the therapeutic agent is less than the therapeutically effective amount of the therapeutic agent when said therapeutic agent is administered by traditional means (e.g., a non-device capsule or tablet, subcutaneous administration, or intravenous administration).

In some embodiments, the device is a device capable of releasing a solid therapeutic agent as disclosed herein or a solid formulation comprising the therapeutic agent as disclosed herein. In some embodiments, the device is a device capable of releasing a liquid therapeutic agent as disclosed herein or a liquid formulation comprising the therapeutic agent as disclosed herein. Accordingly, in some embodiments of the methods herein, the pharmaceutical formulation release from the device is a solid formulation. Accordingly, in some embodiments of the methods herein, the pharmaceutical formulation release from the device is a liquid formulation.

The devices disclosed herein are capable of releasing a therapeutic agent as disclosed herein or a formulation comprising the therapeutic agent as disclosed herein irrespective of the particular type of therapeutic agent as disclosed herein. For example, the therapeutic agent as disclosed herein may be a small molecule, a biological, a nucleic acid, an antibody, a fusion protein, and so on.

In some embodiments, provided herein is a method of releasing a therapeutic agent as disclosed herein into the gastrointestinal tract of a subject for treating one or more diseases or conditions in an organ or tissue originating from the endoderm, the method comprising: administering to the subject a therapeutically effective amount of the therapeutic agent as disclosed herein housed in an ingestible device, wherein the ingestible device comprises a detector configured to detect a location in the gastrointestinal tract, and a controller or processor configured to trigger the release of the therapeutic agent as disclosed herein proximate to the one or more sites of disease in response to the detector detecting the presence of the one or more sites of disease.

In some embodiments, provided herein is a method of releasing a therapeutic agent as disclosed herein into the gastrointestinal tract of a subject for treating one or more pre-determined sites of disease within the gastrointestinal tract, the method comprising:
administering to the subject a therapeutically effective amount of the therapeutic agent as disclosed herein contained in an ingestible device, wherein the ingestible device comprises
a detector configured to detect the location of the device within the gastrointestinal tract, and
a controller or processor configured to trigger the release of the therapeutic agent as disclosed herein proximate to the one or more predetermined sites of disease in response to the detector detecting a location of the device that corresponds to the location of the one or more pre-determined sites of disease.

In some embodiments, provided herein is a method of releasing a therapeutic agent as disclosed herein into the gastrointestinal tract of a subject for treating one or more sites of disease within the gastrointestinal tract, the method comprising:
administering to the subject a therapeutically effective amount of the therapeutic agent as disclosed herein contained in an ingestible device;
receiving at an external receiver from the device a signal transmitting environmental data;

assessing the environmental data to confirm the presence of the one or more sites of disease; and when the presence of the one or more sites of disease is confirmed, sending from an external transmitter to the device a signal triggering the release of the therapeutic agent as disclosed herein proximate to the one or more sites of disease.

In some embodiments, provided herein is a method of releasing a therapeutic agent as disclosed herein into the gastrointestinal tract of a subject for treating one or more sites of disease within the gastrointestinal tract, the method comprising:

administering to the subject a therapeutically effective amount of the therapeutic agent as disclosed herein contained in an ingestible device;

receiving at an external receiver from the device a signal transmitting environmental or optical data;

assessing the environmental or optical data to confirm the location of the device within the gastrointestinal tract; and when the location of the device is confirmed, sending from an external transmitter to the device a signal triggering the release of the therapeutic agent as disclosed herein proximate to the one or more sites of disease.

In some embodiments of any of the methods described herein, the pharmaceutical composition is an ingestible device as disclosed in PCT International Patent Application Ser.

No. PCT/US2017/050642, which published as WO2018/049133 and is herein incorporated by reference in its entirety. In some embodiments of any of the methods described herein, the pharmaceutical composition is an ingestible device that includes localization methods and systems as disclosed in international patent applications PCT/US2015/052500 and PCT/US2018/025191, both of which are incorporated by reference herein in their entireties. In some embodiments of any of the methods described herein, the pharmaceutical composition is not a dart-like dosage form.

Exemplary Methods of Treating a Disease or Condition in a Tissue or Organ Originating from the Endoderm with an Immune Modulator 1. Topical Administration of Drug to the GI Tract of a Subject Exemplary non-limiting embodiments follow.

In some embodiments, provided herein is a method of treating a disease or condition in a tissue or organ originating from the endoderm of a subject, comprising:

topically administering to the GI tract of the subject (i) an immune modulator or (ii) a pharmaceutical formulation that comprises an immune modulator;

wherein the topical administration comprises administering the immune modulator or the pharmaceutical formulation that comprises the immune modulator (a) to a section or subsection of the GI tract proximate to an intended site of release, or (b) proximal to a section or subsection of the GI tract containing one or more disease sites. In some embodiments, the intended site of release in the GI tract is a location that allows for greater efficacy of the pharmaceutical formulation, wherein greater efficacy of the pharmaceutical formulation provides improved pharmacodynamic effects in a target tissue originating from the endoderm as compared to the pharmacodynamic effects in the same target tissue when the pharmaceutical formulation is administered via traditional administration. In some embodiments, the intended site of release in the GI tract is a location that allows for an improved safety profile of the pharmaceutical formulation, wherein improved safety of the pharmaceutical formulation provides fewer side effects as compared to the side effects when the pharmaceutical formulation is administered via traditional administration.

Preferably, the disease or condition is an inflammatory disease or condition in an endoderm tissue. For example, the inflammatory disease or condition that arises in a tissue originating from the endoderm is selected from the group of: gastritis, Celiac disease, hepatitis, alcoholic liver disease, fatty liver disease (non-alcoholic hepatic steatosis (NASH)), non-alcoholic fatty liver disease (NAFLD), cirrhosis, primary schlerosing cholangitis, pancreatitis, insterstitial cystitits, asthma, chronic obstructive pulmonary disease, pulmonary fibrosis, pharyngitis, thyroiditis, hyperthyroidism, parathyroiditis, nephritis, Hashimoto's disease, Addison's disease, Graves' disease, Sjögren syndrome, type 1 diabetes, obesity, pelvic inflammatory disease, auditory canal inflammation, tinnitus, vestibular neuritis, otitis media, auditory canal inflammation, tracheitis, cholestatic liver disease, primary biliary sclerosis, liver parenchyma, an inherited metabolic disorder of the liver, Byler syndrome, cerebrotendinous, xanthomatosis, Zellweger's syndrome, neonatal hepatitis, cystic fibrosis, ALGS (Alagilles syndrome), PFIC (progressive familial intrahepatic cholestasis), autoimmune hepatitis, primary biliary cirrhosis (PBC), liver fibrosis, NAFLD, portal hypertension, general cholestasis, such as in jaundice due to drugs or during pregnancy, intra- and extrahepatic cholestasis, such as hereditary forms of cholestasis, such as PFIC1, gall stones and choledocholithiasis, malignancy causing obstruction of the biliary tree, symptoms (scratching, pruritus) due to cholestasis/jaundice, chronic autoimmune liver disease leading to progressive cholestasis, and pruritus of cholestatic liver disease, duodenal ulcers, enteritis (radiation-, chemotherapy-, or infection-induced enteritis), diverticulitis, pouchitis, cholecystitis, and cholangitis. More preferably, the disease or condition is an inflammatory bowel disease, liver disease, or diabetes.

In some embodiments, when the disease or condition is an inflammatory bowel disease, the section or subsection of the GI tract of the subject containing the one or more disease sites is the duodenum, and the immune modulator or the pharmaceutical formulation that comprises the immune modulator is administered to the cecum. In some embodiments, the disease or condition is Crohn's disease.

In some embodiments, when the disease or condition is an inflammatory bowel disease, the section or subsection of the GI tract of the subject containing the one or more disease sites is the duodenum, and the immune modulator or the pharmaceutical formulation that comprises the immune modulator is administered to the duodenum. In some embodiments, the disease or condition is Crohn's disease.

In some embodiments, when the disease or condition is an inflammatory bowel disease, the section or subsection of the GI tract of the subject containing the one or more disease sites is the jejunum, and the immune modulator or the pharmaceutical formulation that comprises the immune modulator is administered to the cecum. In some embodiments, the disease or condition is Crohn's disease.

In some embodiments, when the disease or condition is an inflammatory bowel disease, the section or subsection of the GI tract of the subject containing the one or more disease sites is the jejunum, and the immune modulator or the pharmaceutical formulation that comprises the immune modulator is administered to the jejunum. In some embodiments, the disease or condition is Crohn's disease.

In some embodiments, when the disease or condition is an inflammatory bowel disease, the section or subsection of the GI tract of the subject containing the one or more disease sites is the ileum, and the immune modulator or the pharmaceutical formulation that comprises the immune modulator is administered to the cecum. In some embodiments, the disease or condition is Crohn's disease. In some further embodiments, the disease or condition is ileal Crohn's disease. In some other embodiments, the disease or condition is ulcerative colitis with at least one or more disease sites in the terminal ileum.

In some embodiments, when the disease or condition is an inflammatory bowel disease, the section or subsection of the GI tract of the subject containing the one or more disease sites is the ileum, and the immune modulator or the pharmaceutical formulation that comprises the immune modulator is administered to the ileum. In some embodiments, the disease or condition is Crohn's disease. In some further embodiments, the disease or condition is ileal Crohn's disease. In some other embodiments, the disease or condition is ulcerative colitis with at least one or more disease sites in the terminal ileum.

In some embodiments, when the disease or condition is an inflammatory bowel disease, the section or subsection of the GI tract of the subject containing the one or more disease sites is the cecum, and the immune modulator or the pharmaceutical formulation that comprises the immune modulator is administered to the ileum. In some embodiments, the disease or condition is ulcerative colitis.

In some embodiments, when the disease or condition is an inflammatory bowel disease, the section or subsection of the GI tract of the subject containing the one or more disease sites is the cecum, and the immune modulator or the pharmaceutical formulation that comprises the immune modulator is administered to the cecum. In some embodiments, the disease or condition is ulcerative colitis.

In some embodiments, when the disease or condition is an inflammatory bowel disease, the section or subsection of the GI tract of the subject containing the one or more disease sites is the colon, and the immune modulator or the pharmaceutical formulation that comprises the immune modulator is administered to the cecum. In some embodiments, the disease or condition is ulcerative colitis.

In some embodiments, when the disease or condition is an inflammatory bowel disease, the section or subsection of the GI tract of the subject containing the one or more disease sites is the colon, and the immune modulator or the pharmaceutical formulation that comprises the immune modulator is administered to the colon. In some embodiments, the disease or condition is ulcerative colitis.

In some embodiments, when the disease or condition is an inflammatory bowel disease, the section or subsection of the GI tract of the subject containing the one or more disease sites is the ascending colon, and the immune modulator or the pharmaceutical formulation that comprises the immune modulator is administered to the cecum. In some embodiments, the disease or condition is ulcerative colitis.

In some embodiments, when the disease or condition is an inflammatory bowel disease, the section or subsection of the GI tract of the subject containing the one or more disease sites is the transverse colon, and the immune modulator or the pharmaceutical formulation that comprises the immune modulator is administered to the cecum or ascending colon. In some embodiments, the disease or condition is ulcerative colitis.

In some embodiments, when the disease or condition is an inflammatory bowel disease, the section or subsection of the GI tract of the subject containing the one or more disease sites is the transverse colon, and the immune modulator or the pharmaceutical formulation that comprises the immune modulator is administered to the cecum. In some embodiments, the disease or condition is ulcerative colitis.

In some embodiments, when the disease or condition is an inflammatory bowel disease, the section or subsection of the GI tract of the subject containing the one or more disease sites is the descending colon, and the immune modulator or the pharmaceutical formulation that comprises the immune modulator is administered to the cecum. In some embodiments, the disease or condition is ulcerative colitis.

In some embodiments, when the disease or condition is an inflammatory bowel disease, the section or subsection of the GI tract of the subject containing the one or more disease sites is the descending colon, and the immune modulator or the pharmaceutical formulation that comprises the immune modulator is administered to the cecum. In some embodiments, the disease or condition is ulcerative colitis.

In some embodiments, the method of treating the disease or condition in a tissue or organ originating from the endoderm of the subject comprises administering a therapeutically effective amount of the immune modulator. In some embodiments, the therapeutically effective amount of the immune modulator is an induction dose. In some embodiments, the therapeutically effective amount of the immune modulator is a maintenance dose. In some embodiments, the method comprises administering an induction dose and subsequently administering a maintenance dose of the immune modulator.

In some embodiments, the method provides a concentration of the immune modulator in the subject's blood, serum, or plasma of less than about 2000 ng/mL. In some further embodiments, the method provides a concentration of the immune modulator in the subject's blood, serum, or plasma of less than about 1000 ng/mL. In some further embodiments, the method provides a concentration of the immune modulator in the subject's blood, serum, or plasma of less than about 500 ng/mL. In some further embodiments, the method provides a concentration of the immune modulator in the subject's blood, serum, or plasma of less than or equal to about 100 ng/mL. In yet some further embodiments, the method provides a concentration of the immune modulator in the subject's blood, serum, or plasma of less than or equal to about 50 ng/mL. In some even further embodiments, the method provides a concentration of the immune modulator in the subject's blood, serum, or plasma of less than or equal to about 10 ng/mL.

In some embodiments, the method provides a concentration of the immune modulator in the subject's blood, serum, or plasma of about 1 ng/mL to about 100 ng/mL. In some further embodiments, the method provides a concentration of the immune modulator in the subject's blood, serum, or plasma of about 1 ng/mL to about 50 ng/mL, about 1 ng/mL to about 30 ng/mL, about 1 ng/mL to about 10 ng/mL, or about 1 ng/mL to about 5 ng/mL.

In some embodiments, the method provides a ratio of GI tissue concentration of the immune modulator to blood, serum, or plasma concentration of the immune modulator of about 2:1 to about 3000:1, about 2:1 to about 2000:1, about 2:1 to about 1000:1, or about 2:1 to about 600:1.

In some embodiments, the method provides a ratio of luminal content concentration of the immune modulator to blood, serum, or plasma concentration of the immune modulator of about 2:1 to about 3000:1, about 2:1 to about 2000:1, about 2:1 to about 1000:1, or about 2:1 to about 600:1. In some embodiments, luminal content concentration of the immune modulator is measured from feces (e.g., using a fecal swab) or GI aspirate.

In some embodiments, the method provides a plasma concentration of immune modulator that is reduced relative to the plasma concentration after systemic administration of the same amount of immune modulator.

In some embodiments, the method provides a Th memory cell count in the GI tract of the subject that is reduced relative to systemic administration of the same amount of the immune modulator. In some embodiments, the method provides a Th memory cell count in tissue originating from the endoderm of the subject that is reduced relative to systemic administration of the same amount of the immune modulator. In some embodiments, the method provides a Th memory cell count in the mesenteric lymph nodes, Peyer's patches, or both, of the subject that is reduced relative to systemic administration of the same amount of the immune modulator. In some further embodiments, the method provides a Th memory cell count in the mesenteric lymph nodes of the subject that is reduced relative to systemic administration of the same amount of the immune modulator. In some more particular embodiments, the method provides a reduction in Th memory cell count in the mesenteric lymph nodes of the subject relative to systemic administration of the same amount of the immune modulator that is at least a 10% reduction, at least a 20% reduction, at least a 30% reduction, at least a 40% reduction or at least a 50% reduction. In other further embodiments, the method provides a Th memory cell count in the Peyer's Patches of the subject that is reduced relative to systemic administration of the same amount of the immune modulator. In some more particular embodiments, the reduction in the Th memory cell count in the Peyer's Patches of the subject relative to the systemic administration is at least two-fold. In other more particular embodiments, the method provides a reduction in Th memory cell count in the Peyer's Patches of the subject relative to systemic administration of the same amount of the immune modulator that is at least a 10% reduction. In other embodiments, the method provides a Th memory cell count in the blood, scrum or plasma of the subject that is increased relative to systemic administration of the same amount of the immune modulator. In some more particular embodiments, the method provides a Th memory cell count increase in the blood, serum or plasma of the subject relative to systemic administration of the same amount of the immune modulator that is at least a 1% increase, at least a 5% increase, at least at 10% increase or at least a 15% increase.

In some embodiments, the immune modulator is an immune modulator as disclosed herein. In some embodiments, the immune modulator is a small molecule, an antibody, a peptide, a peptide fragment or a nucleic acid. In some embodiments, the immune modulator is an antibody selected from the group consisting of vedolizumab, natalizumab, etrolizumab, vatelizumab and PF-00547659; and biosimilars thereof. In some preferred embodiments, the immune modulator is vedolizumab or a biosimilar thereof. In other embodiments, the immune modulator is a peptide selected from the group consisting of PTG-100 and PN-10943 (also known as PN-943); and pharmaceutically acceptable salts thereof. In some other embodiments, the immune modulator is a small molecule selected from the group consisting of AJM-300, HCA2969 (carotegrast), firategrast, valategrast, RO0270608, CDP-323, CT7758, GW-559090, ELND-004, a compound of Formula (I), a compound of Formula (II), a compound of Formula (III) and a compound of Formula (IV); and pharmaceutically acceptable salts thereof. In some preferred embodiments, the small molecule immune modulator is AJM-300, or a pharmaceutically acceptable salt thereof. In some other preferred embodiments, the small molecule immune modulator is HCA2969 (carotegrast), or a prodrug thereof; or a pharmaceutically acceptable salt thereof; provided that the prodrug of carotegrast is not AJM300. In some other preferred embodiments, the small molecule immune modulator is HCA2969 (carotegrast); or a pharmaceutically acceptable salt thereof.

In some embodiments, the immune modulator or the pharmaceutical formulation comprising the immune modulator is contained in a device selected from an endoscope, an ingestible device, or a reservoir. In some embodiments, the endoscope comprises a catheter. In some embodiments, the catheter is a spray catheter. In some embodiments, the endoscope is connected to the reservoir. In some embodiments, the reservoir is an anchorable reservoir.

In some embodiments, the pharmaceutical formulation is a suppository for rectal administration. In other embodiments, the pharmaceutical formulation is an enema for rectal administration. In some further embodiments, the enema for rectal administration is for sustained release or for delayed release.

In some embodiments, the immune modulator is a small molecule or peptide, and the formulation is a formulation as disclosed herein. In some embodiments, the concentration of the immune modulator in the formulation is at least about 5 mg/mL, such as at least about 10 mg/mL, such as at least about 15 mg/mL.

In some embodiments, the immune modulator is a therapeutic protein or an antibody, such as a monoclonal antibody, and the formulation is a formulation as disclosed herein. In some embodiments, the concentration of the immune modulator in the formulation is at least about 110 mg/mL, or at least about 125 mg/mL.

2. Topical Administration of Drug to the GI Tract of a Subject Via Oral Administration of an Ingestible Device as Disclosed Herein.

Exemplary non-limiting embodiments follow.

In some embodiments, provided herein is a method of treating an inflammatory disease or condition in a tissue or organ originating from the endoderm of a subject, comprising:
  orally administering to the subject an ingestible device comprising (i) an immune modulator or (ii) a pharmaceutical formulation that comprises an immune modulator, and
  releasing the immune modulator or the pharmaceutical formulation that comprises the immune modulator from the ingestible device (a) to a section or subsection of the GI tract proximate to an intended site of release, or (b) proximal to a section or subsection of the GI tract containing one or more disease sites.

3. Topical Administration of Drug to the GI Tract of a Subject Via Oral Administration of an Ingestible Device as Disclosed Herein, Further Comprising Localizing the Ingestible Device to a Pre-Selected Location of the GI Tract of the Subject.

Exemplary non-limiting embodiments follow.

In some embodiments, provided herein is a method of treating an inflammatory disease or condition in a tissue or organ originating from the endoderm of a subject, comprising:

orally administering to the subject an ingestible device comprising (i) an immune modulator or (ii) a pharmaceutical formulation that comprises an immune modulator, localizing the device to a pre-selected location of the GI tract of the subject; and releasing the immune modulator or the pharmaceutical formulation that comprises the immune modulator from the ingestible device (a) to a section or subsection of the GI tract proximate to an intended site of release, or (b) proximal to a section or subsection of the GI tract containing one or more disease sites.

Preferably, the inflammatory disease or condition is an inflammatory bowel disease. In a more particular embodiment, the inflammatory bowel disease is ulcerative colitis. In another more particular embodiment, the inflammatory bowel disease is Crohn's disease. In yet another more particular embodiment, the inflammatory bowel disease is ileal Crohn's disease.

4. Topical Administration of Drug to the GI Tract of a Subject Via Oral Administration of an Ingestible Device as Disclosed Herein, Further Comprising Localizing the Ingestible Device to a Pre-Selected Location of the GI Tract of the Subject, Wherein the Device is a Self-Localizing Device.

In some embodiments, the ingestible device is configured to determine the device location within the subject's GI tract. In some embodiments, the ingestible device comprises a self-localization mechanism configured to determine the device location within the subject's GI tract, and is thus a self-localizing device.

In some embodiments, the device is self-localized to a pre-selected location in the GI tract of the subject. Thus, in some further embodiments, the method of treating a disease or condition in a tissue or organ originating from the endoderm comprises localizing the device to a pre-selected location in the GI tract of the subject. In some embodiments, the pre-selected location is the section or subsection of the GI tract containing the one or more inflammatory disease sites. In other embodiments, the pre-selected location is proximal to the section or subsection of the GI tract containing the one or more inflammatory disease sites. In some further embodiments, the pre-selected location immediately precedes the section or subsection of the subject's GI tract containing the one or more inflammatory disease sites. In yet some further embodiments, the pre-selected location does not contain or has not been determined to contain a disease site.

In some exemplary embodiments, the method of treating a disease or condition in a tissue or organ originating from the endoderm of the subject comprises using a self-localizing device comprising at least one sensor configured to collect data, such as optical data, from the portions of the GI tract through which the device has travelled, including the portion of the GI tract in which the device is presently located. In some more particular embodiments, the device determines its location based on data collected by at least one sensor. In some more particular embodiments, the sensor comprises a light sensor and the data comprises optical data. In some more particular embodiments, the optical data is data collected by a system that includes at least one light source and at least one light detector. In some more particular embodiments, the light detector comprises a light sensor.

In some more particular embodiments, the device determines its location (self-localizes) to the stomach about one (1) minute following transition of the device into the GI tract (e.g., time after entry of the device into the mouth, or time after swallowing the device). In some more particular embodiments, the device determines its location to the jejunum about three (3) minutes following transition of the device from the stomach to the duodenum. In some more particular embodiments, the device is also localized in response to detection of a temperature change in the GI tract or in the portion of the GI tract where the device is located, relative to a portion of the GI trace where the device was previously located. In some more particular embodiments, the device is also localized upon detection of a pH change in the GI tract or in the portion of the GI tract where the device is located, relative to a portion of the GI trace where the device was previously located. In other more particular embodiments, localizing the device does not comprise measuring the pH in the GI tract or in the portion of the GI tract where the device is or was previously located. In some more particular embodiments, the device includes one or more machine readable hardware storage devices that store instructions that are executable by one or more processing devices to determine the location of the device.

In some more particular embodiments, the device determines its location within the GI tract of the subject with an accuracy of at least about 85%. In some more particular embodiments, transition of the device from one portion of the GI tract into an adjacent portion of the GI tract is determined by the device with an accuracy of at least about 85%. In some more particular embodiments, transition of the device from the stomach to the duodenum is determined with an accuracy of at least about 90%. In some more particular embodiments, transition of the device from the duodenum to the jejunum is determined with an accuracy of at least about 90%. In some more particular embodiments, transition of the device from the jejunum to the ileum is determined with an accuracy of at least about 80%. In some more particular embodiments, transition of the device from the ileum to the cecum is determined with an accuracy of at least about 80%.

In some embodiments, provided herein is a method of treating an inflammatory disease or condition in a tissue or organ originating from the endoderm of a subject, comprising:

orally administering to the subject a self-localizing ingestible device comprising (i) an immune modulator or (ii) a pharmaceutical formulation that comprises an immune modulator, localizing the device to a pre-selected location of the GI tract of the subject, and releasing the immune modulator or the pharmaceutical formulation that comprises the immune modulator from the ingestible (a) to a section or subsection of the GI tract proximate to an intended site of release, or (b) proximal to a section or subsection of the GI tract containing one or more disease sites;

wherein the device is self-localized to the pre-selected location based on data comprising:
(a) optical data;
(b) elapsed time after entry of the device into the GI tract of the subject; or
(c) a combination of (a) and (b).

In some embodiments, the optical data comprises light reflectance that is external to the device and within the GI tract of the subject.

Preferably, the inflammatory disease or condition is an inflammatory bowel disease. In a more particular embodiment, the inflammatory bowel disease is ulcerative colitis. In another more particular embodiment, the inflammatory bowel disease is Crohn's disease. In yet another more particular embodiment, the inflammatory bowel disease is ileal Crohn's disease.

In some embodiments, the pre-selected location is the section or subsection of the GI tract containing the one or more inflammatory disease sites, or an intended site that allows for greater efficacy and/or improved safety when treating an autoimmune or inflammatory condition in tissue originating from the endoderm.

In some embodiments, provided herein is a method of treating an inflammatory disease or condition in a tissue or organ originating from the endoderm of a subject, comprising:
  orally administering to the subject a self-localizing ingestible device comprising (i) an immune modulator or (ii) a pharmaceutical formulation that comprises an immune modulator,
  localizing the device to a pre-selected location of the GI tract of the subject, and
  releasing the immune modulator or the pharmaceutical formulation that comprises the immune modulator from the ingestible device (a) to a section or subsection of the GI tract proximate to an intended site of release, or (b) proximal to a section or subsection of the GI tract containing one or more disease sites;
  wherein the device is self-localized to the pre-selected location based on detecting one or more device transitions between portions of the subject's GI tract; and
  optionally, the one or more device transitions occurs between the portions of the GI tract selected from the group consisting of mouth and stomach; esophagus and stomach; stomach and duodenum; duodenum and jejunum; jejunum and ileum; ileum and cecum; and cecum and colon; and combinations of any two or more of the foregoing device transitions.

In some embodiments, the detection of the one or more device transitions is based on data comprising light reflectance occurring external to the device and within the GI tract of the subject, elapsed time after entry of the device into the GI tract of the subject, or a combination thereof. In some embodiments, the device comprising the self-localization mechanism (the self-localizing device) comprises a first light source and a second light source. In some embodiments, the first light source is configured to emit light at a first wavelength, and the second light source is configured to emit light at a second wavelength different from the first wavelength. In some embodiments, the self-localizing device further comprises a first detector and a second detector, wherein the first detector is configured to detect light at the first wavelength, and the second detector is configured to detect light at the second wavelength. In some further embodiments, the first wavelength and second wavelength are each independently selected from the group consisting of red light, green light and blue light.

In another more particular embodiment, the detected reflectance includes green light and blue light, wherein an increase in the ratio of the green to blue reflectance detected indicates that the device has transitioned from the stomach to the duodenum.

In other more particular embodiments, the detected reflectance includes red light, wherein a decrease in red light reflectance detected indicates that the device has transitioned from the jejunum to the ileum.

In other more particular embodiments, the detected reflectance includes red light, green light and blue light, wherein a change in the ratio of the red to green reflectance detected, and/or a change in the coefficient of variation (CV) of the detected blue reflectance, indicates that the device has transitioned from the cecum further into the colon.

In some embodiments, the ingestible device further comprises a mechanism to monitor elapsed time. In some embodiments, the elapsed time is a period of time that begins after entry of the ingestible device into the GI tract of the subject. In some embodiments, the elapsed time is a period of time that begins after entry of the ingestible device into the mouth of the subject. In some embodiments, the elapsed time is a period of time that begins after the ingestible device is swallowed by the subject. In some embodiments, the elapsed time is a period of time that ends after the device exits the GI tract. In some embodiments, the elapsed time is a period of time that ends when the device exits the GI tract. In some embodiments, the elapsed time is a period of time that ends after the device has localized to a portion of the GI tract. In some embodiments, the elapsed time is a period of time that ends after the mechanism to monitor elapsed time is inactivated. In some embodiments, the elapsed time includes or consists of time of transition, or the elapsed time during passage of the device from one portion of the GI tract into a second portion of the GI tract. In some embodiments, the elapsed time includes or consists of time following transition, or the elapsed time after passage of the device from one portion of the GI tract into a second portion of the GI tract. In some further embodiments, the elapsed time after entry of the device into the GI tract of the subject comprises time of transition, time following transition, or a combination thereof. In some embodiments, the mechanism configured to monitor elapsed time is a clock circuitry.

In some more particular embodiments, the time of transition is elapsed time during passage of the device from mouth to stomach. In some embodiments, the time of transition is elapsed time during passage of the device from esophagus to stomach. In some embodiments, the time following transition is elapsed time after passage of the device from stomach to duodenum.

Preferably, the inflammatory disease or condition is an inflammatory bowel disease. In a more particular embodiment, the inflammatory bowel disease is ulcerative colitis. In another more particular embodiment, the inflammatory bowel disease is Crohn's disease. In yet another more particular embodiment, the inflammatory bowel disease is ileal Crohn's disease.

In some embodiments, the pre-selected location is the section or subsection of the GI tract containing the one or more inflammatory disease sites.

In other embodiments, the pre-selected location is proximal to the section or subsection of the GI tract containing the one or more inflammatory disease sites. In some further embodiments, the pre-selected location immediately precedes the section or subsection of the subject's GI tract containing the one or more inflammatory disease sites. In yet some further embodiments, the pre-selected location does not contain or has not been determined to contain a disease site.

Device Localization Comprising Detecting Transition from Stomach to Duodenum

In some embodiments, provided herein is a method of treating an inflammatory disease or condition in a tissue or organ originating from the endoderm of a subject, comprising:
  orally administering to the subject a self-localizing ingestible device comprising (i) an immune modulator or (ii) a pharmaceutical formulation that comprises an immune modulator, localizing the device to a pre-selected location of the GI tract of the subject, wherein said pre-selected location is the duodenum; and releasing the immune modulator or the pharmaceutical formulation that comprises the immune modulator from the ingestible device to the duodenum;

wherein the device is self-localized to the pre-selected location based on detecting a transition from the stomach to the duodenum.

Device Localization Comprising Detecting Transition from Duodenum to Jejunum

In some embodiments, provided herein is a method of treating an inflammatory disease or condition in a tissue or organ originating from the endoderm of a subject, comprising:

orally administering to the subject a self-localizing ingestible device comprising (i) an immune modulator or (ii) a pharmaceutical formulation that comprises an immune modulator, localizing the device to a pre-selected location of the GI tract of the subject, wherein said pre-selected location is the jejunum; and releasing the immune modulator or the pharmaceutical formulation that comprises the immune modulator from the ingestible device to the jejunum;

wherein the device is self-localized to the pre-selected location based on detecting a transition from the duodenum to the jejunum.

Device Localization Comprising Detecting Transition from Jejunum to Ileum

In some embodiments, provided herein is a method of treating an inflammatory disease or condition in a tissue or organ originating from the endoderm of a subject, comprising:

orally administering to the subject a self-localizing ingestible device comprising (i) an immune modulator or (ii) a pharmaceutical formulation that comprises an immune modulator, localizing the device to a pre-selected location of the GI tract of the subject, wherein said pre-selected location is the ileum; and releasing the immune modulator or the pharmaceutical formulation that comprises the immune modulator from the ingestible device to the ileum;

wherein the device is self-localized to the pre-selected location based on detecting a transition from the jejunum to the ileum.

Device Localization Comprising Detecting Transition from Ileum to Cecum

In some embodiments, provided herein is a method of treating an inflammatory disease or condition in a tissue or organ originating from the endoderm of a subject, comprising:

orally administering to the subject a self-localizing ingestible device comprising (i) an immune modulator or (ii) a pharmaceutical formulation that comprises an immune modulator, localizing the device to a pre-selected location of the GI tract of the subject, wherein said pre-selected location is the cecum; and releasing the immune modulator or the pharmaceutical formulation that comprises the immune modulator from the ingestible device to the cecum;

wherein the device is self-localized to the pre-selected location based on detecting a transition from the ileum to the cecum.

Preferably, the inflammatory disease or condition is an inflammatory bowel disease. In some more particular embodiments, the inflammatory bowel disease is ulcerative colitis.

Device Localization Comprising Detecting Transition from Cecum to Ascending Colon In some embodiments, provided herein is a method of treating an inflammatory disease or condition in a tissue or organ originating from the endoderm of a subject, comprising:

orally administering to the subject a self-localizing ingestible device comprising (i) an immune modulator or (ii) a pharmaceutical formulation that comprises an immune modulator, localizing the device to a pre-selected location of the GI tract of the subject, wherein said pre-selected location is the colon; and releasing the immune modulator or the pharmaceutical formulation that comprises the immune modulator from the ingestible device to the colon;

wherein the device is self-localized to the pre-selected location based on detecting a transition from the cecum to the colon.

5. Further Embodiments Directed to a Method of Treating a Disease or Condition in a Tissue or Organ Originating from the Endoderm of the Subject, the Method Comprising Topical Administration of Drug to the GI Tract of the Subject In some further embodiments, the method of treating a disease or condition in a tissue or organ originating from the endoderm of a subject further comprises one or more of the following features.

Further Non-Limiting Embodiments Related to the Ingestible Device as Disclosed Herein for the Topical Administration of a Drug to the GI Tract of a Subject.

In some embodiments, the device used in the method of treatment is further configured with at least one environmental sensor. In some embodiments, the environmental sensor is a pH sensor, a temperature sensor, a pressure sensor, or a combination thereof, wherein said pH, temperature and/or pressure sensor monitors the pH, temperature or pressure in the GI tract of the subject, respectively.

In some embodiments, the device used in the method of treatment does not include an environmental pH sensor. In some embodiments, the device used in the method of treatment does not include a temperature sensor. In some embodiments, the device used in the method of treatment does not include a pressure sensor. In some embodiments, the device self-localization mechanism does not require monitoring the pH of the subject's GI tract. In some embodiments, the device self-localization mechanism does not require monitoring the temperature of the subject's GI tract. In some embodiments, the device self-localization mechanism does not require monitoring the pressure of the subject's GI tract.

In some embodiments, the device is self-localized to a pre-selected location in the GI tract of the subject based on data including optical data, elapsed time, or a combination thereof. In some embodiments, the device is self-localized to a pre-selected location in the GI tract of the subject based on data optical data, elapsed time, or a combination thereof. In some further embodiments, the optical data are based on reflected light detected by the device, wherein the reflected light is light reflected within the GI tract of the subject and external to the device.

Further Non-Limiting Embodiments Related to the Release of the Immune Modulator, or the Pharmaceutical Formulation that Comprises the Immune Modulator, from the Device.

In some more particular embodiments, the immune modulator or the pharmaceutical formulation that comprises the immune modulator is released from the device within a period of time of equal to or less than about 5 minutes after the device detects or confirms transition to a portion of the GI tract that has been preselected for release of the immune modulator. In some more particular embodiments, the release of the immune modulator or the pharmaceutical formulation that comprises the immune modulator is triggered within a period of time after the device is self-localized to the pre-selected location. In some embodiments, the period of time is equal to or less than about 60 seconds, such as equal to or less than about 30 seconds, equal to or less than about 20 seconds, equal to or less than about 10 seconds, equal to or less than about 5 seconds, or equal to or less than about 1 second. In some more particular embodiments, the release of the immune modulator or the pharmaceutical formulation that comprises the immune modulator is triggered at substantially the same time as the device is self-localized to the pre-selected location. In some more particular embodiments, the immune modulator or the pharmaceutical formulation that comprises the immune modulator, is released as a bolus. In some more particular embodiments, the release of the immune modulator or the pharmaceutical formulation that comprises the immune modulator is triggered within a period of time after the device detects or confirms transition to a portion of the GI tract containing one or more disease sites. In some embodiments, the period of time is equal to or less than about 60 seconds, such as equal to or less than about 30 seconds, equal to or less than about 20 seconds, equal to or less than about 10 seconds, equal to or less than about 5 seconds, or equal to or less than about 1 second. In some more particular embodiments, the release of the immune modulator or the pharmaceutical formulation that comprises the immune modulator is triggered at substantially the same time as the device is self-localized to the pre-selected location. In a more particular embodiment, the immune modulator or the pharmaceutical formulation that comprises the immune modulator is released as a bolus.

In some more particular embodiments, the release of the immune modulator or the pharmaceutical formulation that comprises the immune modulator is triggered within a period of time after the device is self-localized to the pre-selected location. In some embodiments, the period of time is equal to or less than about 60 seconds, such as equal to or less than about 30 seconds, equal to or less than about 20 seconds, equal to or less than about 10 seconds, equal to or less than about 5 seconds, or equal to or less than about 1 second. In some more particular embodiments, the release of the immune modulator or the pharmaceutical formulation that comprises the immune modulator is triggered at substantially the same time as the device is self-localized to the pre-selected location. In a more particular embodiment, the immune modulator or the pharmaceutical formulation that comprises the immune modulator is released from the device over a pre-determined period of time, wherein the pre-determined period of time commences within at most about 5 minutes after the device is self-localized at the pre-selected location. In some particular embodiments, the pre-determined period of time over which the formulation is released from the device is about 8 hours, about 7 hours, about 6 hours, about 5 hours, about 4 hours, about 3 hours, about 2 hours, about 1 hour, about 30 minutes, about 15 minutes, about 10 minutes, or about 5 minutes. In more particular embodiments, the pre-determined period of time commences within at most about 1 minute, at most about 30 seconds, or at most about 1 second after the device detects or confirms a transition to the pre-selected location. In some more particular embodiments, the release of the immune modulator or the pharmaceutical formulation that comprises the immune modulator is triggered within a period of time after the device detects or confirms transition to a portion of the GI tract pre-determined to contain one or more disease sites. In some embodiments, the period of time is equal to or less than about 60 seconds, such as equal to or less than about 30 seconds, equal to or less than about 20 seconds, equal to or less than about 10 seconds, equal to or less than about 5 seconds, or equal to or less than about 1 second. In some more particular embodiments, the release of the immune modulator or the pharmaceutical formulation that comprises the immune modulator is triggered at substantially the same time as the device is self-localized at a pre-selected location. In a more particular embodiment, the immune modulator or the pharmaceutical formulation that comprises the immune modulator is released from the device over a pre-determined period of time, wherein the pre-determined period of time commences within at most about 5 minutes after the device detects or confirms a transition to a pre-selected location. In some particular embodiments, the pre-determined period of time over which the formulation is released from the device is about 8 hours, about 7 hours, about 6 hours, about 5 hours, about 4 hours, about 3 hours, about 2 hours, about 1 hour, about 30 minutes, about 15 minutes, about 10 minutes, or about 5 minutes. In more particular embodiments, the pre-determined period of time commences within at most about 1 minute, at most about 30 seconds, or at most about 1 second after the device detects or confirms a transition to the pre-selected location.

In some embodiments, at least about 50% or more by weight of the integrin inhibitor, or the pharmaceutical formulation that comprises the immune modulator, is released from the ingestible device at the pre-selected location. In some embodiments, at least about 80% or more by weight of the immune modulator, or the pharmaceutical formulation that comprises the immune modulator, is released from the ingestible device at the pre-selected location.

Further Non-Limiting Embodiments Related to Dosing.

In some embodiments, the method of treating the disease or condition in a tissue or organ originating from the endoderm of the subject comprises administering a therapeutically effective amount of the immune modulator. In some embodiments, the therapeutically effective amount is an induction dose of the immune modulator. In some embodiments, the therapeutically effective amount is a maintenance dose of the immune modulator. In some embodiments, the method comprises administering an induction dose and subsequently administering a maintenance dose of the immune modulator. In some more particular embodiments, the total induction dose for a given period of time is at least about 1.5 times, at least about 2 times, at least about 3 times, at least about 4 times, at least about 5 times, at least about 6 times, at least about 8 times or at least about 10 times greater than a systemic induction dose for the same period of time. In some more particular embodiments, the total induction dose for a 2 week period is at least about 1.5 times, at least about 2 times, at least about 3 times, at least about 4 times, at least about 5 times, at least about 6 times, at least about 8 times or at least about 10 times greater than a systemic induction dose for the same period of time. In some more particular embodiments, the total induction dose for a 4 week period is at least about 1.5 times, at least about 2 times, at least about 3 times, at least about 4 times, at least about 5 times, at least about 6 times, at least about 8 times or at least about 10 times greater than a systemic induction dose for the same period of time. In some more particular embodiments, the total induction dose for a 6 week period is at least about 1.5 times, at least about 2 times, at least about 3 times, at least about 4 times, at least about 5 times, at least about 6 times, at least about 8 times or at least about 10 times greater than a systemic induction dose for the same period of time. In some more particular embodiments, the total induction dose for a 8 week period is at least about 1.5 times, at least about 2 times, at least about 3 times, at least about 4 times, at least about 5 times, at least about 6 times, at least about 8 times or at least about 10 times greater than a systemic induction dose for the same period of time.

In some more particular embodiments, an ingestible device comprising the immune modulator or the pharmaceutical formulation that comprises the immune modulator is administered once per day or more than once per day, for example, 1, 2, 3, 4 or more times per day. In some more particular embodiments, two or more ingestible devices are administered at the same time. In some more particular embodiments, two or more ingestible devices are administered about 1 minute apart, about 2 minutes apart, about 3 minutes apart, about 4 minutes apart, about 5 minutes apart, about 10 minutes apart, about 15 minutes apart, about 30 minutes apart, or about 60 minutes apart. In some more particular embodiments, two or more ingestible devices are administered about 1 hour apart, about 2 hours apart, about 3 hours apart, about 4 hours apart, about 5 hours apart, about 6 hours apart, about 7 hours apart, about 8 hours apart, about 9 hours apart, about 10 hours apart, about 11 hours apart, or about 12 hours apart.

Further Non-Limiting Embodiments Related to a Device Comprising a Reservoir.

In some embodiments, the device comprises a reservoir, and the reservoir contains the immune modulator, or a formulation comprising the immune modulator. In some more particular embodiments, the formulation is suitable for introduction and optionally for storage in a reservoir comprised in the device. In some more particular embodiments the reservoir is configured to fit into the device. In some more particular embodiments, the reservoir comprises one or more anchor systems for anchoring the reservoir at a particular location in the GI tract, such as a section or subsection of the GI tract containing one or more disease sites, or proximal to a section or subsection of the GI tract proximate to an intended site of release.

Thus, in some further embodiments, the method of treating a disease or condition in a tissue or organ originating from the endoderm further comprises releasing the immune modulator or the pharmaceutical formulation that comprises the immune modulator from a reservoir comprised in the device.

In some embodiments, the immune modulator or the pharmaceutical formulation that comprises the immune modulator is released from a reservoir configured to fit into the device.

In some embodiments, the immune modulator or the pharmaceutical formulation that comprises the immune modulator is released from a reservoir comprising one or more anchor systems for anchoring the reservoir at the pre-selected location of the GI tract.

Further Non-Limiting Embodiments Related to Determining a Site of Disease.

In some further embodiments, the method further comprises identifying the section or subsection of the GI tract containing at least one of the one or more disease sites. In some embodiments, the one or more disease sites is identified prior to the administration (i.e., the one or more disease sites is pre-determined). In some embodiments, the identification of the one or more disease sites prior to the administration comprises imaging the GI tract, endoscopy, biopsy, computer-aided (CT) enterography, magnetic resonance enterography, sampling the GI tract for one or more disease markers or biomarkers, or a combination of any two or more of the foregoing.

In some embodiments, determining a site of disease is preceded by identifying symptoms or signs indicative of Crohn's disease in a subject, for example, according to American Gastroenterology Association (AGA) clinical guidelines. In some particular embodiments, such one or more symptoms or signs are selected from fever, abdominal pain, GI bleeding, localized tenderness, weight loss, joint pain, and cutaneous signs.

In more particular embodiments, the subject is further evaluated by determining the level of one or more inflammatory markers, for example, according to AGA guidelines. In some particular embodiments, such one or more markers are selected from CBC, CRP, CMP, fecal calprotectin, and ESR.

In some particular embodiments, the subject, having undergone evaluation for symptoms and signs of disease and evaluation for one or more disease markers, is identified as a candidate for further evaluation, e.g., such that imaging is indicated. In some such embodiments, the subject further undergoes CT-enterography or magnetic resonance enterography to determine the location(s) of one or more disease sites.

In more particular embodiments, determining a site of disease is preceded by identifying one or more AGA clinical guideline symptoms or signs indicative of Crohn's disease, and the subject is further evaluated by determining the level of one or more AGA clinical guideline inflammatory markers. Thus, in some particular embodiments, pre-determining a site of disease is preceded by identifying one or more symptoms or signs selected from fever, abdominal pain, GI bleeding, localized tenderness, weight loss, joint pain, and cutaneous signs, and the subject is further evaluated by determining the level of one or more inflammatory markers selected from CBC, CRP, CMP, fecal calprotectin, and ESR.

In more particular embodiments, determining a site of disease is preceded by identifying one or more AGA clinical guideline symptoms or signs indicative of Crohn's disease, the subject is identified as a candidate for further evaluation, and the subject undergoes CT-enterography or magnetic resonance enterography to determine the location(s) of one or more disease sites. Thus, in some particular embodiments, pre-determining a site of disease is preceded by identifying one or more symptoms or signs selected from fever, abdominal pain, GI bleeding, localized tenderness, weight loss, joint pain, and cutaneous signs; the subject is identified as a candidate for further evaluation; and the subject undergoes CT-enterography or magnetic resonance enterography to determine the location(s) of one or more disease sites.

In more particular embodiments, determining a site of disease is preceded by identifying symptoms or signs indicative of ulcerative colitis in a subject, for example, according to American Gastroenterology Association (AGA) clinical guidelines. In some particular embodiments, such one or more symptoms or signs are selected from bloody diarrhea, tenesmus, urgency, fever, abdominal pain, localized abdominal tenderness, weight loss, joint swelling and/or redness, signs of anemia, and cutaneous signs.

In more particular embodiments, the subject is further evaluated by determining the level of one or more inflammatory markers, for example, according to AGA guidelines. In some particular embodiments, such one or more markers are selected from CBC, CRP, CMP, difficile, ESR, and stool culture.

In some particular embodiments, the subject, having undergone evaluation for symptoms and signs of disease and evaluation for one or more disease markers, is identified as a candidate for further evaluation, e.g., such that imaging is indicated. In some such embodiments, the subject further undergoes colonoscopy and/or sigmoidoscopy to determine the location(s) of one or more disease sites.

In more particular embodiments, determining a site of disease is preceded by identifying one or more AGA clinical guideline symptoms or signs indicative of ulcerative colitis, and the subject is further evaluated by determining the level of one or more AGA clinical guideline inflammatory markers. Thus, in some particular embodiments, pre-determining a site of disease is preceded by identifying one or more symptoms or signs selected from bloody diarrhea, tenesmus, urgency, fever, abdominal pain, localized abdominal tenderness, weight loss, joint swelling and/or redness, signs of anemia, and cutaneous signs, and the subject is further evaluated by determining the level of one or more inflammatory markers selected from CBC, CRP, CMP, difficile, ESR, and stool culture.

In more particular embodiments, determining a site of disease is preceded by identifying one or more AGA clinical guideline symptoms or signs indicative of ulcerative colitis, the subject is identified as a candidate for further evaluation, and the subject undergoes colonoscopy and/or sigmoidoscopy to determine the location(s) of one or more disease sites. Thus, in some particular embodiments, pre-determining a site of disease is preceded by identifying one or more symptoms or signs selected from bloody diarrhea, tenesmus, urgency, fever, abdominal pain, localized abdominal tenderness, weight loss, joint swelling and/or redness, signs of anemia, and cutaneous signs; the subject is identified as a candidate for further evaluation; and the subject undergoes colonoscopy and/or sigmoidoscopy to determine the location(s) of one or more disease sites.

In some embodiments, determining a site of disease comprises imaging the GI tract of the subject. In some more particular embodiments, the imaging comprises still imaging, video imaging, or a combination thereof. In some embodiments, pre-determining a site of disease comprises endoscopy. In some more particular embodiments, pre-determining a site of disease comprises endoscopy with imaging. In one particular aspect, pre-determining the site of disease comprises endoscopy with video imaging, still imaging, or both. In some other more particular embodiments, pre-determining a site of disease comprises endoscopy with biopsy. In more particular embodiments, pre-determining a site of disease comprises endoscopy with imaging and biopsy.

In some more particular aspects of the foregoing embodiments for the determination of the site of disease, the ingestible device is configured with at least one sensor. In some more particular embodiments, the at least one sensor is a light sensor. In some more particular embodiments, the sensor is an imaging sensor. In some more particular embodiments, the sensor is an imaging sensor capable of detecting inflamed tissue or lesions in the GI tract. In some more particular embodiments, the sensor is capable of detecting muscle contractions and/or peristalsis. In some more particular embodiments, the sensor is capable of detecting reflectance.

Thus, in some further embodiments, the method of treating one or more inflammatory disease sites comprises using an ingestible device configured with an imaging sensor. In some embodiments, the imaging sensor is capable of detecting inflamed tissue or lesions in the GI tract. In some embodiments, the ingestible device configured with the imaging sensor comprises the immune modulator, or the pharmaceutical formulation comprising the immune modulator. In other embodiments, the ingestible device configured with the imaging sensor is a second ingestible device that does not comprise the immune modulator, or the pharmaceutical formulation comprising the immune modulator.

Thus, in some further embodiments, the method of treating one or more inflammatory disease sites comprises determining or pre-determining one or more inflammatory disease sites;
  wherein the ingestible device is configured with an imaging sensor capable of detecting inflamed tissue or lesions in the GI tract, and the determining or pre-determining of the one or more inflammatory disease sites comprises imaging the GI tract via the ingestible device imaging sensor.

In some other embodiments, the method further comprises determining or pre-determining one or more inflammatory disease sites based on the level of an analyte or biomarker in a sample obtained from the GI tract. In some embodiments, the sample is obtained from the GI tract prior to the administration of the ingestible device. In some more particular embodiments, the sample is obtained from the same portion of the GI tract in which the immune modulator is subsequently released. In some embodiments, the sample is obtained from the GI tract after the administration of the ingestible device. In some more particular embodiments, the sample is obtained from the same portion of the GI tract in which the immune modulator was released. In some embodiments, a first sample is obtained from the GI tract prior to the administration of the ingestible device, and a second sample is obtained from the GI tract after the administration of the ingestible device. In some more particular embodiments, the first sample and the second sample are obtained from the same portion of the GI tract in which the immune modulator is released. The concentration of the analyte or biomarker in the sample is determined as disclosed herein.

In some even more particular embodiments, the immune modulator or the pharmaceutical formulation that comprises the immune modulator is released from the ingestible device to the same portion of the GI tract from which the sample is obtained. In some even more particular embodiments, the immune modulator or the pharmaceutical formulation that comprises the immune modulator is released from the ingestible device to a portion of the GI tract proximal to that from which the sample is obtained.

In some even more particular embodiments, the analyte or biomarker is an analyte or biomarker that indicates that an immune modulator is a suitable therapeutic for the treatment of the one or more disease sites. Examples of such analytes or biomarkers include, but are not limited to, pro-inflammatory cytokines that rely on the integrin family for signal transduction.

In some even more particular embodiments, the analyte or biomarker is calprotectin, integrin, MadCAM, other cytokines, and/or lactoferrin. Another example of an analyte is blood.

In some even more particular embodiments, the analyte or biomarker is an analyte or biomarker that indicates that an immune modulator may provide a suitable therapeutic for the treatment of the one or more disease sites. Examples of such analytes or biomarkers include pro-inflammatory cytokines that rely on the integrin family for signal transduction.

In some even more particular embodiments, the analyte or biomarker is IL-6, IL-13, IL-15, IL-23 and/or IFNγ. In some even more particular embodiments, the analyte or biomarker is IL-13, IL15, IL-22, IL-24 and/or IL-27. In some even more particular embodiments, the analyte or biomarker is IL-6, IL-13, IL-15, IL-23 and/or IFNγ, and the disease is ulcerative colitis. In some even more particular embodiments, the analyte or biomarker is IL-13, IL15, IL-22, IL-24 and/or IL-27, and the disease is Crohn's disease.

Immune Modulator Delivery Apparatuses

Also provided herein are immune modulator delivery apparatuses that include: an ingestible housing including a reservoir having a pharmaceutical composition including a therapeutically effective amount of the immune modulator stored therein; a detector coupled to the ingestible housing, the detector configured to detect when the ingestible housing is proximate to a respective intended site of release; a valve system in fluid communication with the reservoir system; and a controller communicably coupled to the valve system and the detector, the controller configured to cause the valve system to open in response to the detector detecting that the ingestible housing is proximate to the respective intended site of release so as to release the therapeutically effective amount of the immune modulator at the respective intended site of release. Some embodiments of any of the apparatuses described herein further include a pump positioned in the ingestible housing, the pump configured to pump the therapeutically effective amount of the immune modulator from the reservoir in response to activation of the pump by the controller responsive to detection by the detector of the ingestible housing being proximate to the intended site of release. In some embodiments of any of the apparatuses described herein, the controller is configured to cause the pump to pump the therapeutically effective amount of the immune modulator from the reservoir according to the following protocol. In some embodiments of any of the apparatuses described herein, the valve system includes a dissolvable coating. In some embodiments of any of the apparatuses described herein, the valve system includes one or more doors configured for actuation by at least one of sliding, pivoting, and rotating. In some embodiments of any of the apparatuses described herein, the valve system includes an electrostatic shield. In some embodiments of any of the apparatuses described herein, the reservoir includes a pressurized cell.

Some embodiments of any of the apparatuses described herein further include at least one actuatable anchor configured to retain the ingestible housing at the respective intended site of release upon actuation. In some embodiments of any of the apparatuses described herein, the actuatable anchor is retractable.

Also provided herein are compositions that include a therapeutically effective amount of any of the immune modulators described herein, where the composition is capable of releasing the immune modulator at a location in the gastrointestinal tract of the subject. In some embodiments of any of the compositions described herein, the composition includes a tissue anchoring mechanism for anchoring the composition to the location. In some embodiments of any of the compositions described herein, the tissue anchoring mechanism is capable of anchoring for anchoring to the location. In some embodiments of any of the compositions described herein, the tissue anchoring mechanism includes an osmotically-driven sucker. In some embodiments of any of the compositions described herein, the tissue anchoring mechanism comprises a connector operable to anchor the composition to the location. In some embodiments of any of the compositions described herein, the connector is operable to anchor the composition to the location using an adhesive, negative pressure and/or fastener.

Also provided herein is an immune modulator for use in a method of treating an inflammatory disease or condition that arises in a tissue originating from the endoderm in a subject, where the method includes orally administering to the subject an ingestible device loaded with the immune modulator, wherein the immune modulator is released by the device at a location in the gastrointestinal tract of the subject that is proximate to an intended site of release of the immune modulator. In some embodiments of an immune modulator for use described herein, the immune modulator is contained in a reservoir suitable for attachment to a device housing, and wherein the method includes attaching the reservoir to the device housing to form the ingestible device, prior to orally administering the ingestible device to the subject.

Also provided herein is an attachable reservoir containing an immune modulator for use in a method of treating an inflammatory disease or condition that arises in a tissue originating from the endoderm, where the method includes attaching the reservoir to a device housing to form an ingestible device and orally administering the ingestible device to a subject, where the immune modulator is released by device at a location in the gastrointestinal tract of the subject that is proximate to the intended site of release.

Also provided herein is a composition including or consisting of an ingestible device loaded with a therapeutically effective amount of an immune modulator, for use in a method of treatment, wherein the method includes orally administering the composition to the subject, wherein the immune modulator is released by the device at a location in the gastrointestinal tract of the subject that is proximate to an intended site of release.

In some embodiments of any of the immune modulators for use described herein, any of the attachable reservoirs described herein, or the compositions for use described herein, the intended site of release has been pre-determined. In some embodiments of any of the immune modulators for use described herein, any of the attachable reservoirs described herein, or any of the compositions for use described herein, the ingestible device further includes an environmental sensor and the method further includes using the environmental sensor to identify the location of the intended site of release. In some embodiments of any of the immune modulators for use, any of the attachable reservoirs described herein, or any of the compositions for use described herein, the environmental sensor is an imaging sensor and the method further includes imaging the gastrointestinal tract to identify the intended site of release. In some embodiments of any of the immune modulators for use described herein, any of the attachable reservoirs described herein, or any of the compositions for use described herein, the imaging detects an intended site of release. In some embodiments of any of the immune modulators for use, any of the attachable reservoirs described herein, or any of the compositions for use described herein, the inflammatory disease or condition that arises in a tissue originating from the endoderm is selected from the group of: gastritis, Celiac disease, hepatitis, alcoholic liver disease, fatty liver disease (hepatic steatosis (NASH)), non-alcoholic fatty liver disease (NAFLD), cirrhosis, primary schlerosing cholangitis, pancreatitis, insterstitial cystitits, asthma, chronic obstructic pulmonary disease, pulmonary fibrosis, pharyngitis, thyroiditis, hyperthyroidism, parathyroiditis, nephritis, Hashimoto's disease, Addison's disease, Graves' disease, Sjögren syndrome, type 1 diabetes, obesity, pelvic inflammatory disease, auditory canal inflammation, tinnitus, vestibular neuritis, otitis media, auditory canal inflammation, tracheitis, cholestatic liver disease, primary biliary sclerosis, liver parenchyma, an inherited metabolic disorder of the liver, Byler syndrome, cerebrotendinous, xanthomatosis, Zellweger's syndrome, neonatal hepatitis, cystic fibrosis, ALGS (Alagilles syndrome), PFIC (progressive familial intrahepatic cholestasis), autoimmune hepatitis, primary biliary cirrhosis (PBC), liver fibrosis, NAFLD, portal hypertension, general cholestasis, such as in jaundice due to drugs or during pregnancy, intra- and extrahepatic cholestasis, such as hereditary forms of cholestasis, such as PFIC1, gall stones and choledocholithiasis, malignancy causing obstruction of the biliary tree, symptoms (scratching, pruritus) due to cholestasis/jaundice, chronic autoimmune liver disease leading to progressive cholestasis, and pruritus of cholestatic liver disease, duodenal ulcers, enteritis (radiation-, chemotherapy-, or infection-induced enteritis), diverticulitis, pouchitis, cholecystitis, and cholangitis.

In some embodiments of any of the immune modulators for use, any of the attachable reservoirs described herein, or any of the compositions for use described herein, the inflammatory disease or condition that arises in a tissue originating from the endoderm is a liver disease or disorder selected from the group of: fibrosis, cirrhosis, alcoholic lever disease, fatty liver disease (hepatic steatosis (NASH)), non-alcoholic fatty liver disease (NAFLD), cholestatic liver disease, liver parenchyma, an inherited metabolic disorder of the liver, PFIC (progressive familial intrahepatic cholestasis), autoimmune hepatitis, primary biliary cirrhosis (PBC), NAFLD, chronic autoimmune liver disease leading to progressive cholestasis, pruritus of cholestatic liver disease, inflammation of the liver, and liver fibrosis.

Also provided herein are ingestible devices loaded with a therapeutically effective amount of an immune modulator, where the device is controllable to release the immune modulator at a location in the gastrointestinal tract of the subject that is proximate to an intended site of release. Also provided herein are any of the devices described herein for use in a method of treatment of the human or animal body.

In some embodiments of any of the immune modulators for use described herein, any of the attachable reservoirs described herein, or any of the devices described herein, wherein the ingestible device includes: a housing defined by a first end, a second end substantially opposite from the first end, and a wall extending longitudinally from the first end to the second end; a reservoir located within the housing and containing the immune modulator, where a first end of the reservoir is connected to the first end of the housing; a mechanism for releasing the immune modulator from the reservoir; and an exit value configured to allow the immune modulator to be released out of the housing from the reservoir.

In some embodiments of any of the immune modulators for use described herein, any of the attachable reservoirs described herein, or any of the devices described herein, the ingestible device includes: an ingestible housing including a reservoir compartment having a therapeutically effective amount of the immune modulator stored therein; a release mechanism having a closed state which retains the immune modulator in the reservoir and an open state which releases the immune modulator the reservoir to the exterior of the device; and an actuator which changes the state of the release mechanism from the closed to the open state.

In some embodiments of any of the immune modulators for use described herein, any of the attachable reservoirs described herein, or any of the devices described herein, the ingestible device further comprises an environmental sensor for detecting the location of the device in the gut. In some embodiments of any of the immune modulators for use described herein, any of the compositions for use described herein, or any of the devices described herein, where the ingestible device further includes a communication system for transmitting data from the environmental sensor to an external receiver. In some embodiments of any of the immune modulators for use described herein, any of the attachable reservoirs described herein, any of the compositions for use described herein, or any of the devices described herein, the ingestible device further includes a processor or controller which is coupled to the environmental sensor and to the actuator and which triggers the actuator to cause the release mechanism to transition from its closed state to its open state when it is determined that the device is in the presence of the intended site of release and/or is in a location in the gut that has been predetermined to be proximal to the intended site of release.

In some embodiments of any of the immune modulators for use described herein, any of the attachable reservoirs described herein, any of the compositions for use described herein, or any of the devices described herein, the communication system further includes means for receiving a signal from an external transmitter, and where the actuator is adapted to be triggered in response to the signal.

In some embodiments of any of the immune modulators for use described herein, any of the attachable reservoirs described herein, any of the compositions for use described herein, or any of the devices described herein, the ingestible device further includes a communication system for transmitting localization data to an external receiver.

In some embodiments of any of the immune modulators for use described herein, any of the attachable reservoirs described herein, any of the compositions for use described herein, or any of the devices described herein, the ingestible device further includes a communication system for transmitting localization data to an external receiver and for receiving a signal from an external transmitter; where the actuator is adapted to be triggered in response to the signal.

In some embodiments of any of the immune modulators for use described herein, any of the attachable reservoir compartments for use described herein, any of the compositions for use described herein, or any of the devices described herein, the ingestible device further includes a deployable anchoring system and an actuator for deploying the anchoring system, where the anchoring system is capable of anchoring or attaching the ingestible device to the subject's tissue.

Also provided herein are methods of treating an inflammatory disease or condition that arises in a tissue originating from the endoderm of a subject, that include: releasing an immune modulator at a location in the large intestine of the subject, where the method includes administering endoscopically to the subject a therapeutically effective amount of the immune modulator, where the method does not include releasing more than 20% of the immune modulator at a location that is not an intended site of release.

Also provided herein are methods of treating a disease or condition that arises in a tissue originating from the endoderm in a subject, that include: releasing an immune modulator at a location in the proximal portion of the large intestine of the subject, where the method includes administering endoscopically to the subject a pharmaceutical composition including a therapeutically effective amount of the immune modulator, where the pharmaceutical composition is an ingestible device.

In some embodiments of any of the methods described herein, the method does not include releasing more than 20% of the immune modulator at a location that is not proximate to an intended site of release. In some embodiments of any of the methods described herein, the method does not include releasing more than 10% of the immune modulator at a location that is not proximate to an intended site of release. In some embodiments of any of the methods described herein, the method provides a concentration of the immune modulator at a location that is an intended site of release that is 2-100 times greater than at a location that is not the intended site of release. In some embodiments of any of the methods described herein, the method provides a concentration of the immune modulator in the plasma of the subject that is less than 3 μg/mL. In some embodiments of any of the methods described herein, the method provides a concentration of the immune modulator in the plasma of the subject that is less than 0.3 μg/mL. In some embodiments of any of the methods described herein, the method provides a concentration of the immune modulator in the plasma of the subject that is less than 0.01 μg/mL. In some embodiments of any of the methods described herein, the method provides a $C_{24}$ value of the immune modulator in the plasma of the subject that is less than 3 μg/mL. In some embodiments of any of the methods described herein, the method provides a $C_{24}$ value of the immune modulator in the plasma of the subject that is less than 0.3 μg/mL. In some embodiments of any of the methods described herein, the method provides a $C_{24}$ value of the immune modulator in the plasma of the subject that is less than 0.01 μg/mL.

In some embodiments of any of the methods described herein, the composition does not include an enteric coating. In some embodiments of any of the methods described herein, the immune modulator is not a cyclic peptide. In some embodiments of any of the methods described herein, the immune modulator is present in a pharmaceutical formulation within the device. In some embodiments of any of the methods described herein, the formulation is a solution of the immune modulator in a liquid medium. In some embodiments of any of the methods described herein, the formulation is a suspension of the immune modulator in a liquid medium.

In some embodiments of any of the methods described herein, the tissue originating from the endoderm is selected from the group of: the stomach, the colon, the liver, the pancreas, the urinary bladder, the epithelial parts of the trachea, the lungs, the pharynx, the thyroid, the parathyroid, the intestines, and the gallbladder. In some embodiments of any of the methods described herein, the inflammatory disease or condition that arises in a tissue originating from the endoderm is selected from the group of: gastritis, Celiac disease, hepatitis, alcoholic lever disease, fatty liver disease (hepatic steatosis), non-alcoholic fatty liver disease (NASH), cirrhosis, primary schlerosing cholangitis, pancreatitis, insterstitial cystitits, asthma, chronic obstructive pulmonary disease, pulmonary fibrosis, pharyngitis, thyroiditis, hyperthyroidism, parathyroiditis, nephritis, Hashimoto's disease, Addison's disease, Graves' disease, Sjögren syndrome, type 1 diabetes, pelvic inflammatory disease, auditory canal inflammation, tinnitus, vestibular neuritis, otitis media, auditory canal inflammation, tracheitis, cholestatic liver disease, primary biliary sclerosis, liver parenchyma, an inherited metabolic disorder of the liver, Byler syndrome, cerebrotendinous, xanthomatosis, Zellweger's syndrome, neonatal hepatitis, cystic fibrosis, ALGS (Alagilles syndrome), PFIC (progressive familial intrahepatic cholestasis), autoimmune hepatitis, primary biliary cirrhosis (PBC), liver fibrosis, NAFLD, portal hypertension, general cholestasis, such as in jaundice due to drugs or during pregnancy, intra- and extrahepatic cholestasis, such as hereditary forms of cholestasis, such as PFIC1, gall stones and choledocholithiasis, malignancy causing obstruction of the biliary tree, symptoms (scratching, pruritus) due to cholestasis/jaundice, chronic autoimmune liver disease leading to progressive cholestasis, and pruritus of cholestatic liver disease, duodenal ulcers, enteritis (radiation-, chemotherapy-, or infection-induced enteritis), diverticulitis, pouchitis, cholecystitis, and cholangitis. In some embodiments of any of the methods described herein, the inflammatory disease or condition that arises in a tissue originating from the endoderm is inflammation of the liver.

In some embodiments of any of the methods described herein, the immune modulator is released at a location in the proximal portion of the ascending colon. In some embodiments of any of the methods described herein, the immune modulator is released at a location in the proximal portion of the cecum. In some embodiments of any of the methods described herein, the immune modulator is released at a location in the proximal portion of the sigmoid colon. In some embodiments of any of the methods described herein, the immune modulator is released at a location in the proximal portion of the transverse colon. In some embodiments of any of the methods described herein, the immune modulator is released at a location in the proximal portion of the descending colon. In some embodiments of any of the methods described herein, the method includes administering to the subject a reservoir including the therapeutically effective amount of the immune modulator, where the reservoir is connected to the endoscope.

Some embodiments of any of the methods described herein further include administering a second agent orally, intravenously or subcutaneously, where the second agent is the same immune modulator; a different immune modulator; or an agent having a different biological target from the immune modulator, where the second agent is an agent suitable for treating an inflammatory disease or condition that arises in a tissue originating from the endoderm. In some embodiments of any of the methods described herein, the immune modulator is administered prior to the second agent. In some embodiments of any of the methods described herein, the immune modulator is administered after the second agent. In some embodiments of any of the methods described herein, the immune modulator and the second agent are administered substantially at the same time. In some embodiments of any of the methods described herein, the second agent is administered intravenously. In some embodiments of any of the methods described herein, the second agent is administered subcutaneously. In some embodiments of any of the methods described herein, the amount of the second agent is less than the amount of the second agent when the immune modulator and the second agent are both administered systemically. In some embodiments of any of the methods described herein, the second agent is another immune modulator. In some embodiments of any of the methods described herein, the method does not include administering a second agent.

In some embodiments of any of the methods described herein, the method includes identifying an intended site of release prior to endoscopic administration. In some embodiments of any of the methods described herein, the method includes identifying an intended site of release substantially at the same time as releasing the immune modulator. In some embodiments of any of the methods described herein, the method includes monitoring the progress of the disease. In some embodiments of any of the methods described herein, the method does not include administering an immune modulator with a spray catheter. In some embodiments of any of the methods described herein, the method includes administering an immune modulator with a spray catheter.

Also provided herein are methods of treating an inflammatory disease or condition that arises in a tissue arising from the endoderm in a subject, that include: releasing an immune modulator at a location in the gastrointestinal tract of the subject that is proximate to an intended site of release, where the methods include administering to the subject a pharmaceutical composition including a therapeutically effective amount of the immune modulator the method including one or more of the following steps: (a) identifying a subject having a disease or condition that arises in a tissue originating from the endoderm; (b) determination of the severity of the disease; (c) determination of the location of the disease; (d) evaluating the subject for suitability to treatment; (e) administration of an induction dose of the immune modulator; (f) monitoring the progress of the disease; and/or (g) optionally repeating steps (e) and (f) one or more times.

In some embodiments of any of the methods described herein, the pharmaceutical composition is an ingestible device and the method includes administering orally to the subject the pharmaceutical composition. In some embodiments of any of the methods described herein, the method includes administering one or more maintenance doses following administration of the induction dose in step (e). In some embodiments of any of the methods described herein, the induction dose is a dose of the immune modulator administered in an ingestible device. In some embodiments of any of the methods described herein, the maintenance dose is a dose of the immune modulator administered in an ingestible device as disclosed herein. In some embodiments of any of the methods described herein, the maintenance dose is a dose of the immune modulator delivered systemically. In some embodiments of any of the methods described herein, the induction dose is a dose of the immune modulator delivered systemically. In some embodiments of any of the methods described herein, the maintenance dose is a dose of the immune modulator administered in an ingestible device. In some embodiments of any of the methods described herein, the induction dose is a dose of a second agent as delivered systemically. In some embodiments of any of the methods described herein, the maintenance dose is a dose of the immune modulator administered in an ingestible device.

In some embodiments of any of the methods described herein, wherein the immune modulator is selected from the group of: IL-12/IL-23 inhibitors, TNFα inhibitors, IL-6 receptor inhibitors, JAK inhibitors, CD3 inhibitors, CD40/CD40L inhibitors, IL-1 inhibitors, IL-13 inhibitors, IL-10 receptor agonists, integrin inhibitors, S1P modulators and PDE4 inhibitors.

In some embodiments of any of the methods described herein, the subject has previously been identified as having an inflammatory disease or condition that arises in a tissue originating from the endoderm.

Also provided herein are methods of formulating a pharmaceutical composition comprising an immune modulator, wherein the methods comprise the steps of: (a) topically administering a dose of an immune modulator (e.g., any of the immune modulators described herein or known in the art, or any combination thereof) to a small intestine (e.g., duodenum, jejunum, or ileum) and/or colon (e.g., ascending colon, transverse colon, descending colon, rectum, or cecum) of a mammal (e.g., any of the exemplary mammals described herein or known in the art); (b) selecting an immune modulator whose topical administration in step (a) has been determined to result in (i) a decrease in one or both of the level of T cells in a mesenteric lymph node and the level of T cells in a Peyer's patch in the mammal, and/or (ii) an increase in the level of T cells in blood in the mammal, each as compared to the corresponding level in a control mammal systemically administered the same dose of the immune modulator; and (c) formulating a pharmaceutical composition comprising the selected immune modulator.

Also provided herein are methods of formulating a pharmaceutical composition comprising an immune modulator, wherein the methods comprise the steps of: (a) selecting an immune modulator (e.g., any of the immune modulators described herein or known in the art, or any combination thereof) whose topical administration to a small intestine (e.g., duodenum, jejunum, or ileum) and/or colon (e.g., ascending colon, transverse colon, descending colon, rectum, or cecum) of a mammal (e.g., any of the exemplary mammals described herein or known in the art) has been determined to result in (i) a decrease in one or both of the level of T cells in a mesenteric lymph node and the level of T cells in a Peyer's patch in the mammal, and/or (ii) an increase in the level of T cells in blood in the mammal, each as compared to the corresponding level in a control mammal systemically administered the same dose of the immune modulator; and (b) formulating a pharmaceutical composition comprising the selected immune modulator.

Also provided are methods of formulating a pharmaceutical composition comprising an immune modulator, wherein the methods comprise the steps of formulating a pharmaceutical composition comprising an immune modulator (e.g., any of the immune modulators described herein or known in the art, or any combination thereof) determined to result in a mammal (e.g., any of the exemplary mammals described herein or known in the art) topically administered a dose of the immune modulator to the small intestine (e.g., duodenum, jejunum, or ileum) and/or colon (e.g., ascending colon, transverse colon, descending colon, rectum, or cecum) of the mammal: (i) a decrease in one or both of the level of T cells in a mesenteric lymph node and the level of T cells in a Peyer's patch in a mammal, and/or (ii) an increase in the level of T cells in blood in the mammal, each as compared to the corresponding level in a control mammal systemically administered the same dose of the immune modulator.

In some embodiments of any of the methods, the topical administration of the immune modulator has been determined to result in a decrease in one or both of the level of T cells in a mesenteric lymph node and the level of T cells in a Peyer's patch in a mammal, each as compared to the corresponding level in a control mammal systemically administered the same dose of the immune modulator. In some embodiments of these methods, the topical administration of the immune modulator has been determined to result in an increase in the level of T cells in blood in the mammal, as compared to the corresponding level in a control mammal systemically administered the same dose of the immune modulator. In some embodiments of any of these methods, the topical administration of the immune modulator has been determined to result in (i) a decrease in one or both of the level of T cells in a mesenteric lymph node and the level of T cells in a Peyer's patch in a mammal, and (ii) an increase in the level of T cells in blood in the mammal, each as compared to the corresponding level in a control mammal systemically administered the same dose of the immune modulator.

In some embodiments of these methods, the level of T cells in the mesenteric lymph node is the level of Th memory cells in the mesenteric lymph node. In some embodiments of these methods, the level of T cells in the Peyer's patch is the level of Th memory cells in the Peyer's patch. In some embodiments of these methods, the level of T cells in the blood is the level of Th memory cells in the blood. In some embodiments of these methods, the control mammal is a mammal of a similar age and having a similar disease state as compared to the mammal topically administered the dose of the immune modulator.

In some embodiments of these methods, the T cells are effector memory T cells, also called Th memory cells (e.g., $CD44^+CD45RB^-/CD4^+$ cells expressing $\alpha 4\beta 7$ integrin). For example, the effector memory T cells (Th memory cells) can be detecting using flow cytometry or fluorescence-activated cell sorting (FACS). FACS can be performed as follows: forward-scatter, side-scatter, and fluorescent data are collected; user-defined parameters provide information on how the cells should be sorted; based on these parameters, the FACS machine uses an electrode to impose an electrical charge on each cell; and upon exiting the flow chamber, electromagnetics will sort cells by charge into separate vessels.

Also provided herein are methods of formulating a pharmaceutical composition comprising an immune modulator, wherein the methods comprise the steps of: (a) topically administering a dose of an immune modulator (e.g., any of the immune modulators described herein or known in the art, or any combination thereof) to a small intestine (e.g., duodenum, jejunum, or ileum) and/or colon (e.g., ascending colon, transverse colon, descending colon, rectum, or cecum) of a mammal (e.g., any of the exemplary mammals described herein or known in the art); (b) selecting an immune modulator whose topical administration in step (a) has been determined to result in (i) a decrease in the level of one or more of one or more of T cells (e.g., any of the T cells described herein or known in the art), B cells (e.g., any of the B cells described herein or known in the art), natural killer (NK) cells (e.g., any of the NK cells described herein or known in the art), macrophages (e.g., any of the macrophages described herein or known in the art), M cells (e.g., any of the M cells described herein or known in the art), dendritic cells (e.g., any of the dendritic cells described herein or known in the art), and any of the other effector cells described herein or known in the art, in MALT, GALT, Peyer's patches, mesenteric lymph nodes, paraaortic lymph nodes, or any of the other tissues originating from the endoderm described herein or known in the art, in the mammal, and/or (ii) a decrease in the level of one or more of IL-1 (e.g., IL-1α or IL-1β), IL-2, IL-6, IL-8, IL-12, IL-18, interferon-K, TGF-β, tumor necrosis factor (e.g., TNF-alpha), interferon-K, and GM-CSF, in MALT, GALT, Peyer's patches, mesenteric lymph nodes, paraaortic lymph nodes, or any of the other tissues originating from the endoderm described herein or known in the art, in the mammal, each as compared to the corresponding level in a control mammal systemically administered the same dose of the immune modulator; and (c) formulating a pharmaceutical composition comprising the selected immune modulator.

Also provided herein are methods of formulating a pharmaceutical composition comprising an immune modulator, wherein the methods comprise the steps of: (a) selecting an immune modulator (e.g., any of the immune modulators described herein or known in the art, or any combination thereof) whose topical administration to a small intestine (e.g., duodenum, jejunum, or ileum) and/or colon (e.g., ascending colon, transverse colon, descending colon, rectum, or cecum) of a mammal (e.g., any of the exemplary mammals described herein or known in the art) has been determined to result in (i) a decrease in the level of one or more of T cells (e.g., any of the T cells described herein or known in the art), B cells (e.g., any of the B cells described herein or known in the art), natural killer (NK) cells (e.g., any of the NK cells described herein or known in the art), macrophages (e.g., any of the macrophages described herein or known in the art), M cells (e.g., any of the M cells described herein or known in the art), dendritic cells (e.g., any of the dendritic cells described herein or known in the art), and any of the other effector cells described herein or known in the art, in one or more of the MALT, GALT, Peyer's patches, mesenteric lymph nodes, paraaortic lymph nodes, or any of the other tissues originating from the endoderm described herein or known in the art, in the mammal, and/or (ii) a decrease in the level of one or more of IL-1 (e.g., IL-1α or IL-1β), IL-2, IL-6, IL-8, IL-12, IL-18, interferon-K, TGF-β, tumor necrosis factor (e.g., TNF-alpha), interferon-K, and GM-CSF in MALT, GALT, Peyer's patches, mesenteric lymph nodes, paraaortic lymph nodes, or any of the other tissues originating from the endoderm described herein or known in the art, in the mammal, each as compared to the corresponding level in a control mammal systemically administered the same dose of the immune modulator; and (b) formulating a pharmaceutical composition comprising the selected immune modulator.

Also provided are methods of formulating a pharmaceutical composition comprising an immune modulator, wherein the methods comprise the steps of formulating a pharmaceutical composition comprising an immune modulator (e.g., any of the immune modulators described herein or known in the art, or any combination thereof) determined to result in a mammal (e.g., any of the exemplary mammals described herein or known in the art) topically administered a dose of the immune modulator to the small intestine (e.g., duodenum, jejunum, or ileum) and/or colon (e.g., ascending colon, transverse colon, descending colon, rectum, or cecum) of the mammal: (i) a decrease in the level of one or more of one or more of T cells (e.g., any of the T cells described herein or known in the art), B cells (e.g., any of the B cells described herein or known in the art), natural killer (NK) cells (e.g., any of the NK cells described herein or known in the art), macrophages (e.g., any of the macrophages described herein or known in the art), M cells (e.g., any of the M cells described herein or known in the art), dendritic cells (e.g., any of the dendritic cells described herein or known in the art), and any of the other effector cells described herein or known in the art, in MALT, GALT, Peyer's patches, mesenteric lymph nodes, paraaortic lymph nodes, or any of the other tissues originating from the endoderm described herein or known in the art, in the mammal, and/or (ii) a decrease in the level of one or more of IL-1 (e.g., IL-1α or IL-1β), IL-2, IL-6, IL-8, IL-12, IL-18, interferon-K, TGF-β, tumor necrosis factor (e.g., TNFalpha), interferon-K, and GM-CSF, in MALT, GALT, Peyer's patches, mesenteric lymph nodes, paraaortic lymph nodes, or any of the other tissues originating from the endoderm described herein or known in the art, in the mammal, each as compared to the corresponding level in a control mammal systemically administered the same dose of the immune modulator.

In some embodiments of these methods, the immune modulator is selected from the group of: IL-12/IL-23 inhibitors (e.g., any of the IL-12/IL-23 inhibitors described herein or known in the art), TNFα inhibitors (e.g., any of the TNFα inhibitors described herein or known in the art), IL-6 receptor inhibitors (e.g., any of the IL-6 receptor inhibitors described herein or known in the art), CD3 inhibitors (e.g., any of the CD3 inhibitors described herein or known in the art), CD40/CD40L inhibitors (e.g., any of the CD40/CD40L inhibitors described herein or known in the art), IL-1 inhibitors (e.g., any of the IL-1 inhibitors described herein or known in the art), IL-13 inhibitors (e.g., any of the IL-13 inhibitors described herein or known in the art), IL-10 receptor agonists (e.g., any of the IL-10 receptor antagonists described herein or known in the art), integrin inhibitors (e.g., any of the integrin inhibitors described herein or known in the art), JAK inhibitors (e.g., any of the JAK inhibitors described herein or known in the art), and SIP modulators (e.g., any of the SIP modulators described herein or known in the art).

Non-limiting examples of methods of detecting the level of T cells (e.g., any of the T cells described herein or known in the art), B cells (e.g., any of the B cells described herein or known in the art), natural killer (NK) cells (e.g., any of the NK cells described herein or known in the art), macrophages (e.g., any of the macrophages described herein or known in the art), M cells (e.g., any of the M cells described herein or known in the art), dendritic cells (e.g., any of the dendritic cells described herein or known in the art), and any of the other effector cells described herein or known in the art, in MALT, GALT, Peyer's patches, mesenteric lymph nodes, paraaortic lymph nodes, or any of the other tissues originating from the endoderm described herein or known in the art, include the use of a cell sorting (e.g., fluorescence-assisted cell sorting) and immunohistochemistry. Non-limiting methods of determining the level of one or more of IL-1 (e.g., IL-1α or IL-1β), IL-2, IL-6, IL-8, IL-12, IL-18, interferon-K, TGF-β, tumor necrosis factor (e.g., TNF-alpha), interferon-K, and GM-CSF, in MALT, GALT, Peyer's patches, mesenteric lymph nodes, paraaortic lymph nodes, or any of the other tissues originating from the endoderm described herein or known in the art, include the use of enzyme-linked immunosorbent assays, immunoblots, and gene expression profiling (e.g., RT-PCR or gene chips). Additional methods for detecting the level of T cells (e.g., any of the T cells described herein or known in the art), B cells (e.g., any of the B cells described herein or known in the art), natural killer (NK) cells (e.g., any of the NK cells described herein or known in the art), macrophages (e.g., any of the macrophages described herein or known in the art), M cells (e.g., any of the M cells described herein or known in the art), dendritic cells (e.g., any of the dendritic cells described herein or known in the art), and any of the other effector cells described herein or known in the art, in MALT, GALT, Peyer's patches, mesenteric lymph nodes, paraaortic lymph nodes, or any of the other tissues originating from the endoderm described herein or known in the art, are known in the art. Additional methods for determining the level of one or more of IL-1 (e.g., IL-1α or IL-1β), IL-2, IL-6, IL-8, IL-12, IL-18, interferon-K, TGF-β, tumor necrosis factor (e.g., TNF-alpha), interferon-K, and GM-CSF, in MALT, GALT, Peyer's patches, mesenteric lymph nodes, paraaortic lymph nodes, or any of the other tissues originating from the endoderm described herein or known in the art, are known in the art.

The screening step of the method may comprise detecting inflammatory biomarkers, including but not limited to, proteins, nucleic acids, or cells, using techniques described herein or known in the art, such as immunoaffinity assays, gel electrophoresis, microscopy, microarrays, CBA (cytometric bead array), ICS (intracellular cytokine staining), MHC multimer staining (e.g., MHC-peptide tetramer staining or MHC-Ig dimer staining), and flow cytometry (e.g., fluorescence activated cell sorting (FACS)). Immunoaffinity assays can be based on antibodies and aptamers selectively immunoreactive with proteins or other inflammatory biomarkers. These techniques include without limitation immunoprecipitation, Western blot analysis, molecular binding assays, enzyme-linked immunosorbent assay (ELISA), enzyme-linked immunofiltration assay (ELIFA), and immunohistochemistry (IHC). Immunohistochemistry (IHC) is a process of localizing antigens (e.g., proteins) in cells of a tissue using binding agents (e.g., antibodies or aptamers) specifically to antigens in the tissues. The antigen-binding binding agent can be conjugated or fused to a tag that allows its detection, e.g., via visualization. Other well-known immunoassay techniques can also be used including, e.g., ELISA, radioimmunoassay (RIA), immunoradiometric assays (IRMA) and immunoenzymatic assays (IEMA), including sandwich assays. For the quantification of the expression level of nucleic acids encoding one or more inflammatory polypeptides, or RNA transcripts or expression products thereof, immunohistochemistry (IHC) and/or fluorescence in situ hybridization (FISH) can be used. Other techniques for determination of expression levels of inflammatory genes, include RT-PCR, microarrays, serial analysis of gene expression (SAGE), and gene expression by sequencing.

In some embodiments of any of these methods, the pharmaceutical composition is an ingestible device that contains a therapeutically effective amount of the immune modulator disposed therein. In some embodiments of any of these methods, the formulated pharmaceutical composition can be any of the compositions described herein, any of the devices described herein (e.g., any of the ingestible devices or autonomic devices described herein), or any of the reservoirs containing the immune modulator described herein. Some embodiments of these methods can further include disposing the formulated pharmaceutical composition into any of the devices described herein (e.g., any of the ingestible devices or autonomic devices described herein) or any of the reservoirs described herein.

In some embodiments of any of these methods, the topical administration can be performed using any of the devices described herein (e.g., any of the ingestible devices or autonomous devices described herein). In some embodiments of these methods, the topical administration can be performed using a surgical procedure, e.g., cannulation (e.g., as described in any of Examples 2, 5, 7, and 9). In some embodiments of these methods, the topical administration can be performed by enema, local tissue injections, administration via catheter, device, or cannulation. In some embodiments of these methods, systemic administration can include traditional means, such as oral, subcutaneous, or intravenous administration.

In some embodiments of any of these methods, the mammal can be any of the mammals described herein (e.g., a human, a cow, a sheep, a pig, a goat, a horse, or a donkey), a dog, a cat, a camel, a yak, a llama, an alpaca, a ferret, a rabbit, a rat, a mouse, a hamster, a primate (e.g., a monkey, a macaque, a baboon, a marmoset, and a chimpanzee). In some embodiments of any of these methods, the mammal can be a model of a human disease (e.g., an accepted model of a human disease).

In some embodiments of any of these methods, the immune modulator is released consistent with any of the exemplary parameters and/or consistent with any of the methods described herein.

Also provided herein are pharmaceutical compositions prepared by any of the methods described herein. Also provided are kits comprising any of the pharmaceutical compositions described herein.

Also provided herein are a pharmaceutical composition (e.g., any of the pharmaceutical compositions described herein), a device (e.g., any of the ingestible devices described herein or any of the autonomous devices described herein), or a reservoir (e.g., any of the reservoirs described herein) that comprise (or have disposed therein) an immune modulator (e.g., any of the immune modulators described herein or known in the art, or any combination thereof) determined to have demonstrated (i) a decrease in one or both of the level of T cells in a mesenteric lymph node and the level of T cells in a Peyer's patch in a mammal, and/or (ii) an increase in the level of T cells in blood in the mammal, following topical administration to a small intestine and/or colon of a mammal (e.g., any of the exemplary mammals described herein or known in the art), each as compared to the corresponding level in a control mammal systemically administered the same dose of the immune modulator. Any of the pharmaceutical compositions (e.g., any of the pharmaceutical compositions described herein), devices (e.g., any of the ingestible devices described herein or any of the autonomous devices described herein), or reservoirs (e.g., any of the reservoirs described herein) can have any of the attributes or properties of any of the pharmaceutical compositions, devices, or reservoirs described herein, and can be generated using any of the exemplary aspects or methods of manufacturing a pharmaceutical composition, device, or reservoir described herein.

Aspects and embodiments as described herein are intended to be freely combinable. For example, any details or embodiments described herein for methods of treatment apply equally to an agent, composition or ingestible device for use in said treatment. Any details or embodiments described for a device apply equally to methods of treatment using the device, or to an agent or composition for use in a method of treatment involving the device.

BRIEF DESCRIPTION OF THE DRAWINGS

FIG. 7 is a plot illustrating data collected during an example operation of an ingestible device, which may be used when determining a location of an ingestible device as it transits through a GI tract, in accordance with some embodiments of the disclosure.

FIG. 8 is another plot illustrating data collected during an example operation of an ingestible device, which may be used when determining a location of an ingestible device as it transits through a GI tract, in accordance with some embodiments of the disclosure.

FIG. 23 illustrates a valve system.

FIGS. 24A and 24B illustrate a portion of a two-stage valve system in its first and second stages, respectively.

FIG. 52 is a representative table of the plasma adalimumab concentrations (μg/mL) as shown in FIG. 51.

FIG. 68A shows binding of anti-TNFα to TNFα receptor without drug. FIG. 68B shows binding of anti-TNFα to TNFα with drug.

FIG. 93 is a representative table showing the quantitative histological grading of colitis as described in Example 11.

Extensive loss (light asterisks) of intestinal crypts is present in the mucosa. Scattered crypts remain (dark asterisks) and are often dilated and filled with inflammatory cell debris and mucus. The luminal epithelium persists in some areas (upper left arrow), but is absent in others (erosion; top middle and top right arrows). Inflammatory cells in the mucosa (light arrow) are abundant and extend into the submucosa (bottom left and bottom middle arrows).

Figure 97:
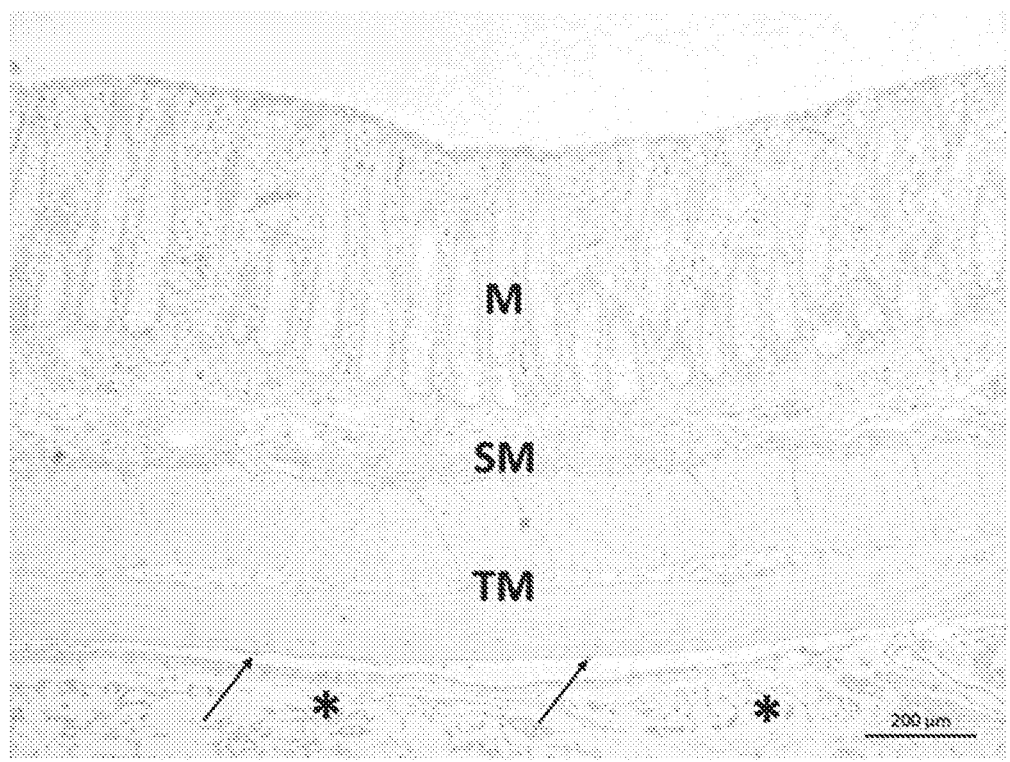

FIG. 97 is a representative immunohistochemistry micrograph of the transverse colon of animal 1501 (healthy control swine) stained for human IgG. M, mucosa; SM, submucosa; TM, tunica muscularis. Serosal surface (arrows) and loose connective mesentery tissue (asterisks) are indicated. Faint 3,3-diaminobenzidine (DAB) staining in this tissue was considered a background effect and not indicative of human IgG.

Figure 98:
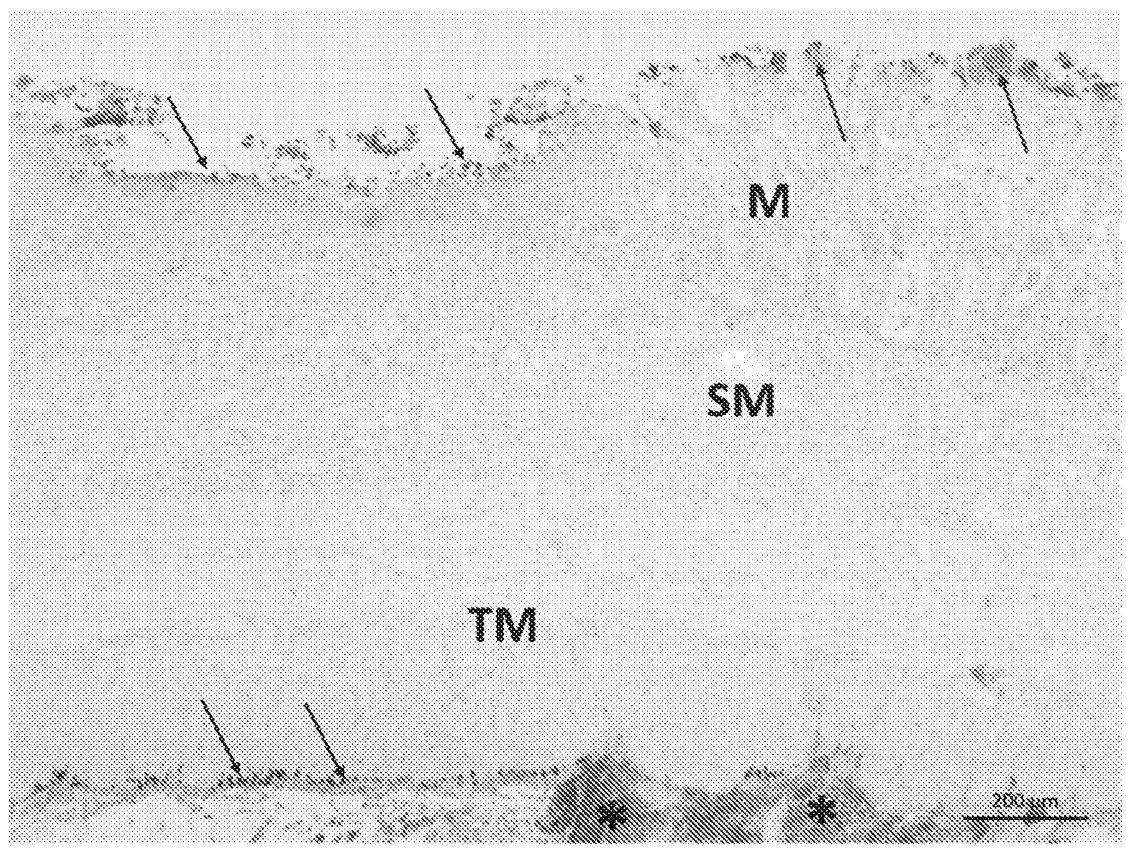

FIG. 98 is a representative immunohistochemistry micrograph of the transverse colon of animal 2504 (8.5% DSS-induced colitis swine treated with 1.86 mg/kg dose of adalimumab) stained for human IgG. M, mucosa; SM, submucosa; TM, tunica muscularis. DAB staining demonstrates the presence of human IgG at the surface of luminal epithelium (two top right arrows) and at the luminal surface of an area of inflammation and erosion (top two left arrows).

Intense staining is also present in the loose connective mesentery tissue (asterisks) and extends a short distance into the outer edge of the tunica muscularis (bottom left two arrows). This type of staining was considered strong (grade 4) or very strong (grade 5).

Figure 99:
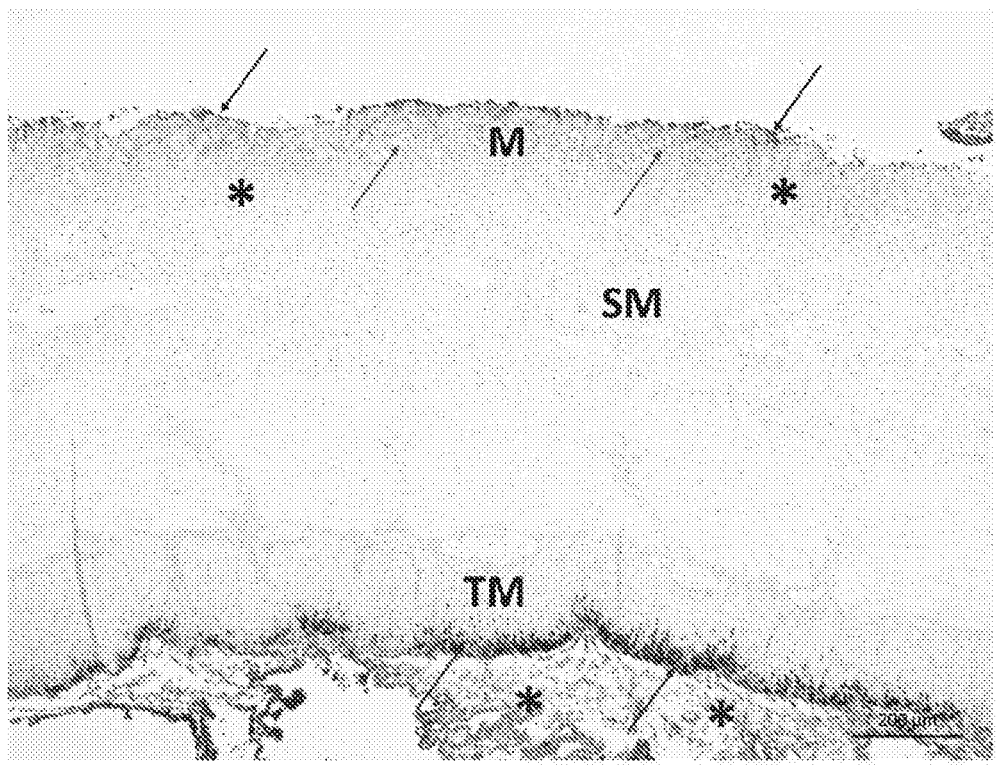

FIG. 99 is a representative immunohistochemistry micrograph of the large intestine of animal 2504 (8.5% DSS-induced colitis swine treated with 1.86 mg/kg adalimumab) stained for human IgG. M, mucosa; SM, submucosa; TM, tunica muscularis. Lesions of DSS-induced colitis are present in this section. The luminal epithelium is absent (erosion) and diffuse loss of crypts (glands) is seen (top two asterisks). Very strong (grade 5) DAB (brown) staining demonstrates the presence of human IgG in the loose mesentery connective tissue (bottom two asterisks) and extending a short distance into the outer edge of the tunica muscularis (bottom two arrows). Strong (grade 4) staining for human IgG is seen at the eroded luminal surface (top two arrows pointing down) and within the inflammatory exudate. Weak (grade 2) staining for human IgG extends into the lamina propria (top two arrows pointing up) near the luminal surface.

Figure 100:
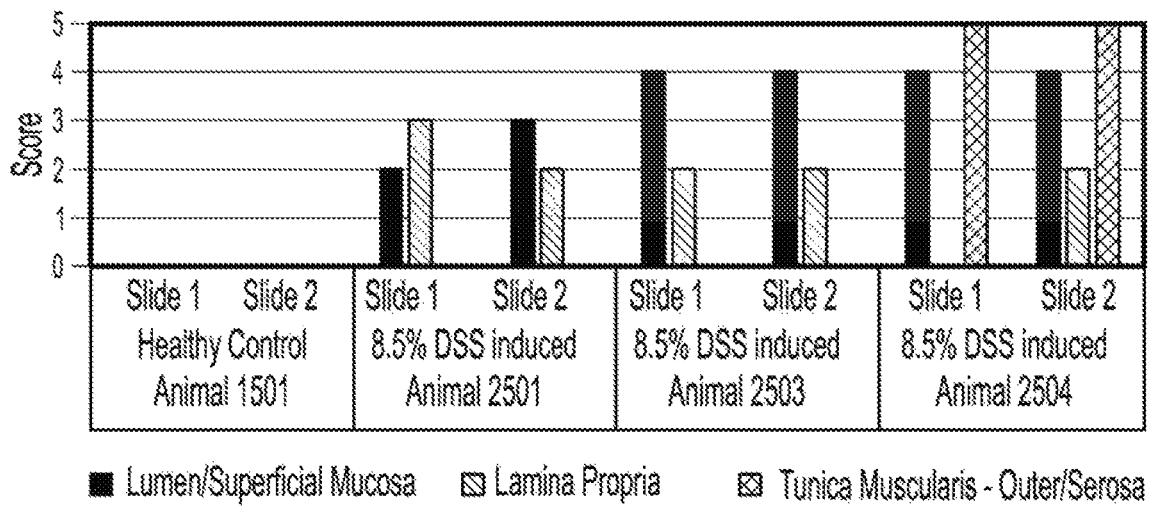

FIG. 100 is a graph showing the presence of human IgG (adalimumab) at the specified locations (lumen/superficial mucosa, lamina propria, and tunica muscularis-outer/serosa) (scored level) in two slides from each of animal 1502 (placebo-treated healthy control swine), animal 2501 (swine with 8.5% DSS-induced colitis treated with 1.86 mg/kg adalimumab), animal 2503 (swine with 8.5% DSS-induced colitis treated with 1.86 mg/kg adalimumab) and animal 2504 (swine with 8.5% DSS-induced colitis treated with 1.86 mg/kg adalimumab) at the placebo or adalimumab administration site. Absence of a bar for a particular location indicates that the value for this location was 0. Scoring: 0=not present; 1=minimal; 2=weak; 3=moderate; 4=strong; and 5=very strong immunolabel.

Figure 101:
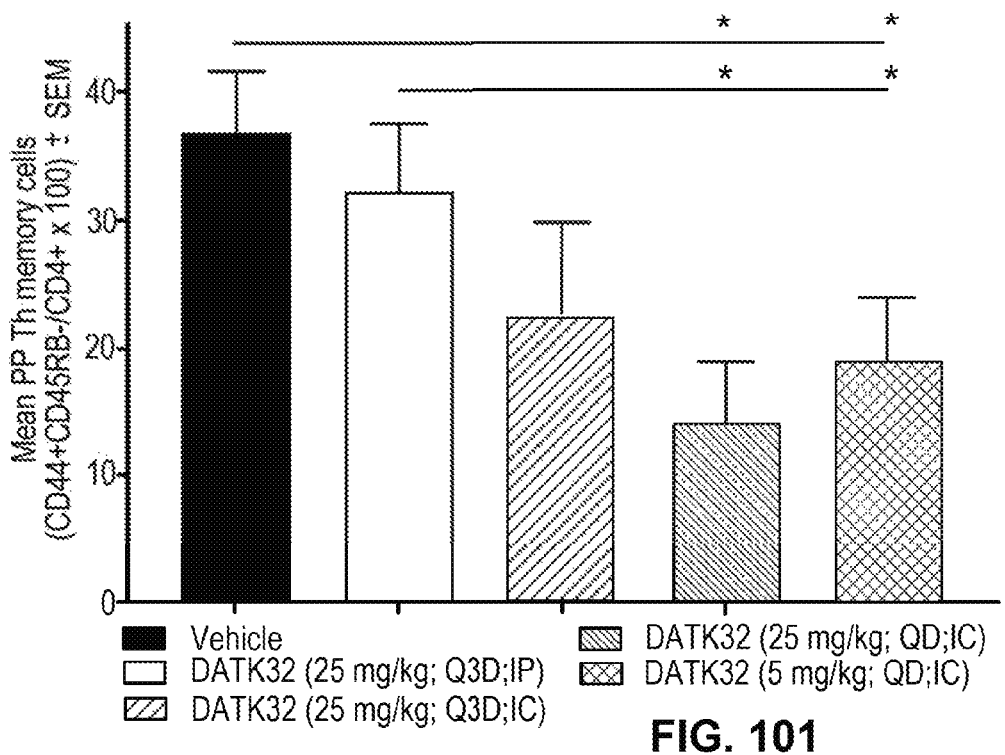

FIG. 101 is a graph showing the mean of Th memory cells (mean±SEM) in Peyer's Patches (PP) for DATK32 antibody (anti-α4β7 integrin antibody) intraperitoneally (25 mg/kg) or intracecally (25 mg/kg or 5 mg/kg) administered treatment groups given daily (QD) or every third day (Q3D), when compared to vehicle control (Vehicle) and when IP is compared to IC. Mean Th memory cells were measured using FACS analysis. Mann-Whitney's U-test and Student's t-test were used for statistical analysis on non-Gaussian and Gaussian data respectively. A value of p<0.05 was considered significant (Graph Pad Software, Inc.).

Figure 102:
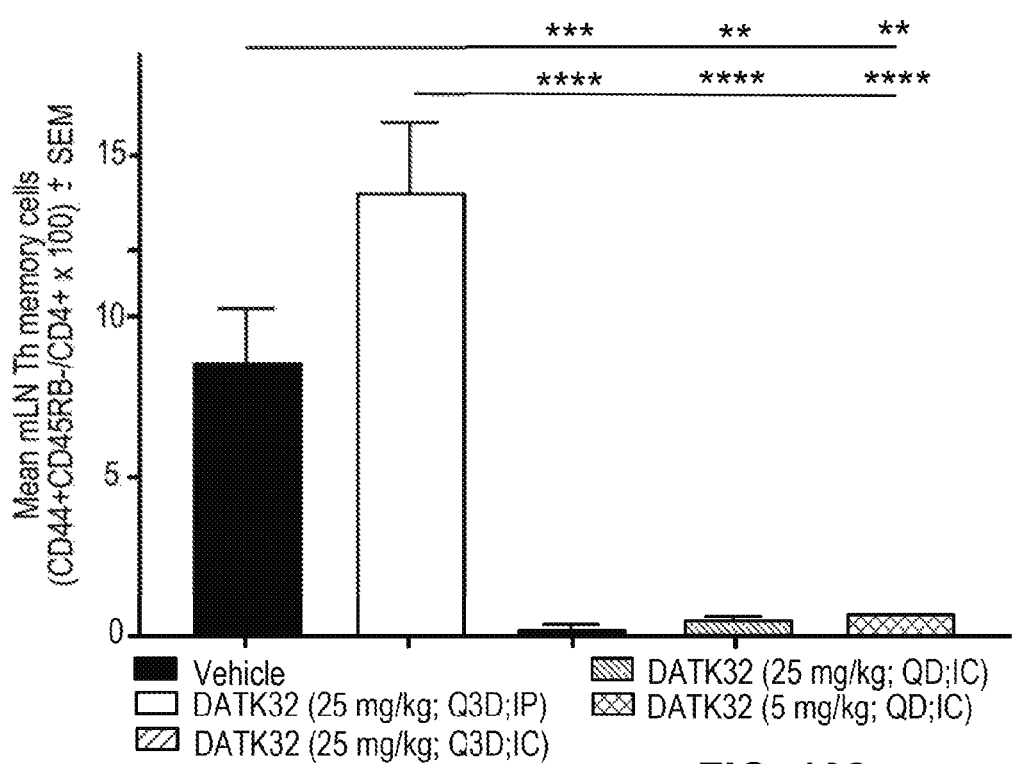

FIG. 102 is a graph showing the mean of Th memory cells (mean±SEM) in mesenteric lymph nodes (mLN) for DATK32 antibody (anti-α4β7 integrin antibody) intraperitoneally (25 mg/kg) or intracecally (25 mg/kg or 5 mg/kg) administered treatment groups given daily (QD) or every third day (Q3D), when compared to vehicle control (Vehicle) and when IP is compared to IC. Mean Th memory cells were measured using FACS analysis. Mann-Whitney's U-test and Student's t-test were used for statistical analysis on non-Gaussian and Gaussian data respectively. A value of p<0.05 was considered significant (Graph Pad Software, Inc.).

Figure 103:
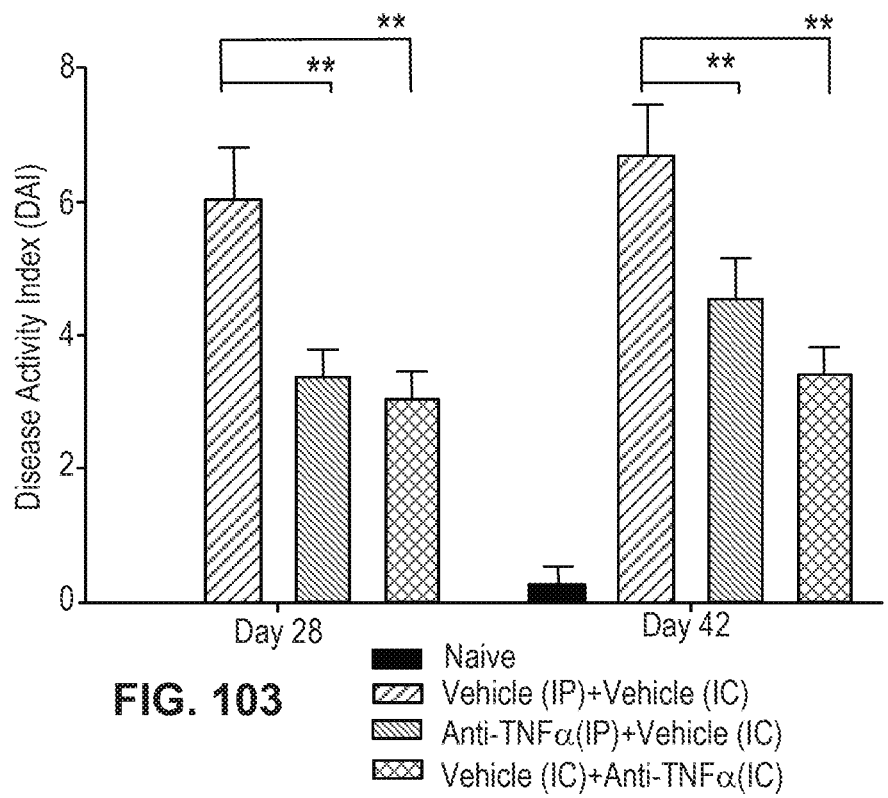

FIG. 103 is a graph showing the Disease Activity Index (DAI) of naïve mice (Group 1), mice administered vehicle only both intraperitoneally (IP) and intracecally (IC) (Group 2), mice administered an anti-TNFα antibody IP and vehicle IC (Group 7), and mice administered an anti-TNFα antibody IC and vehicle IP (Group 8) at Day 28 and Day 42 of the study described in Example 16.

Figure 104:
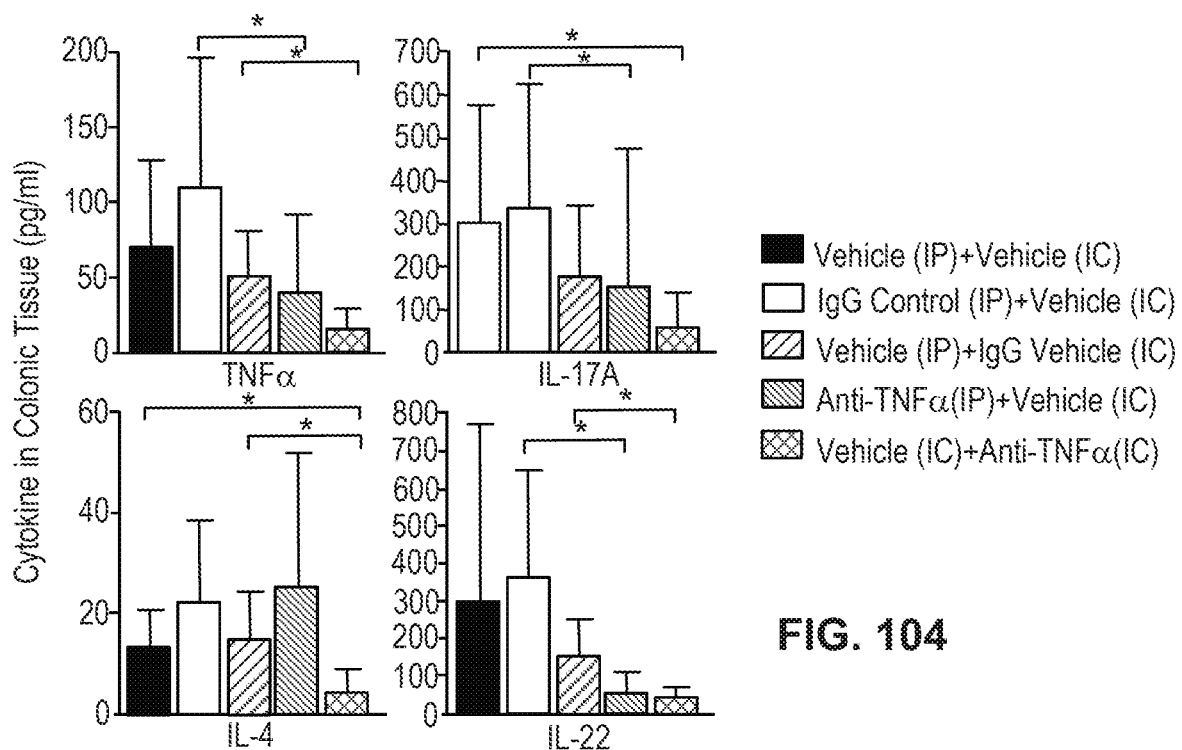

FIG. 104 is a set of graphs showing the colonic tissue concentration of TNFα, IL-17A, IL-4, and IL-22 in mice administered vehicle only both IP and IC (Group 2), mice administered IgG control antibody IP and vehicle IC (Group 3), mice administered IgG control IC and vehicle IP (Group 4), mice administered anti-TNFα antibody IP and vehicle IC (Group 7), and mice administered anti-TNFα antibody IC and vehicle IP (Group 8) at Day 42 of the study described in Example 16.

Figure 105:
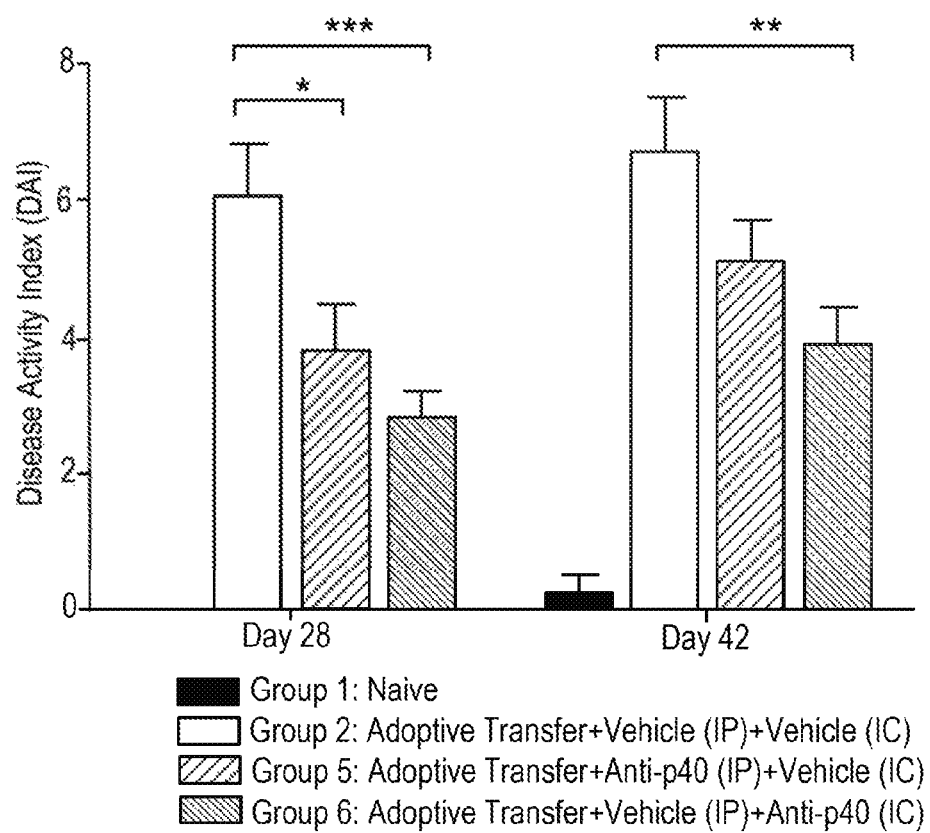

FIG. 105 is a graph showing the Disease Activity Index (DAI) of naïve mice (Group 1), mice administered vehicle only both IP and IC (Group 2), mice administered an anti-IL12 p40 antibody IP and vehicle IC (Group 5), and mice an anti-IL12 p40 antibody IC and vehicle IP (Group 6) at Day 28 and Day 42 of the study described in Example 16.

Figure 106:
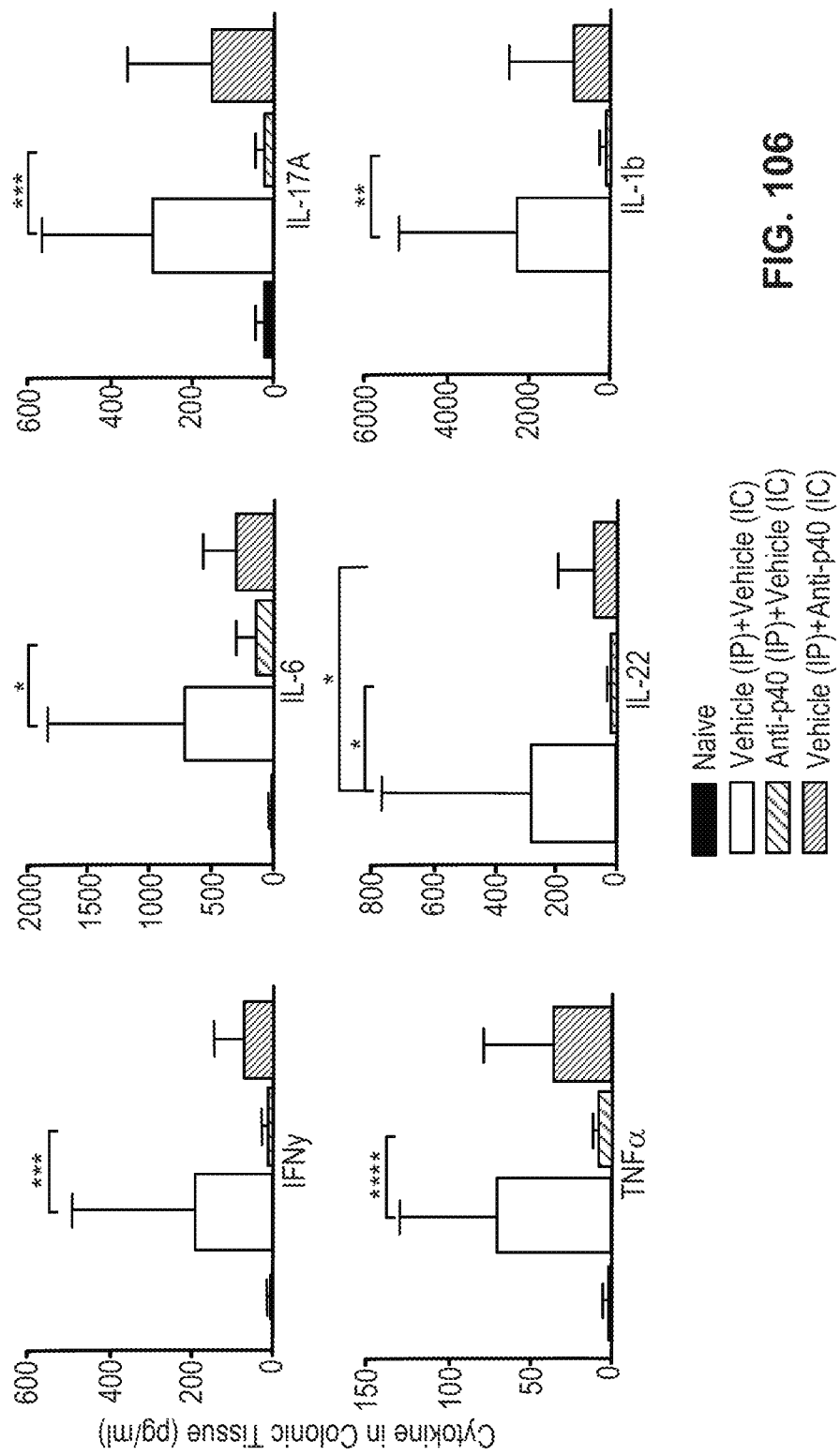

FIG. 106 is a set of graphs showing the colonic tissue concentration of IFN-gamma, IL-6, IL-17A, TNFα, IL-22, and IL-1b in naïve mice (Group 1), mice administered vehicle only both IP and IC (Group 2), mice administered anti-IL12 p40 antibody IP and vehicle IC (Group 5), and mice administered anti-IL12 p40 antibody IC and vehicle IP (Group 8) at Day 42 of the study described in Example 16.

Figure 107A:
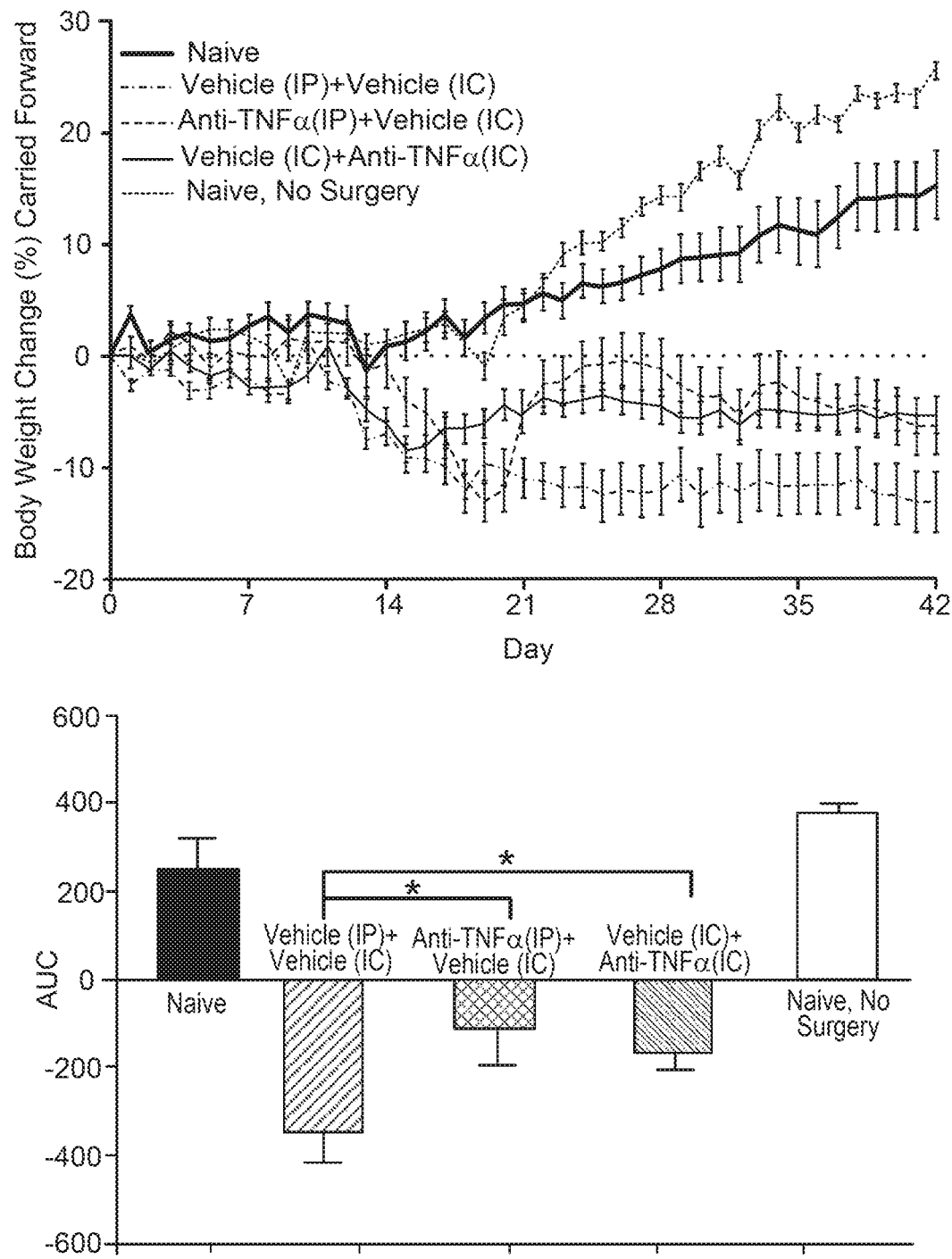
Figure 107B:
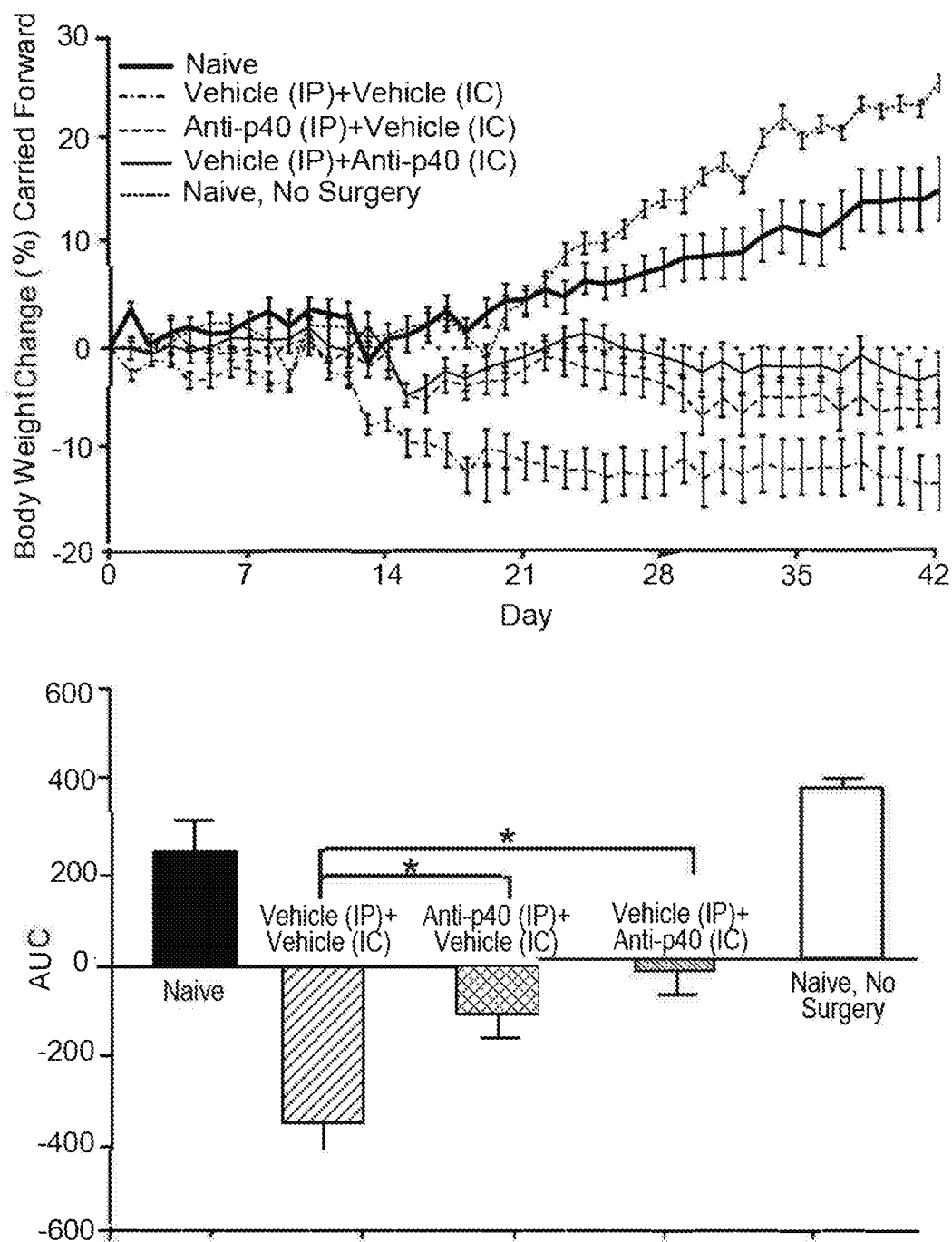

FIGS. 107A-107B show body weight changes (mean % SEM). FIG. 107A shows the influence of anti-TNF alpha; FIG. 107B shows the influence of anti-IL12p40. The AUC was calculated using the trapezoidal rule and is shown in the figure inset. Differences in body weight loss were calculated as AUC for individual mouse from Days 0 to 42. Two-tailed Mann-Whitney U-Test; p<0.05*; p<0.01; p<0.005*, n=5-9.

Figure 108:
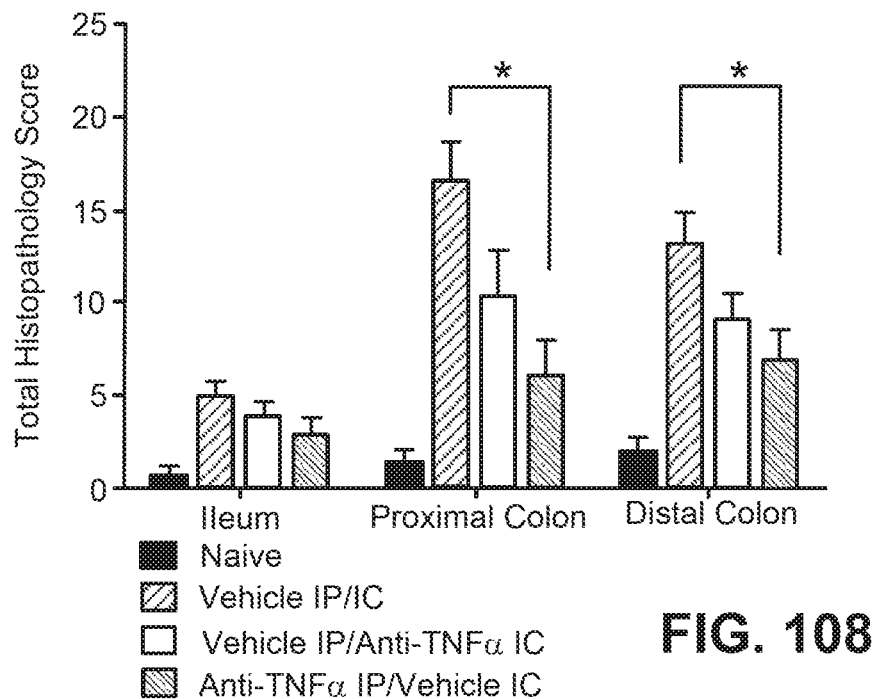

FIG. 108 shows total histopathology score (mean %±SEM) in ileum, proximal colon and distal colon tissues after targeted IC anti-TNF alpha treatment compared with vehicle and IP treatment groups. Pair-wise comparisons by two-tailed Mann-Whitney U-Test for treatment effects; p<0.05*.

FIGS. 109A-109D show mean lymphocyte counts from luminal to external submucosa of proximal colon and represented images of H&E stains and IHC stains of the proximal colon.

Figure 109A:
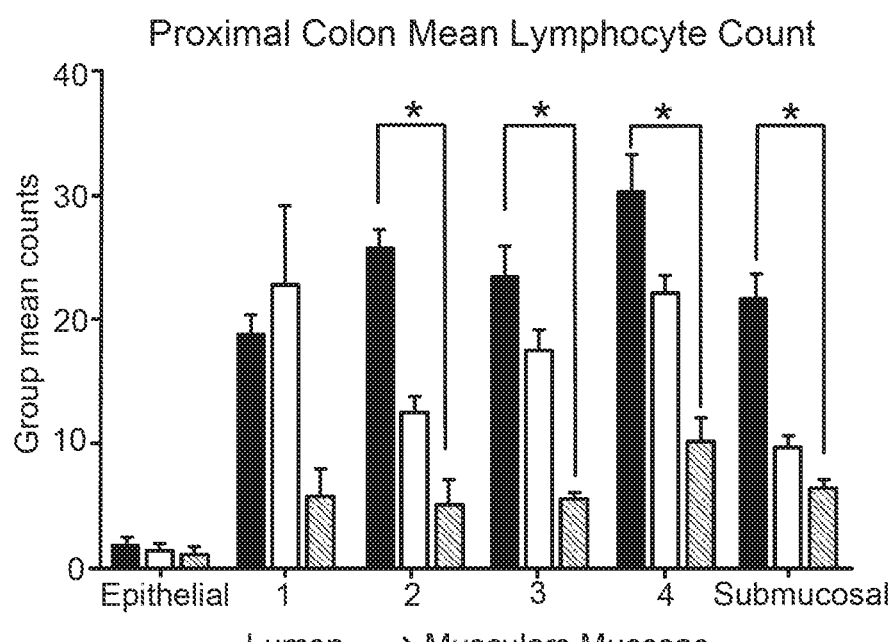
Figure 109B:
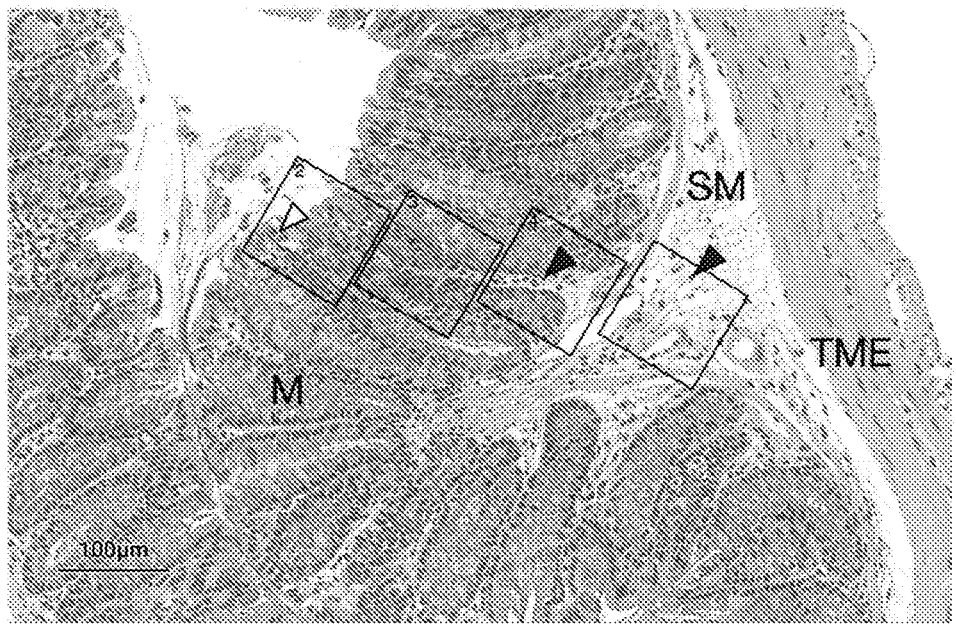
Figure 109C:
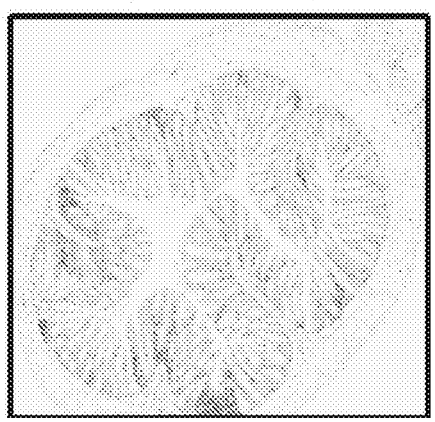
Figure 109D:
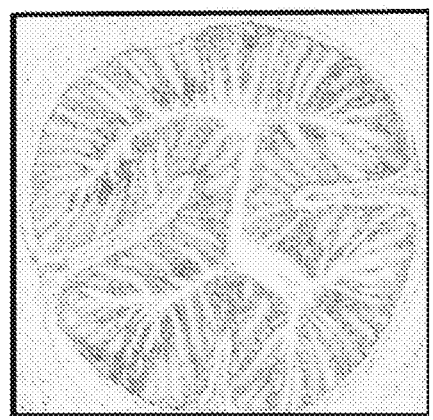

FIG. 109A shows the mean lymphocyte count from most inner lumen to submucosal of the proximal colon in groups treated with Vehicle controls, anti-TNFα (IP) and anti-TNFα (IC), Group mean+/−SEM. Kruskal-Wallis Test with Dunn's multiple comparison for treatment effects; p<0.05*. FIG. 109B is a representative image of H&E stain of proximal colon in proximal colon of anti-TNFα (IC) group. An intraepithelial lymphocyte (white arrowhead), example lamina proprial lymphocytes (black arrowheads), and the tunica muscularis externa (TME) are indicate. FIGS. 109C and 109D are representative images of IHC stain of CD4 marker for lymphocytes in proximal colon of anti-TNFα (IC) (FIG. 109C) or anti-TNFα (IP) (FIG. 109D) group.

Figures 110A, 110B:
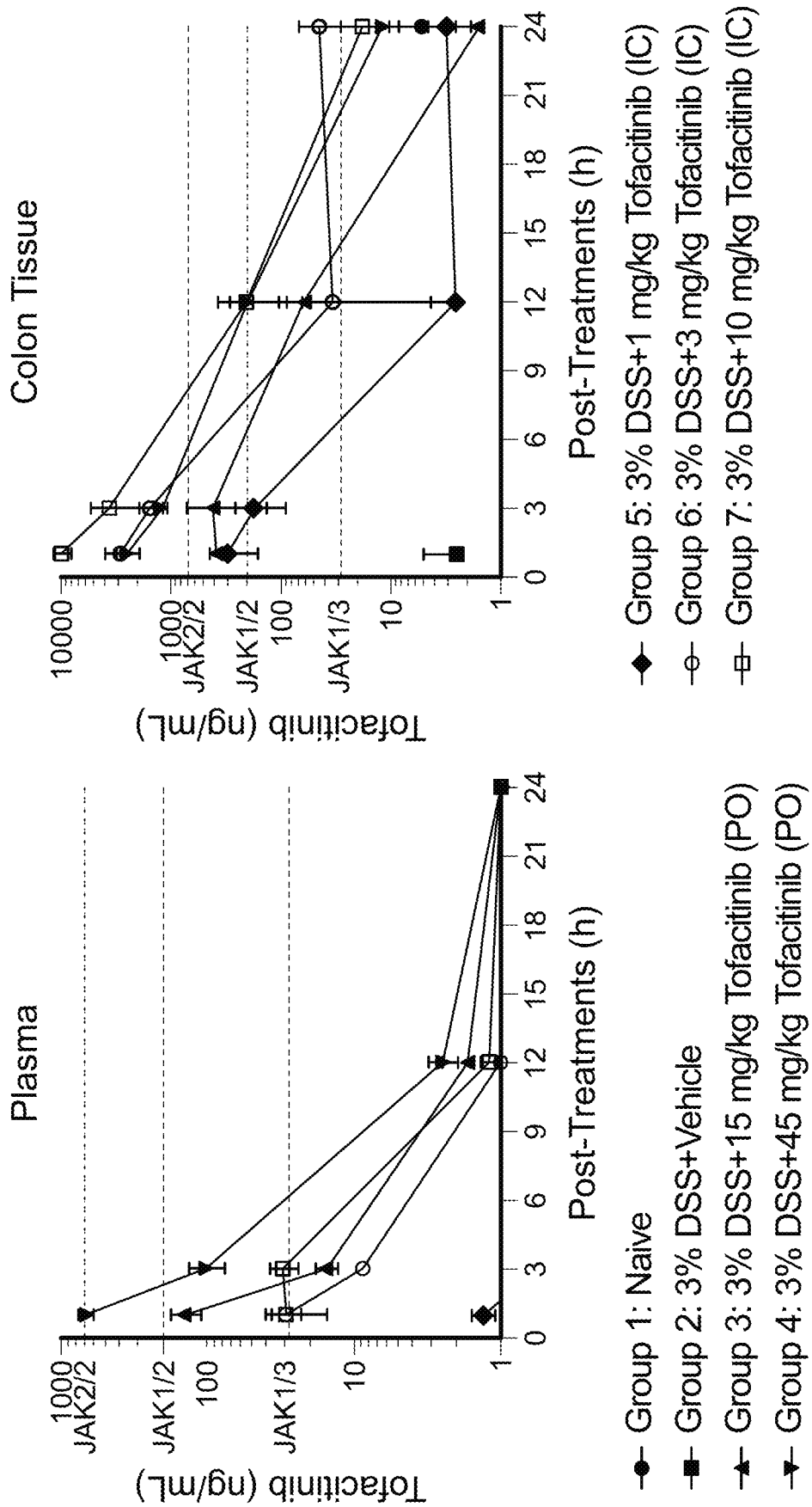

FIGS. 110A-110B show mean plasma (FIG. 110A) and colon tissue (FIG. 110B) concentrations of tofacitinib (free base) over a 24-hour period post-treatment with tofacitinib citrate or vehicle in a DSS-induced colitis mouse model. Dashed lines indicate in vitro $IC_{50}$ values for JAK1/3, JAK1/2 and JAK2/2 in whole blood. Error bars represent standard deviation.

FIGS. 111A-111C show plasma (FIG. 111A), colon content (FIG. 111B) and colon tissue (FIG. 111C) tofacitinib exposure ($AUC_{0-24h}$) after treatment with vehicle or tofacitinib citrate via per oral (PO) or intracecal (IC) administration in a DSS-induced colitis mouse model.

Figure 112A:
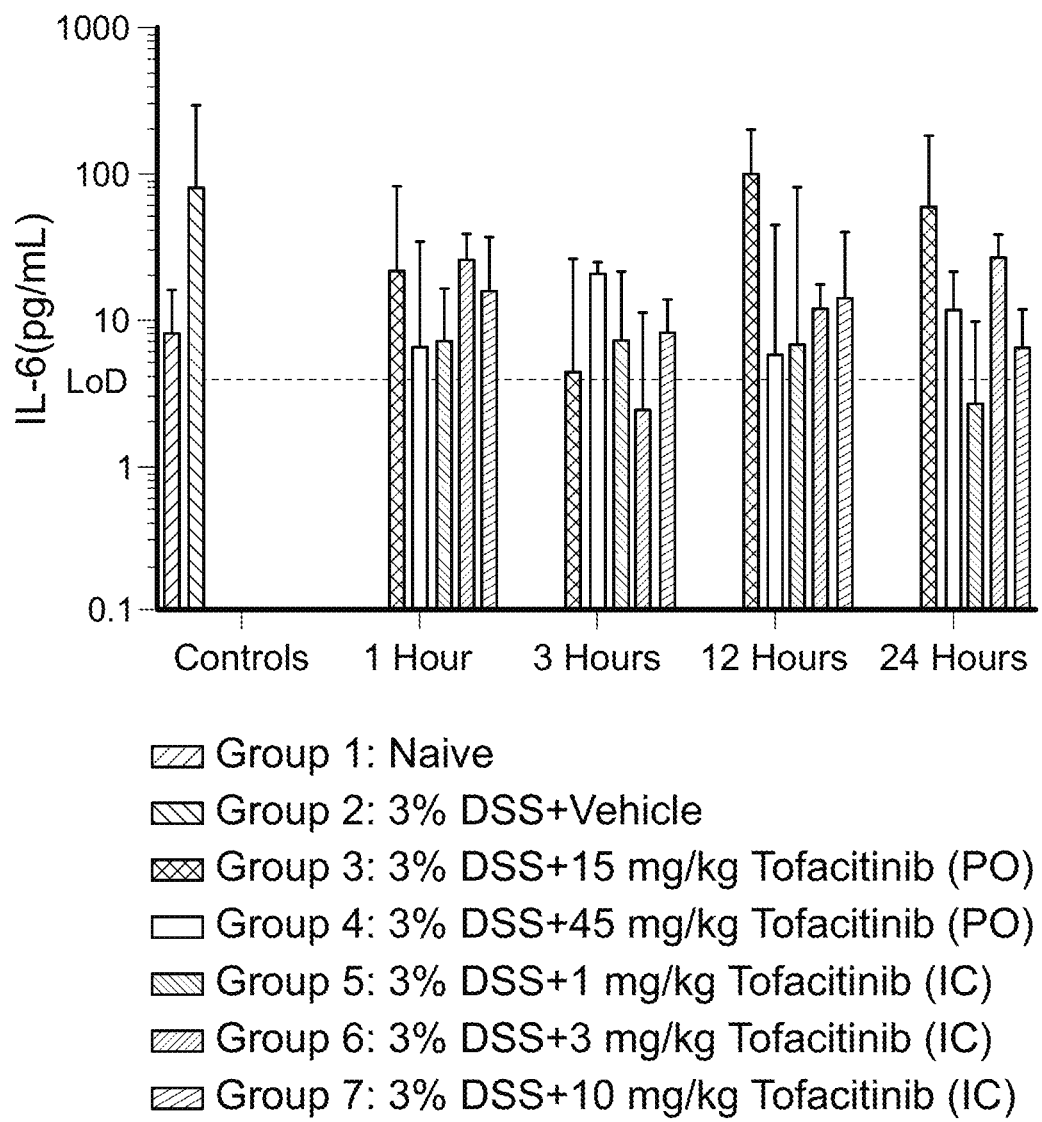
Figure 112B:
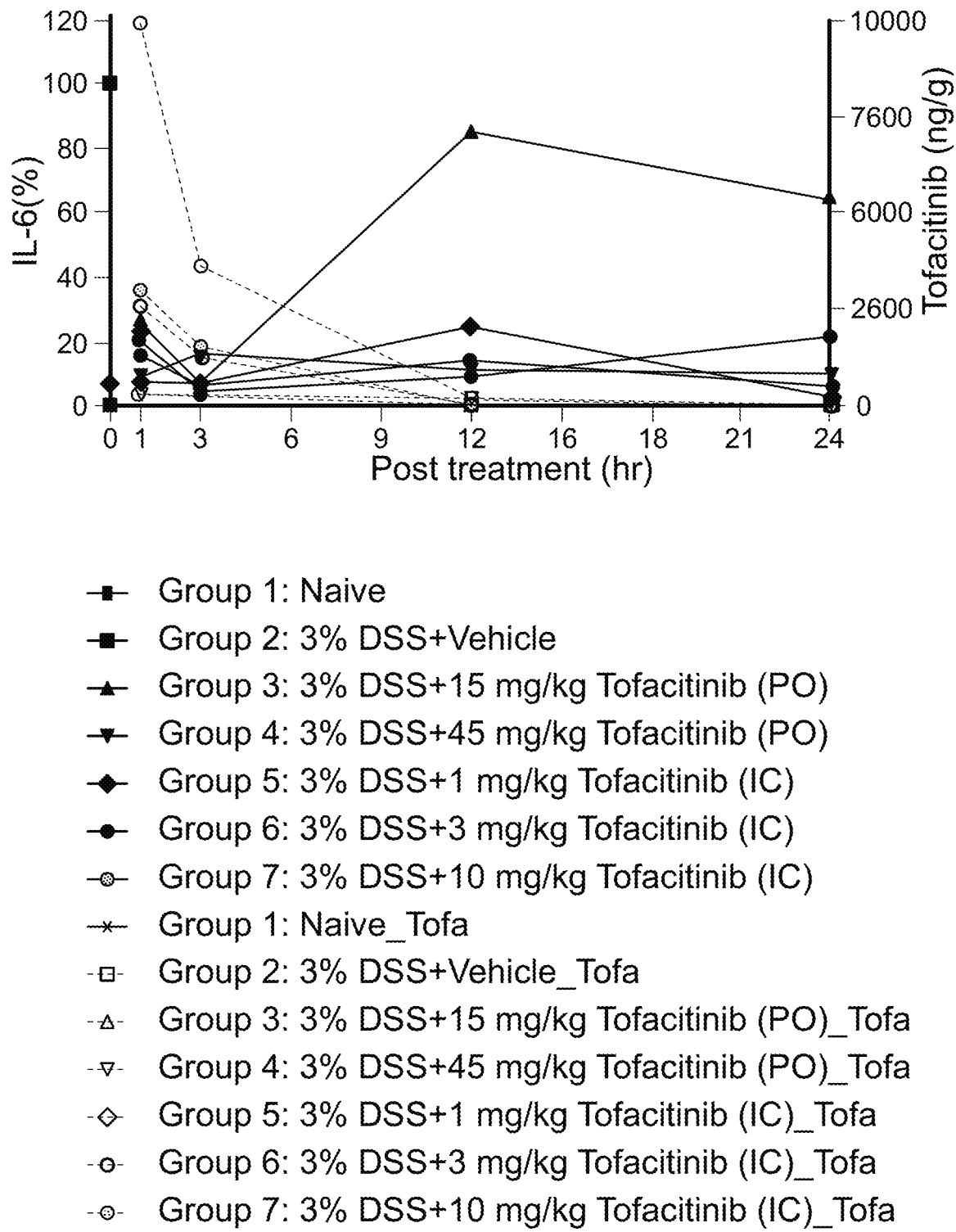

FIGS. 112A-112B show IL-6 concentrations in colon tissue over a 24-hour period post-treatment with vehicle or tofacitinib citrate via per oral (PO) or intracecal (IC) administration in a DSS-induced colitis mouse model on Study Day 12. FIG. 112A shows IL-6 concentrations in colon tissue at various timepoints on Study Day 12. FIG. 112B shows the relationship between tofacitinib concentration in colon tissue (open shapes and dotted lines; right y-axis) and % IL-6 in colon tissue after treatment with tofacitinib citrate, normalized to DSS vehicle control (Group 2) (solid shapes and solid lines; left y-axis).

DETAILED DESCRIPTION

The present disclosure is directed to various methods and formulations for treating diseases and conditions in tissues and organs originating from the endoderm with a therapeutic agent as disclosed herein. For example, in an embodiment, a method of treating a disease or condition in tissues and organs originating from the endoderm in a subject comprises administering to the subject a pharmaceutical formulation comprising a therapeutic agent as disclosed herein wherein the pharmaceutical formulation is released in the subject's gastrointestinal tract proximate to the intended site of release. For example, in an embodiment, the pharmaceutical formulation comprises a therapeutically effective amount of a therapeutic agent as disclosed herein, wherein release of said therapeutic agent in the gastrointestinal tract produces therapeutic effects (e.g., ameliorates disease) in tissues and organs of endoderm origin. For example, release of an immune modulator in the cecum can produce anti-inflammatory effects proximal to the site of release in the ileum and jejunum. In another example, release of an immune modulator in the cecum can produce anti-inflammatory effects in the large intestine and small intestine. In yet another example, release of an immune modulator in the small intestine or cecum can produce anti-inflammatory effects in the liver.

In some embodiments, the formulation is contained in an ingestible device, and the device releases the formulation at a location proximate to the site of disease. The location of the site of disease may be predetermined. For example, an ingestible device, the location of which within the GI tract can be accurately determined as disclosed herein, may be used to sample one or more locations in the GI tract and to detect one or more analytes, including markers of the disease, in the GI tract of the subject. A pharmaceutical formulation may be then administered via an ingestible device and released at a location proximate to the predetermined site of disease. The release of the formulation may be triggered autonomously, as further described herein.

The following disclosure illustrates aspects of the formulations and methods embodied in the claims.

Formulations and Pharmaceutical Formulations

As used herein, a "formulation" of an immune modulator may refer to either the immune modulator in pure form—such as, for example, the lyophilized immune modulator—or a mixture of the immune modulator with one or more physiologically acceptable carriers, excipients or stabilizers. Thus, therapeutic formulations or medicaments can be prepared by mixing the immune modulator having the desired degree of purity with optional physiologically acceptable carriers, excipients or stabilizers (Remington's Pharmaceutical Sciences 16th edition, Osol, A. Ed. (1980)), in the form of lyophilized formulations or aqueous solutions. Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) antibody; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as TWEEN™, PLURONICS™ or polyethylene glycol (PEG). Exemplary pharmaceutically acceptable carriers herein further include insterstitial drug dispersion agents such as soluble neutral-active hyaluronidase glycoproteins (sHASEGP), for example, human soluble PH-20 hyaluronidase glycoproteins, such as rHuPH20 (HYLENEX<®>, Baxter International, Inc.). Certain exemplary sHASEGPs and methods of use, including rHuPH20, are described in US Patent Publication Nos. 2005/0260186 and 2006/0104968. In one aspect, a sHASEGP is combined with one or more additional glycosaminoglycanases such as chondroitinases. Exemplary lyophilized formulations are described in U.S. Pat. No. 6,267,958. Aqueous formulations include those described in U.S. Pat. No. 6,171,586 and WO2006/044908, the latter formulations including a histidine-acetate buffer.

A formulation of an immune modulator as disclosed herein, e.g., sustained-release formulations, can further include a mucoadhesive agent, e.g., one or more of polyvinyl pyrolidine, methyl cellulose, sodium carboxyl methyl cellulose, hydroxyl propyl cellulose, carbopol, a polyacrylate, chitosan, a eudragit analogue, a polymer, and a thiomer. Additional examples of mucoadhesive agents that can be included in a formulation with a therapeutic agent as disclosed herein are described in, e.g., Peppas et al., *Biomaterials* 17 (16): 1553-1561, 1996; Kharenko et al., *Pharmaceutical Chemistry J.* 43 (4): 200-208, 2009; Salamat-Miller et al., *Adv. Drug Deliv. Reviews* 57 (11): 1666-1691, 2005; Bernkop-Schnurch, *Adv. Drug Deliv. Rev.* 57 (11): 1569-1582, 2005; and Harding et al., *Biotechnol. Genet. Eng. News* 16 (1): 41-86, 1999.

In some embodiments, components of a formulation may include any one of the following components, or any combination thereof: Acacia, Alginate, Alginic Acid, Aluminum Acetate, an antiseptic, Benzyl Alcohol, Butyl Paraben, Butylated Hydroxy Toluene, an antioxidant. Citric acid, Calcium carbonate, Candelilla wax, a binder, Croscarmellose sodium, Confectioner sugar, Colloidal silicone dioxide, Cellulose, Carnuba wax, Corn starch, Carboxymethylcellulose calcium, Calcium stearate, Calcium disodium EDTA, Chelation agents, Copolyvidone, Castor oil hydrogenated, Calcium hydrogen phosphate dehydrate, Cetylpyridine chloride, Cysteine HCl, Crosspovidone, Dibasic Calcium Phosphate, Disodium hydrogen phosphate, Dimethicone, Erythrosine Sodium, Ethyl Cellulose, Gelatin, Glyceryl monooleate, Glycerin, Glycine, Glyceryl monostearate, Glyceryl behenate, Hydroxy propyl cellulose, Hydroxyl propyl methyl cellulose, Hypromellose, HPMC Pthalate, Iron oxides or ferric oxide, Iron oxide yellow, Iron oxide red or ferric oxide, Lactose (hydrous or anhydrous or monohydrate or spray dried), Magnesium stearate, Microcrystalline cellulose, Mannitol, Methyl cellulose, Magnesium carbonate, Mineral oil, Methacrylic acid copolymer, Magnesium oxide, Methyl paraben, PEG, Polysorbate 80, Propylene glycol, Polyethylene oxide, Propylene paraben, Polaxamer 407 or 188 or plain, Potassium bicarbonate, Potassium sorbate, Potato starch, Phosphoric acid, Polyoxy 140 stearate, Sodium starch glycolate, Starch pregelatinized, Sodium crossmellose, Sodium lauryl sulfate, Starch, Silicon dioxide, Sodium benzoate, Stearic acid, Sucrose base for medicated confectionery, a granulating agent, Sorbic acid, Sodium carbonate, Saccharin sodium, Sodium alginate, Silica gel, Sorbiton monooleate, Sodium stearyl fumarate, Sodium chloride, Sodium metabisulfite, Sodium citrate dehydrate, Sodium starch, Sodium carboxy methyl cellulose, Succinic acid, Sodium propionate, Titanium dioxide, Talc, Triacetin, Triethyl citrate.

Accordingly, in some embodiments of the method of treating a disease as disclosed herein, the method comprises administering to the subject a pharmaceutical composition that is a formulation as disclosed herein. In some embodiments the formulation is a dosage form, which may be, as an example, a solid form such as, for example, a capsule, a tablet, a sachet, or a lozenge; or which may be, as an example, a liquid form such as, for example, a solution, a suspension, an emulsion, or a syrup.

In some embodiments the formulation is not comprised in an ingestible device. In some embodiments wherein the formulation is not comprised in an ingestible device, the formulation may be suitable for oral administration. The formulation may be, for example, a solid dosage form or a liquid dosage form as disclosed herein. In some embodiments wherein the formulation is not comprised in an ingestible device, the formulation may be suitable for rectal administration. The formulation may be, for example, a dosage form such as a suppository or an enema. In embodiments where the formulation is not comprised in an ingestible device, the formulation releases the immune modulator at a location in the gastrointestinal tract of the subject that is proximate to an intended site of release in the GI tract. Such localized release may be achieved, for example, with a formulation comprising an enteric coating. Such localized release may be achieved, an another example, with a formulation comprising a core comprising one or more polymers suitable for controlled release of an active substance. A non-limiting list of such polymers includes: poly(2-(diethylamino)ethyl methacrylate, 2-(dimethylamino)ethyl methacrylate, poly(ethylene glycol), poly(2-aminoethyl methacrylate), (2-hydroxypropyl) methacrylamide, poly(β-benzyl-1-aspartate), poly(N-isopropylacrylamide), and cellulose derivatives.

In some embodiments the formulation is comprised in an ingestible device as disclosed herein. In some embodiments wherein the formulation is comprised in an ingestible device, the formulation may be suitable for oral administration. The formulation may be, for example, a solid dosage form or a liquid dosage form as disclosed herein. In some embodiments the formulation is suitable for introduction and optionally for storage in the device. In some embodiments the formulation is suitable for introduction and optionally for storage in the reservoir comprised in the device. In some embodiments the formulation is suitable for introduction and optionally for storage in the reservoir comprised in the device. Thus, in some embodiments, provided herein is a reservoir comprising a therapeutically effective amount of an immune modulator, wherein the reservoir is configured to fit into an ingestible device. In some embodiments, the reservoir comprising a therapeutically effective amount of an immune modulator is attachable to an ingestible device. In some embodiments, the reservoir comprising a therapeutically effective amount of an immune modulator is capable of anchoring itself to the subject's tissue. As an example, the reservoir capable of anchoring itself to the subject's tissue comprises silicone. As an example, the reservoir capable of anchoring itself to the subject's tissue comprises polyvinyl chloride.

In some embodiments the formulation is suitable for introduction in the spray catheters disclosed herein.

The formulation/medicament herein may also contain more than one active compound as necessary for the particular indication being treated, for example, those with complementary activities that do not adversely affect each other. For instance, the formulation may further comprise another immune modulator or a chemotherapeutic agent. Such molecules are suitably present in combination in amounts that are effective for the purpose intended.

The active ingredients may also be entrapped in microcapsule prepared, for example, by coacervation techniques or by interfacial polymerization, for example, hydroxymethylcellulose or gelatin-microcapsule and poly-(methylmethacrylate) microcapsule, respectively, in colloidal drug delivery systems (for example, liposomes, albumin microspheres, microemulsions, nano-particles and nanocapsules) or in macroemulsions. Such techniques are disclosed in Remington's Pharmaceutical Sciences 16th edition, Osol, A. Ed. (1980).

The formulations to be used for in vivo administration must be sterile. This is readily accomplished by filtration through sterile filtration membranes.

Sustained-release preparations may be prepared. Suitable examples of sustained-release preparations include semipermeable matrices of solid hydrophobic polymers containing the immune modulator, which matrices are in the form of shaped articles, e.g., films, or microcapsule. Examples of sustained-release matrices include polyesters, hydrogels (for example, poly(2-hydroxyethyl-methacrylate), or poly(vinyl-alcohol)), polylactides (U.S. Pat. No. 3,773,919), copolymers of L-glutamic acid and γ ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(–)-3-hydroxybutyric acid. While polymers such as ethylene-vinyl acetate and lactic acid-glycolic acid enable release of molecules for over 100 days, certain hydrogels release proteins for shorter time periods. When encapsulated immune modulators remain in the body for a long time, they may denature or aggregate as a result of exposure to moisture at 37° C., resulting in a loss of biological activity and possible changes in immunogenicity. Rational strategies can be devised for stabilization depending on the mechanism involved. For example, if the aggregation mechanism is discovered to be intermolecular S—S bond formation through thio-disulfide interchange, stabilization may be achieved by modifying sulfhydryl residues, lyophilizing from acidic solutions, controlling moisture content, using appropriate additives, and developing specific polymer matrix compositions.

Pharmaceutical formulations may contain one or more immune modulators. The pharmaceutical formulations may be formulated in any manner known in the art. In some embodiments the formulations include one or more of the following components: a sterile diluent (e.g., sterile water or saline), a fixed oil, polyethylene glycol, glycerin, propylene glycol, or other synthetic solvents, antibacterial or antifungal agents, such as benzyl alcohol or methyl parabens, chlorobutanol, phenol, ascorbic acid, thimerosal, and the like, antioxidants, such as ascorbic acid or sodium bisulfite, chelating agents, such as ethylenediaminetetraacetic acid, buffers, such as acetates, citrates, or phosphates, and isotonic agents, such as sugars (e.g., dextrose), polyalcohols (e.g., mannitol or sorbitol), or salts (e.g., sodium chloride), or any combination thereof. Liposomal suspensions can also be used as pharmaceutically acceptable carriers (see, e.g., U.S. Pat. No. 4,522,811, incorporated by reference herein in its entirety). The formulations can be formulated and enclosed in ampules, disposable syringes, or multiple dose vials. Where required, proper fluidity can be maintained by, for example, the use of a coating, such as lecithin, or a surfactant. Controlled release of the immune modulator can be achieved by implants and microencapsulated delivery systems, which can include biodegradable, biocompatible polymers (e.g., ethylene vinyl acetate, polyanhydrides, polyglycolic acid, collagen, polyorthoesters, and polylactic acid; Alza Corporation and Nova Pharmaceutical, Inc.).

In some embodiments, the immune modulator is present in a pharmaceutical formulation within the device.

In some embodiments, the immune modulator is present in solution within the device.

In some embodiments, the immune modulator is present in a suspension in a liquid medium within the device.

In some embodiments, the therapeutic agent as disclosed herein is present as a pure, powder (e.g., lyophilized) form of the therapeutic agent as disclosed herein.

Liquid pharmaceutically administrable formulations can, for example, be prepared by dissolving, dispersing, etc. a therapeutic agent provided herein and optional pharmaceutical adjuvants in a carrier (e.g., water, saline, aqueous dextrose, glycerol, glycols, ethanol or the like) to form a solution, colloid, liposome, emulsion, complexes, coacervate or suspension. If desired, the pharmaceutical formulation can also contain minor amounts of nontoxic auxiliary substances such as wetting agents, emulsifying agents, co-solvents, solubilizing agents, pH buffering agents and the like (e.g., sodium acetate, sodium citrate, cyclodextrin derivatives, sorbitan monolaurate, triethanolamine acetate, triethanolamine oleate, and the like).

Small Molecule Drug Formulations—General Properties

In one embodiment, the formulation comprises a small molecule drug. In some embodiments, the small molecule drug formulation is suitable for topical delivery to the GI tract, especially for topical delivery to the small intestine, including the duodenum, the jejunum and/or the ileum; the large intestine; the cecum; and/or the colon. In a further embodiment, the formulation is suitable for topical delivery of the drug to one or more sites of disease in the GI tract. In some aspects, the small molecule drug formulation, when released into the GI tract, is dispersed such that the formulation and/or the drug is topically administered to one or more tissues of the GI tract, including diseased tissue. In some embodiments, the drug formulation when released in the GI tract, is dispersed into the mucosa, and the formulation and/or the drug is distributed locally to the site of administration and or/distal to the site of administration, thereby providing topical administration of the drug to the disease site(s).

Preferably, the formulation provides one or more of the following characteristics: substantial distribution of the formulation and/or drug in the target tissue; highly localized drug tissue concentration; low systemic drug exposure; stability of the formulation and/or drug in the drug product (e.g., stability within a delivery device, such as an ingestible device as described herein, prior to and/or after administration); stability of the formulation and/or drug in the GI environment upon administration, including a disease state GI environment (for example, temperature stability, pH stability, oxidative stability); and the ability of the formulation and/or drug to permeate into disease tissue.

In some aspects, the drug substance is provided as a solid for direct use in a drug delivery system (for example, in an ingestible device as described herein), or for combination with one or more excipients to provide a formulation suitable for delivery to the GI tract. In some embodiments, the drug substance is provided in amorphous form. In other embodiments, the drug substance is provided in crystalline form.

In some embodiments, the drug substance is provided as micronized drug particles. In some aspects, the micronized drug particles have been sized to enhance absorption and/or penetration in the GI tract and/or at the disease site. In other aspects, the micronized drug particles have been sized to optimize topical administration and absorption of the drug to the mucosal layer. In yet other aspects, the micronized drug particles have been sized to increase the dispersion loading of a suspension, i.e., to increase the concentration of the drug in the suspension in order to increase the drug load to the site of delivery upon dispersion.

In some embodiments, the drug is provided as a lyophilized powder. In some aspects, the lyophilized drug powder comprises, consists of or consists essentially of the drug. In some embodiments, the small molecule drug formulation is provided as a liquid. Preferably, the liquid formulation has a viscosity that does not exceed 5000 cps. In some embodiments, the liquid formulation has a viscosity ranging from about 0.8 to about 1000 cps.

Preferably, the small molecule drug formulation is a high concentration formulation. In some embodiments, the concentration of the drug in the formulation is expressed in units of mg/mL, for example, when the formulation is a solution formulation. In some aspects, the concentration of the drug in the formulation is at least 3 mg/mL. In other aspects, the concentration of the drug in the formulation is at least 5 mg/mL. In yet other aspects, the concentration of the drug in the formulation ranges from about 5 mg/mL to about 20 mg/mL, from about 5 mg/mL to about 15 mg/mL, or from about 10 mg/mL to about 15 mg/mL. Preferably, the concentration of the drug in the formulation is at least about 10 mg/mL, or at least about 15 mg/mL. In some embodiments, the concentration of the drug in the formulation is expressed in units of mg/g, for example, when the formulation is a solid formulation or a suspension or dispersion formulation. In some aspects, the concentration of drug in the formulation is at least 3 mg/g. In other aspects, the concentration of the drug in the formulation is at least 5 mg/g. In yet other aspects, the concentration of the drug in the formulation ranges from about 5 mg/g to about 20 mg/g, from about 5 mg/g to about 15 mg/g, or from about 10 mg/g to about 15 mg/g. Preferably, the concentration of the drug in the formulation is at least about 10 mg/g, or at least about 15 mg/g.

In one embodiment, the small molecule formulation is provided as a solution formulation, such as a fully solubilized formulation or a stabilized solution formulation. In another embodiment, the small molecule drug formulation is provided as a solid formulation, for example a solid drug alone or in combination with one or more excipients. In yet another embodiment, the small molecule formulation is provided as a dispersion or suspension formulation. In another embodiment, the formulation is provided as an emulsion formulation, including but not limited to a micelle-solubilized formulation, a lipid-based or liposomal formulation, a self-micro-emulsifying drug delivery system (SMEDDS) or a self-nano-emulsifying drug delivery system (SNEDDS). The foregoing categories are also not intended to be mutually exclusive. Thus, for example, a stabilized solution, a suspension or an emulsion formulation may incorporate micelles or liposomes.

In some aspects, the formulations in the foregoing categories further comprise one or more additional excipients to enhance performance, such as GI penetration/absorption and/or stability. Excipients that may be incorporated to enhance absorption by the GI tract and/or at the disease site within the GI tract include bile salts, chelators, surfactants, anti-oxidants, fatty acids and derivatives thereof, cationic polymers, anionic polymers, and acylcarnitines.

Bile salts may be incorporated into a formulation of the present disclosure, for example, in order to form reverse micelles, disrupt a cell membrane, open up tight junctions between cells, and/or to inhibit enzymes and/or mucolytic activity. Non-limiting examples of suitable bile salts include sodium deoxycholate, sodium taurocholate, sodium glycodeoxycholate, sodium taurodihydrofusidate, and sodium glycodihydrofudisate.

Chelators may be incorporated into a formulation of the present disclosure, for example, in order to interfere with calcium ions, disrupt intracellular junctions and/or decrease transepithelial electrical resistance. Non-limiting examples of suitable chelators include EDTA, citric acid, succinic acid and salycilates.

Surfactants may be incorporated into a formulation of the present disclosure, for example, in order to perturb intercellular lipids, lipid order, orientation and/or fluidity, and/or to inhibit efflux mechanisms. Non-limiting examples of suitable surfactants include sodium lauryl sulfate, laureth-9, sodium dodecylsulfate, sodium taurodihydrofusidate, polyoxyethylene ethers, polysorbate (polyoxyethylene sorbitan monolaurate, for example, polysorbate 20, polysorbate 40, polysorbate 60 and polysorbate 80); TRITON (t-octylphenoxypolyethoxyethanol, nonionic detergent, Union Carbide subsidiary of Dow Chemical Co., Midland Mich.); sodium octyl glycoside; lauryl-, myristyl-, linoleyl-, or stearyl-sulfobetaine; lauryl-, myristyl-, linoleyl- or stearyl-sarcosine; linoleyl-, myristyl-, or cetyl-betaine; lauroamidopropyl-, cocamidopropyl-, linoleamidopropyl-, myristamidopropyl-, palmidopropyl-, or isostearamidopropyl-betaine (e.g. lauroamidopropyl); myristamidopropyl-, palmidopropyl-, or isostearamidopropyl-dimethylamine; sodium methyl cocoyl-, or disodium methyl oleyl-taurate; sorbitan monopalmitate; and the MONAQUAT series (Mona Industries, Inc., Paterson, N.J.); polyethyl glycol (PEG), polypropylene glycol (PPG), and copolymers of poloxyethylene and poloxypropylene glycol (e.g. Pluronics/Poloxamer, PF68 etc); etc.

Fatty acids or derivatives thereof (for example, salts, esters or ethers thereof) may be incorporated into a formulation of the present disclosure, for example, in order to increase the fluidity of phospholipid membranes, contraction of actin myofilaments and/or the opening of tight junctions. Non-limiting examples of suitable fatty acids or derivatives thereof include oleic acid, linoleic acid, caprylic acid, capric acid, acyl carnitines, mono-glyceride and diglycerides.

In some embodiments, the formulation comprises at least one adhesive agent, such as a mucoadhesive agent, In some embodiments, the formulation containing the (muco)adhesive agent is particularly useful in the topical treatment of gastrointestinal mucosal lesions. Non-limiting examples of the at least one adhesive agent for incorporation into formulations of the present disclosure include alginate, gelatin, collagen, poly(acrylic acid), poly(methacrylic acid), poly(L-lysine), poly(ethyleneimine), poly(ethylene oxide), poly(2-hydroxyethyl methacrylate), P(MAA-g-EG) hydrogel microparticles, lectin-conjugated alginate microparticles, thiolated polymer, natural oligosaccharides gum, drum dried waxy maize starch, Carbopol 974P, chitin, chitosan and derivatives thereof (for example, trimethyl chitosan), sea curve 240, scleroglucan, HE-starch, hydroxyl propyl cellulose, cellulose derivatives, pectin, xanthan gum, polycarbophil, amino dextran, DEAE-dextran, aminocaprylate, hyaluronic acid and/or a hyaluronate salt, polyvinyl acetate (PVA), cellulose derivatives such as cellulose sodium glycolate, methyl cellulose, carboxy methylhydroxyethyl cellulose, hydroxyethyl cellulose, propyl cellulose, hydroxypropyl methylcellulose, ethylcellulose, 3-O-ethylcellulose, hydroxypropyl methylcellulose phthalate, ethyl(hydroxyethyl) cellulose, 6-O-alkylated cellulose, cellulose octanoate sulfate, cellulose lauroate sulfate, cellulose stearate sulfate, and cationic derivatives thereof, 6-O-benzylcellulose, 2,3-di-O-methyl-6-O-benzylcellulose, 2,3-di-O-benzylcellulose, 2,3-di-O-benzyl-6-O-methylcellulose, 2,3,6-tri-O-benzylcellulose, hydroxypropyl methylcellulose acetate succinate, O-2-[2-(2-methoxyethoxy) ethoxy]acetyl cellulose, sodium alginate, starch, dextrin, a polyvinyl alcohol, a (poly) vinyl resin, sodium silicate, poloxamers, and the like. When the adhesive agent is sodium alginate, a compound containing divalent ions, such as $CaCl_2$), is preferably present in the composition. Other mucoadhesive agents include cationic and anionic polymers, as described below.

Cationic polymers may be incorporated into a formulation of the present disclosure, for example, in order to enhance mucoadhesion, to open tight junctions, or both, for example, via ionic interactions with cell membrane(s). Non-limiting examples of suitable cationic polymers include chitin, chitosan and derivatives thereof (for example, trimethyl chitosan).

Anionic polymers may be incorporated into a formulation of the present disclosure, for example, in order to inhibit enzymes, to open tight junctions, or both, for example, via removal of extracellular calcium ions. Non-limiting examples of suitable anionic polymers include polymers of acrylic acid cross-linked with polyalkenyl ethers or divinyl glycol (e.g., Carbopol®) and polyacrylic acid derivatives, including salts, esters and ethers thereof.

Acylcarnities may be incorporated into a formulation of the present disclosure, for example, in order to disrupt membranes and/or open tight junctions via a calcium-independent mechanism. Non-limiting examples of suitable acylcarnitines include lauroyl-L-carnitine chloride and palmitoylcarnitine chloride.

Antioxidants may be incorporated into a formulation of the present disclosure, for example, in order to reduce the viscosity of the mucus layer, which may involve breaking and/or preventing the formation of disulfide bonds. In a non-limiting embodiment, the antioxidant is N-acetylcysteine.

Other excipients that may be incorporated to enhance drug and/or drug formulation stability include antioxidants, reducing agents and preservatives. Non-limiting examples of these agents include those present in some commercial drug products listed in the tables below. The concentration ranges are illustrative and non-limiting.

TABLE 1

Antioxidants and reducing agents and usage in some commercial products

| Excipient | Range | Example |
| --- | --- | --- |
| Ascorbate (sodium/acid) | 0.1-4.8% w/v | Vibramycin ® (Roerig) 4.8% |
| Bisulfite sodium | 0.02-0.66% w/v | Amikin ® (Bristol Myers) 0.66% |
| Butylated hydroxy anisole (BRA) | 0.00028-0.03% w/v | Aquasol ® (Astra) 0.03% |
| Butylated hydroxy toluene (BHT) | 0.00116-0.03% w/v | Aquasol ® (Astra) 0.03% |
| Cystein/Cysteinate, HCl | 0.07-0.10% w/v | Acthar Gel ® (Rhone-Poulanc) 0.1% w/v |
| Dithionite sodium (Na hydrosulfite, Na sulfoxylate) | 0.10% | Nurorphan ® (DuPont) 0.10% |
| Gentisic acid | 0.02% w/v | OctreoScan ® (Mallinckrodt) |
| Gentisic acid ethanolamine | 2% | M.V.I. 12 ® (Astra) 2% |
| Glutamate monosodium | 0.1% w/v | Varivas ® (Merck) 0.1% w/v |
| Formaldehyde sulfoxylate sodium | 0.075-0.5% w/v | Terramycin Solution (Roerig) 0.5% |
| Metabisulfite potassium | 0.10% | Vasoxyl ® (Glaxo-Wellcome) 0.10% |
| Metabisulfite sodium | 0.02-1% w/v | Intropin ® (DuPont) 1% w/v |
| Monothioglycerol (Thioglycerol) | 0.1-1% | Terramycin Solution (Roerig) 1% |
| Propyl gallate | 0.02% | Navane ® (Roerig) |
| Sulfite, sodium | 0.05-0.2% w/v | Enion ® (Ohmeda) 0.2% w/v |
| Thioglycolate, sodium | 0.66% w/v | Sus-Phrine ® (Forest) 0.66% w/v |

TABLE 2

Preservatives and usage in some commercial products

| Excipient | Range | Example |
| --- | --- | --- |
| Benzethonium chloride | 0.01% | Benadryl ® (Parke-Davis) 0.01% w/v |
| Benzyl alcohol | 0.75-5% | Dimenhydrinate ® (Steris) 5% |
| Chlorobutanol | 0.25-0.5% | Codine phosphate (Wyeth-Ayerst) 0.5% |
| m-Cresol | 0.1-0.3% | Humatrope ® (Lilly) 0.30% |
| Myristyl gamma-picolinium | 0.0195-0.169% | Depo-Provera ® (Upjohn) 0.169% w/v |
| Paraben methyl | 0.05-0.18% | Inapsine ® (Janssen) 0.18% w/v |
| Paraben propyl | 0.01-0.1% | Xylocaine w/Epinephrine (Astra) 0.1% w/v |
| Phenol | 0.2-0.5% | Calcimar ® (Rhone Poulanc) 0.5% w/v |
| 2-Phenoxyethanol | 0.50% | Havrix ® (SmithKline Beecham) 0.50% w/v |
| Phenyl mercuric nitrate | 0.001% | Antivenin ® (Wyeth-Ayerst) 0.001% |
| Thimerosal | 0.003-0.01% | Atgam ® (Upjohn) 0.01% |

Solution Formulations
Solutions

In one embodiment, the small molecule drug formulation is provided as a solution. In some aspects, the solution formulation comprises the drug dissolved in one or more solvents, i.e., the drug is fully solubilized in the one or more solvents. Preferably, the one or more solvents is generally regarded as safe (GRAS). Non-limiting examples of solvents suitable for providing the small molecule solution formulation include water (e.g., WFI or a pH-adjusted water), one or more aqueous buffers, polyethylene glycol (PEG) 300-600 (e.g., PEG 300, PEG 400, PEG 500 or PEG 600), ethanol, propylene glycol, glycerin, N-methyl-2-pyrrolidone, dimethylacetamide, dimethylsulfoxide, and combinations of any two or more of the foregoing. In some embodiments, the solution formulation consists of or consists essentially of the drug and the one or more solvents.

Non-limiting examples of aqueous buffers for use as a solution formulation solvent include a phosphate buffer, a phosphate buffered saline (PBS, TBS, TNT, PBT), a histidine buffer, a citrate buffer, a TRIS buffer, a glycine-HCl buffer, a glycine-NaOH buffer, an acetate buffer, a cacodylate buffer, a maleate buffer, a PIPES buffer, a HEPES buffer, an MES buffer, a MOPS buffer, a phosphate-citrate buffer, and a barbital buffer. In some aspects, the pH of the aqueous buffer, and/or the pH of the final solution formulation containing the buffer, ranges from about pH 5.5 to about pH 8.5, or about pH 6 to about pH 8; preferably, the pH ranges from about pH 6.5 to about pH 7.2. In some embodiments, the buffer and/or final solution formulation pH is about 7.

In some embodiments, the solution formulation comprises a co-solvent system, wherein the co-solvent system consists of or consists essentially of a mixture of an organic solvent (such as ethanol) and an aqueous solvent (such as water, water for injection (WFI), a pH-adjusted water, a saline solution (e.g., normal saline), a dextrose solution (e.g., dextrose 5% for injection), or an aqueous buffer, such as phosphate buffer, a phosphate buffered saline (PBS, TBS, TNT, PBT), a histidine buffer, a citrate buffer, a TRIS buffer, a glycine-HCl buffer, a glycine-NaOH buffer, an acetate buffer, a cacodylate buffer, a maleate buffer, a PIPES buffer, a HEPES buffer, an MES buffer, a MOPS buffer, a phosphate-citrate buffer, and a barbital buffer.

In one embodiment, the formulation is an ethanolic solution formulation. In some aspects, the ethanolic solution formulation comprises at least about 50% ethanol, at least about 60% ethanol, at least about 70% ethanol, at least about 75% ethanol, or at least 80% ethanol, wherein the % is (w/w) with respect to the total mass of the solvent(s). In yet further aspects, the ethanolic solution formulation comprises an aqueous medium (e.g., water, water for injection (WFI), a pH-adjusted water, a saline solution (e.g., normal saline), a dextrose solution (e.g., dextrose 5% for injection), or an aqueous buffer (e.g., a phosphate buffer, a phosphate buffered saline (PBS, TBS, TNT, PBT), a histidine buffer, a citrate buffer, a TRIS buffer, a glycine-HCl buffer, a glycine-NaOH buffer, an acetate buffer, a cacodylate buffer, a maleate buffer, a PIPES buffer, a HEPES buffer, an MES buffer, a MOPS buffer, a phosphate-citrate buffer, and a barbital buffer). In some embodiments, the ethanolic solution formulation comprises at most about 20%, about 25%, about 30%, about 40% or about 50% water (e.g., WFI or pH-adjusted water) or aqueous buffer, wherein the % is (w/w) with respect to the total mass of the solvent(s).

Stabilized Solutions

In another embodiment, the small molecule drug formulation is provided as a stabilized solution. In some aspects, the stabilized solution comprises the drug, one or more solvents and a stabilizing agent. The stabilizing agent may facilitate and maintain the dissolution of the drug in the one or more solvents. Non-limiting examples of solvents suitable for providing the stabilized solution formulation include water (e.g., WFI or pH-adjusted water), one or more aqueous buffers, polyethylene glycol 300-600 (e.g., PEG 300, PEG 400, PEG 500 or PEG 600), ethanol, propylene glycol, glycerin, N-methyl-2-pyrrolidone, dimethylacetamide, dimethylsulfoxide, and combinations of two or more of the foregoing.

Non-limiting examples of aqueous buffers for use in a small molecule stabilized solution formulation solvent include a phosphate buffer, a phosphate buffered saline (PBS, TBS, TNT, PBT), a histidine buffer, a citrate buffer, a TRIS buffer, a glycine-HCl buffer, a glycine-NaOH buffer, an acetate buffer, a cacodylate buffer, a maleate buffer, a PIPES buffer, a HEPES buffer, an MES buffer, a MOPS buffer, a phosphate-citrate buffer, and a barbital buffer. In some aspects, the pH of the aqueous buffer, and/or the pH of the final solution formulation containing the buffer, ranges from about pH 5.5 to about pH 8.5, or about pH 6 to about pH 8; preferably, the pH ranges from about pH 6.5 to about pH 7.2. In some embodiments, the buffer and/or final solution formulation pH is about 7.

Non-limiting examples of a stabilizing agent to be combined with the one or more solvents to provide the small molecule drug stabilized solution formulation include surfactants, water-insoluble lipids, organic liquids or semi-solids, cyclodextrins, phospholipids, and combinations of two or more of the foregoing.

In some embodiments, the stabilizing agent is a surfactant. Non-limiting examples of surfactants for incorporation into the stabilized solution formulation include Cremophor EL, Cremophor RH 40, Cremophor RH 60, d-alpha-tocopherol polyethylene glycol 1000 succinate, polysorbate 20, polysorbate 40, polysorbate 60, polysorbate 80, Solutol HS 15, sorbitan monooleate, poloxamer 407, Labrafil M-1944CS, Labrafil M-2125CS, Labrasol, Gellucire 44/14, Softigen 767, mono- and di-fatty acid esters of PEG 300, 400 or 1750; and combinations of two or more of the foregoing.

In some embodiments, the stabilizing agent is a water-insoluble lipid. Non-limiting examples of water-insoluble lipids for incorporation into the stabilized solution formulation include castor oil, corn oil, cottonseed oil, olive oil, peanut oil, peppermint oil, safflower oil, sesame oil, soybean oil, hydrogenated vegetable oils, hydrogenated soybean oil, and medium-chain triglycerides of coconut oil and palm seed oil; and combinations of two or more of the foregoing.

In some embodiments, the stabilizing agent is an organic liquid or semi-solid. Non-limiting examples of an organic liquid or semi-solid for incorporation into the stabilized solution formulation include beeswax, d-alpha-tocopherol, oleic acid, medium-chain mono- and diglycerides; and combinations of two or more of the foregoing.

In some embodiments, the stabilizing agent is a cyclodextrin. Non-limiting examples of a cyclodextrin for incorporation into the stabilized solution formulation include alpha-cyclodextrin, beta-cyclodextrin, hydroxypropyl-beta-cyclodextrin and sulfobutylether-beta-cyclodextrin.

In some embodiments, the stabilizing agent is a phospholipid. Non-limiting examples of a phospholipid for incorporation into the stabilized solution formulation include hydrogenated soy phosphatidylcholine, distearoylphosphatidylglycerol, L-alpha-dimyristoylphosphatidylcholine and L-alpha-dimyristoylphosphatidylglycerol; and combinations of two or more of the foregoing.

In one embodiment, the stabilized solution formulation comprises, consists essentially of or consists of the drug, one or more solvents (such as ethanol), and a water insoluble lipid; optionally, the formulation further comprises a polyol, such as a sugar or sugar alcohol; in some embodiments, the polyol is sucrose, mannitol, sorbitol, trehalose, raffinose, maltose, or a combination thereof.

In another embodiment, the stabilized solution formulation comprises, consists essentially of or consists of the drug, one or more solvents, and an organic liquid or semisolid.

In another embodiment, the stabilized solution formulation comprises, consists essentially of or consists of the drug, one or more solvents, and a cyclodextrinr.

In another embodiment, the stabilized solution formulation comprises, consists essentially of or consists of the drug, one or more solvents, and a phospholipid. In another embodiment, the stabilized solution formulation comprises, consists essentially of or consists of the drug, one or more solvents, and a surfactant.

In one embodiment, the formulation is a stabilized ethanolic solution formulation comprising the drug, ethanol, a stabilizing agent, and optionally, a second solvent. In further aspects of this embodiment, the ethanolic formulation comprises at least about 50% ethanol, at least about 60% ethanol, at least about 70% ethanol, at least about 75% ethanol, at least 80% ethanol, at least about 85% ethanol, or at least about 90% ethanol, wherein the % is (w/w) with respect to the total mass of the solvent(s) or the total mass of the solvent(s) and the stabilizing agent. In yet further aspects, the stabilized ethanolic solution formulation further comprises water (e.g., WFI or a pH-adjusted water) or an aqueous buffer as the second solvent. In some embodiments, the stabilized ethanolic solution formulation comprises at most about 20%, at most about 25%, at most about 30%, at most about 40% or at most about 50% water or aqueous buffer, wherein the % is (w/w) with respect to the total mass of the solvent(s) or the total mass of the solvent(s) and the stabilizing agent. In some embodiments, the stabilized ethanolic solution formulation comprises between about 0.1% and about 50% of the stabilizing agent, wherein the % is (w/w) with respect to the total mass of the solvent(s) and the stabilizing agent. Non-limiting examples of a stabilizing agent suitable for providing the stabilized ethanolic solution formulation include surfactants (e.g., Cremophor EL, Cremophor RH 40, Cremophor RH 60, d-alpha-tocopherol polyethylene glycol 1000 succinate, polysorbate 20, polysorbate 40, polysorbate 60, polysorbate 80, Solutol HS 15, sorbitan monooleate, poloxamer 407, Labrafil M-1944CS, Labrafil M-2125CS, Labrasol, Gellucire 44/14, Softigen 767, mono- and di-fatty acid esters of PEG 300, 400, or 1750), water-insoluble lipids (e.g., castor oil, corn oil, cottonseed oil, olive oil, peanut oil, peppermint oil, safflower oil, sesame oil, soybean oil, hydrogenated vegetable oils, hydrogenated soybean oil, and medium-chain triglycerides of coconut oil, palm seed oil), organic liquids or semi-solids (e.g., beeswax, d-alpha-tocopherol, oleic acid, medium-chain mono- and diglycerides), cyclodextrins (e.g., (alpha-cyclodextrin, beta-cyclodextrin, hydroxypropyl-beta-cyclodextrin, and sulfobutylether-beta-cyclodextrin), phospholipids (e.g., hydrogenated soy phosphatidylcholine, distearoylphosphatidylglycerol, L-alpha-dimyristoylphosphatidylcholine and L-alpha-dimyristoylphosphatidylglycerol), and combinations of two or more of the foregoing.

In another embodiment, the formulation is a stabilized ethanolic solution formulation comprising the drug, ethanol, a stabilizing agent or carrier, and optionally, a second solvent. In further aspects of this embodiment, the ethanolic formulation comprises from 0.1 to 99.9% of the stabilizing agent or carrier, wherein the % is (w/w) with respect to the total mass of the solvent(s) or the total mass of the solvent(s) and the stabilizing agent. In yet further aspects, the stabilized ethanolic solution formulation further comprises water (e.g., WFI or a pH-adjusted water) or an aqueous buffer as the second solvent. Non-limiting examples of a stabilizing agent or carrier suitable for providing the stabilized ethanolic solution formulation include surfactants (e.g., Cremophor EL, Cremophor RH 40, Cremophor RH 60, d-alpha-tocopherol polyethylene glycol 1000 succinate, polysorbate 20, polysorbate 40, polysorbate 60, polysorbate 80, Solutol HS 15, sorbitan monooleate, poloxamer 407, Labrafil M-1944CS, Labrafil M-2125CS, Labrasol, Gellucire 44/14, Softigen 767, mono- and di-fatty acid esters of PEG 300, 400, or 1750), water-insoluble lipids (e.g., castor oil, corn oil, cottonseed oil, olive oil, peanut oil, peppermint oil, safflower oil, sesame oil, soybean oil, hydrogenated vegetable oils, hydrogenated soybean oil, and medium-chain triglycerides of coconut oil, palm seed oil), organic liquids or semi-solids (e.g., beeswax, d-alpha-tocopherol, oleic acid, medium-chain mono- and diglycerides), cyclodextrins (e.g., (alpha-cyclodextrin, beta-cyclodextrin, hydroxypropyl-beta-cyclodextrin, and sulfobutylether-beta-cyclodextrin), phospholipids (e.g., hydrogenated soy phosphatidylcholine, distearoylphosphatidylglycerol, L-alpha-dimyristoylphosphatidylcholine and L-alpha-dimyristoylphosphatidylglycerol), and combinations of two or more of the foregoing.

In a particular embodiment, the formulation comprises, consists essentially of or consists of the drug, ethanol, and a surfactant, such as Labrasol or a a polyoxyethylene hydrogenated castor oil such as Cremophor. In a more particular embodiment, the formulation comprises, consists essentially of or consists of the drug, ethanol, and a polyoxyethylene hydrogenated castor oil (e.g., Cremophor).

In one embodiment, the formulation comprises, consists essentially of or consists of the drug, ethanol and Cremophor. In some embodiments, the drug is tacrolimus. In one such embodiment, the formulation is Prograf® 5 mg/mL Concentrate for Solution for Infusion (Astellas Pharma Ltd.), wherein 1 mL of the Prograf® contains 5 mg tacrolimus, 200 mg of polyoxyethylene hydrogenated castor oil and 638 mg of dehydrated alcohol, and wherein any suitable volume of the Prograf® may be incorporated into the ingestible device (for example, about 0.3 mL or about 0.4 mL). Optionally, each of the foregoing formulations comprising the drug, the ethanol and the Cremophor further comprises a second solvent. Optionally, the second solvent is a PEG (for example, PEG 300 or PEG 400). Alternatively, the second solvent is water (e.g., WFI or a pH-adjusted water) or an aqueous buffer, thereby optionally providing the formulation as a micelle-solubilized formulation.

In another embodiment, the comprises, consists essentially of or consists of the drug and a solvent, such as a PEG (for example, PEG 300 or PEG400), optionally further comprising a stabilizing agent or carrier, and/or a second solvent. In some embodiments, the second solvent is water (e.g., WFI or a pH-adjusted water) or an aqueous buffer. In other embodiments, the second solvent is ethanol. Non-limiting examples of a stabilizing agent or carrier suitable for providing the formulation include surfactants (e.g., Cremophor EL, Cremophor RH 40, Cremophor RH 60, d-alphatocopherol polyethylene glycol 1000 succinate, polysorbate 20, polysorbate 40, polysorbate 60, polysorbate 80, Solutol HS 15, sorbitan monooleate, poloxamer 407, Labrafil M-1944CS, Labrafil M-2125CS, Labrasol, Gellucire 44/14, Softigen 767, mono- and di-fatty acid esters of PEG 300, 400, or 1750), water-insoluble lipids (e.g., castor oil, corn oil, cottonseed oil, olive oil, peanut oil, peppermint oil, safflower oil, sesame oil, soybean oil, hydrogenated vegetable oils, hydrogenated soybean oil, and medium-chain triglycerides of coconut oil, palm seed oil), organic liquids or semi-solids (e.g., beeswax, d-alpha-tocopherol, oleic acid, medium-chain mono- and diglycerides), cyclodextrins (e.g., (alpha-cyclodextrin, beta-cyclodextrin, hydroxypropyl-beta-cyclodextrin, and sulfobutylether-beta-cyclodextrin), phospholipids (e.g., hydrogenated soy phosphatidylcholine, distearoylphosphatidylglycerol, L-alpha-dimyristoylphosphatidylcholine L-alpha-dimyristoylphosphatidylglycerol), and combinations of two or more of the foregoing. In some embodiments, the stabilizing agent is Cremophor. In some embodiments, the drug is tacrolimus.

Solid Formulations

In one embodiment, the small molecule drug formulation is provided as a solid. In some aspects, the solid formulation, upon administration, is released into the GI tract where it is dispersed and distributed locally and or/distal to the site of administration. In some embodiments, the solid drug formulation is dispersed into the mucosa and distributed locally and or/distal to the site of administration. In a non-limiting example, the solid drug formulation is released in the cecum, dispersed into the mucosa, and distributed to the colon. In some embodiments, the solid drug formulation is loaded into an ingestible device for release into the GI tract. In some aspects, upon administration, the solid drug formulation is emulsified in the GI tract via contact with one or more substances present in the local environment, for example, with bile salts present in the GI tract; in further aspects, the emulsification enhances drug distribution to and/or absorption by the surrounding tissues, and/or enhances the stability of the formulation.

In one embodiment, the solid drug formulation comprises, consists of or consists essentially of the drug. In some aspects, the drug is in crystalline form. In other aspects, the drug is in amorphous form. In some embodiments, the drug is provided in as micronized drug particles, a lyophilized powder or in extruded form.

In another embodiment, the solid formulation comprises the drug and one or more excipients. In some aspects, the drug (which may be crystalline or amorphous, micronized or lyophilized) is physically admixed with the one or more excipients. In some embodiments, the one or more excipients is selected from the group consisting of preservatives and anti-oxidants. In some embodiments, the drug is physically admixed with an excipient such as a solvent (for example, PEG) and extruded.

In another embodiment, the solid drug formulation is an enteric-coated formulation.

In another embodiment, the solid drug formulation is not an enteric-coated formulation.

In another embodiment, the solid drug formulation does not contain a pH-dependent drug release matrix.

Dispersion or Suspension Formulations
Dispersion Formulations

In one embodiment, the small molecule drug formulation is provided as a dispersion formulation. Typically, the dispersion formulation comprises at least two phases, a dispersed phase and a dispersion medium or vehicle. In one embodiment, solid drug particles (the dispersed phase) are dispersed in a continuous dispersion vehicle, which is preferably a solution in which the drug is insoluble or poorly soluble, and throughout which the drug particles are distributed.

In some embodiments, the solid drug particles comprise micronized drug particles; advantageously, the micronized drug particles increase dispersion loading. In other embodiments, the solid drug is provided in an extruded form, for example, the drug may be admixed with an excipient (for example, a solvent such as PEG and extruded; advantageously, the extruded drug formulation increases dispersion loading. In other embodiments, the solid drug is provided in a lyophilized form; advantageously, the lyophilized drug formulation increases dispersion loading.

In some aspects, the dispersion formulation is prepared using solvent evaporation techniques, which may increase dispersion loading.

In other embodiments, the drug is a liquid or a semi-solid, and the dispersion formulation comprises the drug in the form of droplets dispersed throughout the dispersion vehicle, which may be a solution phase in which the drug is insoluble or poorly soluble, and throughout which the drug droplets are distributed.

Suspension Formulations

In one embodiment, the formulation is provided as a suspension. In some aspects, the suspension formulation comprises the drug suspended via a suspending agent in an aqueous media, such as an aqueous buffer.

Non-limiting examples of suitable suspending agents include carboxymethyl cellulose (CMC), PEGs (e.g., PEG 100-1000, PEG 3350), hydroxypropyl methylcellulose (HPMC), and combinations thereof. The formulation may further comprise one or more excipients, such as castor oil, modified starch, sorbitol, cellulose, pectin, sucrose, citric acid, poloxamers, tetrasodium edetate (EDTA), PEG(s), cocamide DE, glycerol, Cremophor RH40, dextrose, polyvinyl alcohol, hydroxyethyl cellulose, hydroxypropyl cellulose, propylene glycol, gums (various), propylene glycol alginate, methyl paraben, providone, water, and surfactants (such as polysorbate 20, 40, 60 or 80).

In one example, the suspension formulation comprises the drug solubilized in a lipid, which is further suspended in an aqueous vehicle (e.g., WIFI, a pH-adjusted water, or an aqueous buffer). In another example, the suspension formulation comprises micronized drug substance suspended in an excipient, such as an excipient suitable for solution formulations as disclosed herein. In another example, the suspension formulation comprises micronized drug substance suspended in a solvent, such as a solvent suitable for solution formulations as disclosed herein. In a further example, the suspension formulation comprises drug solubilized in a lipid, which is further suspended in an excipient, such as an excipient suitable for solution formulations as disclosed herein. In another example, the suspension formulation comprises drug solubilized in a lipid, which is further suspended in a solvent, such as a solvent suitable for solution formulations as disclosed herein.

Emulsion Formulations

In one embodiment, the formulation is provided as an emulsion.

Water-In-Oil Emulsions

In some aspects, the emulsion formulation is a water-in-oil emulsion formulation. In further aspects, the water-in-oil emulsion formulation comprises a water-insoluble excipient, a triglyceride and one or more surfactants. Typically, the water-in-oil emulsion will contain two (2) surfactants.

In one embodiment, the emulsion comprises a non-ionic surfactant. In some embodiments, the non-ionic surfactant contains the following functionality or agent: ethoxylated aliphatic alcohol; polyoxyethylene surfactants; carboxylic esters; polyethylene glycol esters; anhydrosorbitol ester and ethoxylated derivatives thereof; glycol esters of fatty acids; amides; monoalkanolamine condensates; polyoxyethylene fatty acid amides.

In one embodiment, the emulsion comprises an amphoteric surfactant. In some embodiments, the amphoteric surfactant contains the following functionality or agent: n-coco 3-aminopropionic acid sodium salt; n-tallow 3-iminodipropionate, disodium salt; n-carboxymethyl n-dimethyl n-9 octadecenyl ammonium hydroxide; n-cocoamidethyl n-hydroxyethylglycine, sodium salt.

In other embodiments, the emulsion is a cationic emulsion, which preferably interacts with negatively charged tissue of the GI tract, thereby facilitating the topical administration of the drug to the GI tissue. In some embodiments, the cationic emulsion comprises one or more excipients comprising one or more of the following functional groups: quaternary ammonium salts; amines with amide linkages; polyoxyethylene alkyl and alicyclic amines; n,n,n',n' tetrakis substituted ethylenediamines; 2-alkyl 1-hydroxethyl 2-imidazolines.

In some embodiments, the emulsion is an anionic emulsion, which preferably interacts with positively charged inflamed tissue at a disease site, thereby facilitating the targeted topical administration of the drug to the disease site. In some embodiments, the anionic emulsion comprises one or more excipients comprising one or more of the following functional groups: carboxylates; sulfonates; petroleum sulfonates; alkylbenzenesulfonates; naphthalenesulfonates; olefin sulfonates; alkyl sulfates; sulfates; sulfated natural oils and fats; sulfated esters; sulfated alkanolamides; alkylphenols, and ethoxylated and sulfated derivatives.

Non-limiting examples of water-insoluble excipients for incorporation into the emulsion formulation include bees wax, oleic acid, soy fatty acids, d-alpha-tocopherol (vitamin E), corn oil monoglycerides, corn oil diglycerides, corn oil triglycerides, medium chain (C8-C10) monoglycerides, medium chain (C8-C10) diglycerides, propylene glycol esters of fatty acids, and combinations of two or more of the foregoing.

Non-limiting examples of triglycerides for incorporation into the emulsion formulation include long-chain triglycerides, such as hydrogenated soybean oil, hydrogenated vegetable oil, corn oil, olive oil, peanut oil, sesame oil; and medium-chain triglycerides, such as caprylic/capric triglycerides, triglycerides derived from coconut oil or palm seed oil; and combinations thereof.

Non-limiting examples of surfactants for incorporation into the emulsion formulation include polysorbate 20 (Tween 20), polysorbate 80 (Tween 80), sorbitanmonolaurate (Span 20), d-alpha-tocopheryl PEG 1000 succinate (TPGS), glycerylmonoolate, polyoxyl 35 castor oil (Cremophor EL), polyoxyl 40 hydrogenated castor oil (Cremophor RH40), polyoxyl 60 hydrogenated castor oil (Cremophor RH60), PEG 300 oleic glycerides (Labrafil® M-1944CS), PEG 300 linoleic glycerides (Labrafil® M-2125CS), PEG 400 caprylic/capric glycerides (Labrasol®), PEG 1500 lauric glycerides (Gelucire® 44/14); and combinations thereof.

Lipid-Based Emulsions

In some embodiments, the formulation is a lipid-based formulation comprising the drug, an aqueous phase (e.g., water, water for injection (WFI), a pH-adjusted water, a saline solution (e.g., normal saline), a dextrose solution (e.g., dextrose 5% for injection), or an aqueous buffer) and an emulsifier. Non-limiting examples of the emulsifiers suitable for use in the lipid-based emulsion formulations are listed in the table below. Optionally, the formulation further comprises a non-aqueous co-solvent; non-limiting examples of the cosolvent include ethanol, propylene glycol, glycerol, and a PEG (e.g, PEG400). Suitable combinations of agents used to formulate the small molecule drug are found in Table 4, which discloses some commercial lipid-based formulations.

TABLE 3

Emulsifiers used in lipid-based formulations

| Low hydrophilic lipophilic balance (HLB) (<10) emulsifier | |
| --- | --- |
| Phosphatidylcholine and phosphatidylcholine/ solvent mixtures | Phosphatidylcholine, phosphatidylcholine in propylene glycol, phosphatidylcholine in medium chain triglycerides, and phosphatidylcholine in safflower oil/ ethanol |
| Unsaturated polyglycolized glycerides | Oleoyl macrogolglycerides, linoleoyl macrogolglycerides |
| Sorbitan esters | Sorbitan monooleate, sorbitan monostearate, sorbitan monolaurate, and sorbitan monopalmitate |
| High HLB (>10) emulsifier | |
| Polyoxyethylene sorbitan esters | Polysorbate 20, polysorbate 40, polysorbate 60, and polysorbate 80 |
| Polyoxyl castor oil derivatives | Polyoxyl 35 castor oil, polyoxyl 40 hydrogenated castor oil |
| Polyoxyethylene polyoxypropylene block copolymer | Poloxamer 188, poloxamer 407 |
| Saturated polyglycolized glycerides | Lauroyl macrogolglycerides, stearoyl macrogolglycerides |
| PEG-8 caprylic/capric glycerides | Caprylocaproyl macrogolglycerides |
| Vitamin E derivative | Tocopherol PEG succinate |

TABLE 4

Some Commercial Lipid formulations

| Drug | Oils: triglycerides or mixed mono and diglycerides | Water-insoluble surfactants (HLB < 12) | Water-soluble surfactants (HLB > 12) | Hydrophilic cosolvent |
| --- | --- | --- | --- | --- |
| Isotretinoin (Accutane ®) Discontinued | Beeswax, hydrogenated soybean oil flakes, hydrogenated vegetable oil, soybean oil | | | |

TABLE 4-continued

Some Commercial Lipid formulations

| Drug | Oils: triglycerides or mixed mono and diglycerides | Water-insoluble surfactants (HLB < 12) | Water-soluble surfactants (HLB > 12) | Hydrophilic cosolvent |
|---|---|---|---|---|
| Cyclosporin A (Sandimmune ®) | Olive oil | | polyoxyethylated oleic glycerides | Ethanol 12.5% |
| Dronabinol (Marinol ®) | Sesame oil | | | |
| Clofazimine (Lamprene ®) 100 mg Discontinued | Beeswax | | | |
| Cyclosporin A (Sandimmune ®) | Corn oil | Linoleic macroglycerides | | Ethanol 12.7% |
| Ranitidine (Zantac ®) Discontinued | Medium chain triglycerides | Mixed glycerides of long chain fatty acids (Gelucire 33/01) | | |
| Cyclosporin A (Neoral ®) | Corn oil mono-di-triglycerides | | Polyoxyl 40 hydrogenated castor oil | Ethanol 11.9%, glycerol, propylene glycol |
| Cyclosporin A (Neoral ®) | Corn oil-mono-di-triglycerides | | Polyoxyl 40 hydrogenated castor oil | Ethanol 11.9%, propylene glycol |
| Tretinoin (Vesanoid ®) Discontinued | Beeswax, hydrogenated soybean oil flakes, hydrogenated vegetable oil, soybean oil | | | |
| Ritonavir (Norvir ®) | | Oleic acid | Polyoxyl 35 castor oil | Ethanol |
| Saquinavir (Fortovase ®) Discontinued | Medium chain mono- and di-glycerides | | | |
| Progesterone (Prometrium ®) | Peanut oil | | | |
| Amprenavir (Agenerase ®) discontinued | | | Vitamin E TPGS | PEG400, propylene glycol |
| Bexarotene (Targretin ®) | | | Polysorbate 20 | PEG400 |
| Doxercalciferol (Hectorol ®) | Coconut oil | | | Alcohol |
| Sirolimus (Rapamune ®) | Phosphatidylcholine, mono- and di-glycerides, soy fatty acids, ascorbyl palmitate | | Polysorbate 80 | 1.5-2.5% ethanol, propylene glycol |
| Cyclosporin A (Gengraf ®) | | | Polysorbate 80, Polyoxyl 35 castor oil | Propylene glycol, alcohol 12.8% v/v |
| Cyclosporin A (Gengraf ®) | | | Polyoxyl 40 hydrogenated castor oil, Polysorbate 80 | Propylene glycol |
| Ritonavir/lopinavir (Kaletra ®) Discontinued | | Oleic acid | Polyoxyl 35 castor oil | Propylene glycol |
| Dutasteride (Avodart ®) | Mono-di-glycerides of caprylic/capric acid | | | |
| Isotretinoin (Claravis ®) | Hydrogenated vegetable oil, soybean oil, white wax | | Polysorbate 80 | |
| Omega-3-acid ethyl esters (Lovaza ®) | Soybean oil | | | |
| Tipranavir (Aptivus ®) | Mono-/di-glycerides of caprylic/capric acids | | Polyoxyl 35 castor oil | Ethanol, propylene glycol |
| Tipranavir | | | Vitamin E | PEG 400, |

TABLE 4-continued

Some Commercial Lipid formulations

| Drug | Oils: triglycerides or mixed mono and diglycerides | Water-insoluble surfactants (HLB < 12) | Water-soluble surfactants (HLB > 12) | Hydrophilic cosolvent |
|---|---|---|---|---|
| (Aptivus ®) | | | TPGS | propylene glycol, water |
| Paricalcitol (Zemplar ®) | Medium chain triglycerides fractionated from coconut oil or palm kernel oil | | | Alcohol |
| Lubiprostone (Amitiza ®) | Medium chain triglycerides | | | |
| Fenofibrate (Lipofen ®) | | | Gelucire 44/14 (lauroyl macrogol glyceride type 1500) | |
| Topotecan HCl (Hycamtin ®) | Hydrogenated vegetable oil | Glyceryl monostearate | | |
| Loratadine (Claritin ®) | Caprylic/capric glycerides | | Polysorbate 80 | |
| Isotretinoin (Absorica ®) | Soybean oil, stearoyl polyoxylglycerides | Sorbitan monooleate | | |
| Enzalutamide (Xtandi ®) | Caprylocaproyl polyoxyglycerides | | | |
| Nintedanib (Ofev ®) | MCTs, hard fat | Lecithin | | |
| Calcifediol (Rayaldee ™) | | Mixture of lipophilic emulsifier with a HLB < 7 and an absorption enhancer with HLB of 13-18 Oily vehicle- mineral oil, liquid paraffins, or squalene | | |

Formulations Containing Tacrolimus

In some embodiments, the small molecule drug formulation contains tacrolimus as the active ingredient. In some aspects, a commercial tacrolimus formulation or a bioequivalent formulation is used for topical administration to the GI tract, or more particularly, to the disease site of the GI tract. Any one of the formulations containing the tacrolimus may be loaded into an ingestible device as disclosed herein; for example, the formulated drug as found in the content of an Astragraf xl capsule may be loaded into an ingestible device of the present disclosure.

TABLE 5

Commercial Tacrolimus Formulations

| Tacrolimus formulation | Formulation | Comments |
|---|---|---|
| Prograf ® 5 mg/mL Concentrate for Solution for Infusion | Ethanol, 80% Cremophor | Micelle solubilized formulation upon dilution in an aqueous media |
| Astragraf xl capsule | ethylcellulose NF, hypromellose USP, magnesium stearate NF | Capsule excluded |
| Protopic ointment | mineral oil, paraffin propylene carbonate, white petrolatum, white wax. | |
| Envarssu XR | hypromellose USP, lactose monohydrate NF, polyethylene glycol NF, poloxamer NF, magnesium stearate NF, tartaric acid NF, butylated hydroxytoluene NF, dimethicone NF. | |

In some embodiments, the tacrolimus is provided in a water-in-oil emulsion formulation comprising medium-chain triglycerides (e.g., caprylic/capric triglycerides) plus one or more surfactants, such as a PEG-based surfactant.

In some embodiments, the formulation comprises, consists essentially of or consists of the tacrolimus, ethanol and Cremophor. In one such embodiment, the formulation is Prograf® 5 mg/mL Concentrate for Solution for Infusion (Astellas Pharma Ltd.), wherein 1 mL of the Prograf® contains 5 mg tacrolimus, 200 mg of polyoxyethylene hydrogenated castor oil and 638 mg of dehydrated alcohol, and wherein any suitable volume of the Prograf® may be incorporated into the ingestible device (for example, about 0.3 mL or about 0.4 mL). Optionally, each of the foregoing formulations comprising the tacrolimus, the ethanol and the Cremophor further comprises water, thereby optionally providing the formulation as a micelle-solubilized formulation.

Formulations Containing Tofacitinib

In some embodiments, the pharmaceutical formulation comprising tofacitinib is tofacitinib in the form of micronized particles, such as particles micronized with PEG.

In some more particular embodiments, the pharmaceutical formulation comprises tofacitinib citrate. More particularly, the pharmaceutical formulation is XELJANZ®.

Thus, in some more particular embodiments, the pharmaceutical formulation comprises tofacitinib citrate and the pharmaceutical formulation comprises microcrystalline cellulose, lactose monohydrate, croscarmellose sodium, magnesium stearate, HPMC 2910/Hypromellose 6 cP, titanium dioxide, macrogol/PEG3350, and triacetin.

In other embodiments, the pharmaceutical formulation is provided as a dispersion or a suspension comprising the tofacitinib in a suspending agent, wherein the suspending agent is optionally carboxymethyl cellulose (CMC), one or more PEGs (e.g., PEG 100 to 1000, PEG 3350), hydroxypropyl methylcellulose (HPMC), or a combination thereof. Optionally, the formulation further comprises one or more excipients selected from the group consisting of castor oil, modified starch, sorbitol, cellulose, pectin, sucrose, citric acid, poloxamers, EDTA, cocamide DE, glycerol, Cremophor RH40, dextrose, polyvinyl alcohol, hydroxyethyl cellulose, hydroxypropyl cellulose, propylene glycol, a gum, propylene glycol alginate, methyl paraben, providone, water, and a surfactant, which is optionally polysorbate 20, 40, 60 or 80. Optionally, the tofacitinib is provided as a micronized solid dispersed or suspended in the suspending agent and the one or more optional excipients. Preferably, the pharmaceutical formulation contains the tofacitinib at a concentration of at least about 5 mg/mL or 5 mg/g, at least about 10 mg/mL or 10 mg/g; optionally, at least about 15 mg/mL or 15 mg/g. In some embodiments, the tofacitinib is tofacitinib citrate.

In other embodiments, the formulation is provided as a solid, and the tofacitinib is present in the pharmaceutical formulation at a concentration of at least about 75% (w/w), about 80% (w/w), about 85% (w/w), or at least about 90% (w/w); optionally, at least about 95%, about 96%, about 97%, about 98% or about 99% (w/w). In some embodiments, the tofacitinib is tofacitinib citrate.

Formulations for Delivery of Antibodies and Other Therapeutic Proteins

Agents such as antibodies and other therapeutic proteins can be delivered using the devices and methods described herein, including an ingestible device as disclosed herein. The antibodies or other therapeutic proteins can be incorporated into pharmaceutical formulations, which may be loaded into a device for release and delivery to a subject, or more particularly, for topical delivery of the formulation and/or antibody or therapeutic protein to the gastrointestinal tract of a subject. The formulations can be liquid, semi-solid, or solid formulations, and typically comprise the agent and a physiologically acceptable carrier. Exemplary carriers include water, saline, phosphate buffered saline, dextrose, glycerol, ethanol and the like. Polyamines or polyols, including sugars and polyalcohols (e.g., mannitol or sorbitol), may be incorporated into the present formulations, for example, for use as stabilizing agents, e.g., to preserve the biological activity of an antibody or other therapeutic protein under various stress conditions. Formulations can include other substances, such as wetting or emulsifying agents, preservatives, buffers, and/or mucoadhesive agents, which can enhance the shelf life and/or effectiveness of the agent. Formulations that are particularly useful for the methods and compositions described herein are described in detail below. Some formulations disclosed herein, which may be commercially or otherwise available for IV or subcutaneous delivery, and which may be available in pre-loaded syringes or pens, may alternatively be incorporated or loaded into a device, such as an ingestible device, as disclosed herein, for release and topical delivery of the formulation and/or antibody or therapeutic protein to the gastrointestinal tract of a subject.

General Description of Formulations and Ingredients

An antibody or other therapeutic protein can be formulated in a solution (e.g., aqueous formulation), dry formulation (e.g., lyophilized solid formulation), microemulsion, nanoemulsion, solid composition, semi-solid composition, dispersion, liposome, or a particulate composition containing a micro- or nanoencapsulated antibody or other therapeutic protein. In some embodiments, the formulation can be suitable for high antibody concentration (e.g., about 150 mg/mL and greater). Solutions can be prepared, e.g., by incorporating an antibody in the required amount in an appropriate solvent with at least one, or a combination of, ingredients described above. Generally, dispersions can be prepared by incorporating an antibody into a vehicle that contains a basic dispersion medium and the required other ingredients from those described above. In some embodiments, proper fluidity of a solution may be maintained, for example, using a coating such as lecithin, by the maintenance of the required particle size in the case of dispersion, and by the use of surfactants. Prolonged absorption of compositions can be brought about by including in the composition an agent that delays absorption, for example, monostearate salts and/or gelatin. In some embodiments, formulations containing an antibody or therapeutic protein further comprises one or more additional excipients to enhance performance, such as GI penetration/absorption and/or stability. Excipients that may be incorporated to enhance absorption by the GI tract and/or at the disease site within the GI tract include bile salts, chelators, surfactants, anti-oxidants, fatty acids and derivatives thereof, cationic polymers, anionic polymers, and acylcarnitines, such as lauroyl-L-carnitine chloride or palmitoylcarnitine chloride.

Polyols

In some embodiments, the present disclosure provides a formulation comprising a polyol. As used herein, the term "polyol" refers an excipient with multiple hydroxyl groups, and includes sugars (e.g., reducing and nonreducing sugars), sugar alcohols and sugar acids. Preferably, the polyol is a small molecule. A "reducing sugar" is one which contains a hemiacetal group that can reduce metal ions or react covalently with lysine and other amino groups in proteins. A "nonreducing sugar" is one which does not have these properties of a reducing sugar. Polyols that are suitable for use in formulations of the present application include, for example, polyols selected from the group consisting of mannitol, sucrose, trehalose, sorbitol, erythritol, isomalt, lactitol, maltitol, maltose, xylitol, raffinose, stachyose, melezitose, dextran, palatinit, glycerol, lactitol, propylene glycol, polyethylene glycol, inositol, and mixtures thereof.

In some embodiments, the present disclosure provides a composition comprising an antibody and a polyol, which may be a sugar (e.g., a non-reducing sugar). In one example, these excipients increase stability of an antibody or another therapeutic protein in the formulation that is susceptible to deamidation, oxidation, isomerization and/or aggregation. Hence, inclusion of a sugar in the formulation improves stability, reduces aggregate formation, and retards degradation of the therapeutic protein therein. Suitable examples of polyols include mannitol, sorbitol, sucrose, trehalose, raffinose, maltose, and a combination thereof.

A molar ratio of the polyol to the antibody or other therapeutic protein can be, e.g., at least about 600:1; about 625:1; about 650:1; about 675:1; about 700:1; about 750:1, about 800:1, about 1000:1, about 1200:1, about 1400:1, about 1500:1, about 1600:1, about 1700:1, about 1800:1, about 1900:1, or about 2000:1. In some embodiments, sucrose, mannitol, sorbitol, trehalose, or any combination thereof, is the non-reducing sugar for use in an antibody formulation (solid or liquid). In some embodiments, the molar ratio of the non-reducing sugar to the antibody (mole:mole) is at least about 600:1.

Amino Acids

In some embodiments, a formulation can include any desired free amino acid, a salt thereof, or a combination thereof, which can be in the L-form, the D-form or any desired mixture of these forms. Free amino acids that can be included in the formulation include, for example, any one of the 20 essential amino acids, or more particular amino acids, such as histidine, alanine, arginine, glycine, glutamic acid, serine, lysine, tryptophan, valine, cysteine, methionine, and any combination thereof. The amino acids can stabilize an antibody against degradation during manufacturing, drying, lyophilization and/or storage, e.g., through hydrogen bonds, salt bridges antioxidant properties or hydrophobic interactions or by exclusion from the protein surface. Amino acids can act as tonicity modifiers or can act to decrease viscosity of the formulation. Free amino acids, such as histidine and arginine, can act as cryoprotectants and lyoprotectants, and do not crystallize when lyophilized as components of the formulation.

Free amino acids, such as glutamic acid and histidine, alone or in combination, can act as buffering agents in an aqueous formulation in the pH range of about 5 to about 7.5, or about 4.7 to about 5.7. In some embodiments, when a combination of amino acids, such as histidine and arginine, is used in a formulation, the molar ratio of total amino acid amount to antibody ratio can be at least about 200:1, about 200:1 to about 500:1, or at least about 400:1. In some embodiments, the free amino acid in the formulation is histidine, alanine, arginine, glycine, glutamic acid, or any combination thereof. The molar ratio of free amino acid to antibody may be at least about 200:1, about 250:1, about 300:1, about 400:1, or about 500:1.

Surfactants

In some embodiments, a formulation may contain a surfactant. When present, the surfactant is generally included in an amount which reduces formation of insoluble aggregates of an antibody, e.g., during bottling, freezing, drying, lyophilization and/or reconstitution. A "surfactant" herein refers to an agent that lowers surface tension of a liquid. The surfactant can be a nonionic surfactant. Non-limiting examples of useful surfactants include polysorbate (polyoxyethylene sorbitan monolaurate, for example, polysorbate 20, polysorbate 40, polysorbate 60, and polysorbate 80); TRITON (t-octylphenoxypolyethoxyethanol, nonionic detergent); sodium dodecyl sulfate (SDS); sodium laurel sulfate; sodium octyl glycoside; lauryl-, myristyl-, linoleyl-, or stearyl-sulfobetaine; lauryl-, myristyl-, linoleyl- or stearylsarcosine; linoleyl-, myristyl-, or cetyl-betaine; lauroamidopropyl-, cocamidopropyl-, linoleamidopropyl-, myristamidopropyl-, palmidopropyl-, or isostearamidopropylbetaine (e.g. lauroamidopropyl); myristamidopropyl-, palmidopropyl-, or isostearamidopropyl-dimethylamine; sodium methyl cocoyl-, or disodium methyl oleyl-taurate; sorbitan monopalmitate; and the MONAQUAT series; polyethyl glycol (PEG), polypropylene glycol (PPG), and copolymers of poloxyethylene and poloxypropylene glycol (e.g., pluronics/poloxamer, PF68 etc); etc. In some embodiments, the surfactant is polysorbate 80. In some embodiments, the surfactant:antibody molar ratio is about 1:1.

Bile Salts

In some embodiments, the formulation comprises at least one bile salt. When present, the one or more bile salts is generally included in an amount enhances absorption of the formulation and/or antibody by the GI tract and/or at the disease site within the GI tract include. Non-limiting examples of bile salts for incorporation into a formulation of the present disclosure include sodium deoxycholate, sodium taurocholate, sodium glycodeoxycholate, sodium taurodihydrofusidate, sodium glycodihydrofudisate.

Mucoadhesive Agents

In some embodiments, the formulation comprises at least one adhesive agent, such as a mucoadhesive agent, wherein the adhesive agent is optionally a thermoreversible adhesive agent. In some embodiments, the formulation is particularly useful in the topical treatment of gastrointestinal mucosal lesions. Non-limiting examples of the at least one adhesive agent for incorporation into formulations of the present disclosure include alginate, gelatin, collagen, poly(acrylic acid), poly(methacrylic acid), poly(L-lysine), poly(ethyleneimine), poly(ethylene oxide), poly(2-hydroxyethyl methacrylate), P(MAA-g-EG) hydrogel microparticles, lectin-conjugated alginate microparticles, thiolated polymer, natural oligosaccharides gum, drum dried waxy maize starch, Carbopol 974P, chitin, chitosan and derivatives thereof (for example, trimethyl chitosan), sea curve 240, scleroglucan, HE-starch, hydroxyl propyl cellulose, cellulose derivatives, pectin, xanthan gum, polycarbophil, amino dextran, DEAE-dextran, aminocaprylate, hyaluronic acid and/or a hyaluronate salt, polyvinyl acetate (PVA), cellulose derivatives such as cellulose sodium glycolate, methyl cellulose, carboxy methylhydroxyethyl cellulose, hydroxyethyl cellulose, propyl cellulose, hydroxypropyl methylcellulose, ethylcellulose, 3-O-ethylcellulose, hydroxypropyl methylcellulose phthalate, ethyl(hydroxyethyl) cellulose, 6-O-alkylated cellulose, cellulose octanoate sulfate, cellulose lauroate sulfate, cellulose stearate sulfate, and cationic derivatives thereof, 6-O-benzylcellulose, 2,3-di-O-methyl-6-O-benzylcellulose, 2,3-di-O-benzylcellulose, 2,3-di-O-benzyl-6-O-methylcellulose, 2,3,6-tri-O-benzylcellulose, hydroxypropyl methylcellulose acetate succinate, O-2-[2-(2-methoxyethoxy) ethoxy]acetyl cellulose, sodium alginate, starch, dextrin, a polyvinyl alcohol, a (poly) vinyl resin, sodium silicate, poloxamers, and the like. When the adhesive agent is sodium alginate, a compound containing divalent ions, such as CaCl2, is preferably present in the composition.

In some embodiments, the mucoadhesive agent is a cationic polymer. When present, the cationic polymer is generally included in an amount which enhances mucoadhesion, opens tight junctions between cells, or both, for example, via ionic interactions with cell membrane(s). Non-limiting examples of suitable cationic polymers include chitin, chitosan and derivatives thereof (for example, trimethyl chitosan).

In some embodiments, the mucoadhesive agent is an anionic polymer. When present, the anionic polymer is generally included in an amount which enhances mucoadhesion, opens tight junctions between cells, or both. Non-limiting examples of suitable anionic polymers include polymers of acrylic acid cross-linked with polyalkenyl ethers or divinyl glycol (e.g., Carbopol®), polyacrylic acid derivatives, including salts, esters and ethers thereof, atInd hyaluronic acid, including salts thereof.

In some embodiments, the formulation comprises the antibody and one or more adhesive agents, such as a poloxamer, a hyaluronic acid and/or hyaluronate salt, or a combination thereof.

In some more particular embodiments, the one or more adhesive agents includes a thermoreversible adhesive agent, and the formulation comprising the thermoreversible adhesive agent may be a thermoreversible formulation, essentially as described in WO 2018/019881, which is hereby incorporated by reference in its entirety. Accordingly, in some embodiments, a formulation of the present disclosure comprises the antibody, a hyaluronic acid or a salt thereof and two thermoreversible adhesive agents, wherein one of the two thermoreversible agents is a poloxamer, and wherein the poloxamer and the hyaluronic acid or salt thereof are present in a specific ratio. In some embodiments, the weight ratio between the poloxamer and the hyaluronic acid or its salt is from 60:1 to 10:1. In more particular embodiments, the weight ratio between the poloxamer and the hyaluronic acid or its salt is from 60:1 to 20:1, more particularly from 50:1 to 30:1, more particularly is from 45:1 to 35:1, and even more particularly about 40:1. In some more particular embodiments, the weight ratio between the poloxamer and the second thermoreversible adhesive agent is from about 4:1 to about 25:1, more particularly from about 8:1 to about 12:1, more particularly still from about 9:1 to about 11:1, even more particularly the ratio is 10:1. In some embodiments, the formulation comprises, consists essentially of or consists of the antibody, the hyaluronic acid or salt thereof, and the one or more mucoadhesive agents, wherein one of the two thermoreversible agents is a poloxamer. In other embodiments, the formulation comprises, consists essentially of or consists of the antibody, the hyaluronic acid or salt thereof, the one or more mucoadhesive agents, wherein one of the two thermoreversible agents is a poloxamer, and an aqueous medium, such as water, a pH-adjusted water or an aqueous buffer. In some more particular embodiments, the hyaluronic acid or salt thereof is present in an amount ranging from about 0.1 to about 2% (w/w), about 0.25 to about 1.5%, about 0.3 to about 0.8% (w/w), or more particularly about 0.4% (w/w) with respect to the total weight of all formulation excipients (including the aqueous medium), or with respect to the total mass of the formulation, including the antibody. In some further embodiments, the formulation comprises from about 10 to about 25% (w/w) of two thermoreversible adhesive agents, with respect to the total weight of all formulation excipients (including the aqueous medium), or with respect to the total mass of the formulation, including the antibody; wherein one of the thermoreversible adhesive agents is a poloxamer.

In some embodiments, the formulation comprises the antibody and one or more thermoreversible adhesive agents, such as a poloxamer, and does not contain a hyaluronic acid or salt thereof.

In some embodiments, the antibody is a monoclonal antibody; optionally, the monoclonal antibody is selected from the group consisting of adalimumab, vedolizumab, infliximab, etrolizumab, golimumab, certolizumab, certolizumab pegol, ustekinumab, risankizumab, etanercept, brazikumab, natalizumab, PF-00547659, guselkumab, mirikizumab, or any antigen-binding fragment thereof, glycosylation variant thereof, or biosimilar thereof.

The term "adhesion" as used herein refers to the ability of the formulations of the disclosure to bind to the site of topical administration, e.g. mucoses, (e.g., a mucosal lining of the gastrointestinal tract of a subject) upon contact, whereby when they are brought into contact work must be done in order to separate them. The adhesion can be measured by a texture analyzer, e.g., TA.XT Plus (Texture Technologies). For example, a 40-mm diameter disk can be compressed into the gel and redrawn. The method settings, including speed rate at 1 mm/second and distance (depth of the insertion) of 9-mm can be assessed at the desired temperature, e.g. at 22° C., 25° C. or at 37° C. The adhesion is measured in mN/s units. The more negative the value in mN/s, the more adhesive the composition will be. Thus, for example a composition showing a measurement value of −100 mN/s is more adhesive than a composition showing a lower measurement value of e.g., −50 mN/s.

As used herein, the term "thermoreversible" or equivalent expressions thereof such as "thermally reversible" applied to the composition means that it exhibits reverse thermogellation, i.e., it undergoes a change in viscosity when the temperature varies. In some embodiments, the composition is liquid at room temperature and forms a gel at body temperature. The liquid state at room temperature facilitates the administration of the composition when it is to be administered e.g. to the gastrointestinal mucosa, by using an appropriate delivery device, such as for example an ingestible device as disclosed herein. When the composition is released from the device and comes into contact with the mucosa at body temperature, its viscosity increases to a higher viscosity state, hence acquiring the consistency of a gel. This has the advantage that the composition remains on the surface of the affected area.

Other Excipients

Metal chelators may be a useful component to a formulation. Suitable metal chelators include, for example, methylamine, ethylenediamine, desferoxamine, trientine, histidine, malate, succinate, phosphonate compounds, e.g., etidronic acid, succinic acid, citric acid, salicylates, ethylenediaminetetraacetic acid (EDTA), ethyleneglycoltetraacetic acid (EGTA), and the like.

Formulations may include an anti-oxidant. Suitable anti-oxidants include, for example, citric acid, uric acid, ascorbic acid, lipoic acid, glutathione, methionine, tocopherol, carotene, lycopene, cysteine and the like.

A preservative may be a useful addition to a formulation. Suitable examples of preservatives include benzyl alcohol, phenol, m-cresol, chlorobutanol and benzethonium Cl.

In some embodiments, a formulation can include an antibody and at least one amphiphilic polysaccharide. Suitable examples of amphiphilic polysaccharides are described, for example, in US 2011/0014189, the disclosure of which is incorporated herein by reference in its entirety.

In some embodiments, a formulation can include an antibody and at least one alkylglycoside. Alkylglycoside may have a critical micelle concentration (CMC) of less than about 1 mM. Presence of an alkylglycoside may reduce aggregation and immunogenicity of the antibody in the formulation. Suitable examples of alkylglycosides include dodecyl maltoside, tridecyl maltoside, tetradecyl maltoside, sucrose mono-dodecanoate, sucrose mono-tridecanoate, and sucrose mono-tetradecanoate. Examples of formulations containing an alkylglycoside are described, for example, in U.S. Pat. No. 8,226,949, which is incorporated herein by reference in its entirety.

A formulation may include N-methyl pyrrolidone (NMP). Concentration of N-methyl pyrrolidone may be, for example, from about 1 mM to about 1000 mM. N-methyl pyrrolidone provides reduced viscosity of the formulation. Exemplary concentrations of NMP include about 50 mM, about 60 mM, about 70 mM, about 80 mM, about 90 mM, about 100 mM, about 110 mM, about 120 mM, about 130 mM, about 140 mM, about 150 mM, about 160 mM, about 170 mM, about 180 mM, about 190 mM, about 200 mM, about 250 mM, about 275 mM, about 300 mM, about 325 mM, about 350 mM, about 375 mM, about 400 mM, about 425 mM, about 450 mM, about 475 mM, about 500 mM, about 525 mM, about 550 mM, about 575 mM, about 600 mM, about 625 mM, about 650 mM, about 675 mM, or about 700 mM. Ranges of amounts of NMP include, but are not limited to, about 50 mM to about 600 mM, about 50 mM to about 150 mM, about 50 mM to about 200 mM, and about 370-600 mM. Additional examples of NMP formulations are disclosed, for example, in WO 2018/067987, which is incorporated herein by reference in its entirety.

Effective Dose

In some embodiments, a formulation can include a dose of about 30-90 mg, about 70-90 mg, about 30-110 mg, about 70-110 mg, about 150-450 mg, or about 300-1200 mg of an antibody, an antigen-binding portion or a biosimilar thereof, or other therapeutic protein. In some embodiments, an effective dose of an antibody, or an antigen-binding portion or a biosimilar thereof, or other therapeutic protein, in a formulation is about 30 mg, about 40 mg, about 50 mg, about 60 mg, about 70 mg, about 80 mg, about 90 mg, about 100 mg, about 125 mg, about 150 mg, about 160 mg, about 175 mg, about 200 mg, about 300 mg, about 400 mg, about 450 mg, about 500 mg, about 600 mg, about 750 mg, about 1000 mg, or about 1200 mg. In some embodiments, the dose is an induction dose. In other embodiments, the dose is a maintenance dose.

Exemplary Antibodies for Formulations

A formulation described herein may include any antibody or fragment thereof, or other therapeutic protein (e.g., a recombinant protein, therapeutic enzyme, etc.). Antibodies can be of any type, e.g., a human, humanized, chimeric, or murine antibody (e.g., a human IgG1 kappa antibody). For example, a formulation described herein may include an anti-TNF-alpha antibody. Exemplary antibodies useful for inclusion in a formulation described herein include adalimumab, vedolizumab, infliximab, etrolizumab, golimumab, certolizumb pegol, ustekinumab, risankizumab, etanercept, brazikumab, natalizumab, PF-00547659, guselkumab, mirikizumab, or any antigen-binding fragment thereof, glycosylation variant thereof, or biosimilar thereof. In some embodiments, a formulation includes an antibody, or antigen-binding fragment thereof, selected from the group consisting of: adalimumab, vedolimumab, golimumab, certolizumb pegol, and ustekinumab, any antigen binding fragment thereof or a biosimilar thereof. Additional pharmaceutical formulations of antibodies potentially useful in the presently described compositions and methods are disclosed in US publication Nos. 2012/0282249, US 2009/0291062; U.S. Pat. Nos. 8,420,081 and 8,883,146; and PCT Publication No. WO 02/072636, the disclosures of which are incorporated herein by reference in their entireties.

Antibodies in Crystalline Form

In some embodiments, an antibody or other therapeutic protein is crystalline. Advantages afforded by crystalline protein particles include their dense packing, allowing high drug loading; reduced surface area, which reducing interactions with solvent and polymeric scaffolds and thus may show improved stability over amorphous formulations; potential for controlled/sustained release, which may be attributable to delayed dissolution of crystals even absent polymeric encapsulation (Puhl et al, "Recent Advances in Crystalline and Amorphous Particulate Protein Formulations for Controlled Delivery"; Asian J. Pharm. Sci. II (2016), pp. 469-477; the entire contents of which is hereby incorporated by reference in its entirety). In some embodiments, antibody crystals are prepared by batch crystallization. Suitable methods for batch crystallization of antibodies and crystals obtained by those methods include those described in, e.g., U.S. Pat. Nos. 8,034,906 and 8,436,149; and US patent application publication No. 2010/0034823, the disclosure of which is incorporated herein by reference in its entirety; examples of needle morphology of the antibody crystals include needles with a maximum length l of about 2-500 μm or about 100-300 μm and an l/d ratio of about 3 to 30. In a more particular embodiment, the antibody is adalimumab or a biosimilar thereof. Other suitable methods for antibody batch crystallization is disclosed in Yang et al., Crystalline monoclonal antibodies for subcutaneous delivery, PNAS, 100 (12), 2003, 6934-6939, the disclosure of which is incorporated herein by reference in its entirety.

Exemplary Formulations

In many embodiments, a formulation, at a bare minimum, comprises an antibody and a polyol. In one example, the polyol in the formulation is selected from: sucrose, mannitol, sorbitol, trehalose, raffinose, maltose, and any combination thereof. In another example, the polyol in the formulation is sucrose. In yet another example, the polyol in the formulation is mannitol. In yet another example, the polyol in the formulation is sorbitol.

In many embodiments, a formulation, at a bare minimum, comprises an antibody and a surfactant. In one example, the surfactant in the formulation is non-ionic. In one example, the non-ionic surfactant is a polysorbate. The polysorbate is typically selected from polysorbate 80, polysorbate 60, polysorbate 40, and polysorbate 20. In another example, the non-ionic surfactant is a poloxamer such as poloxamer 188.

In many embodiments, a formulation, at a bare minimum, comprises an antibody and at least one amino acid (e.g., one, two, or three amino acids). In one example, the amino acid in the formulation is selected from arginine, histidine, alanine, glycine, glutamic acid, and methionine. In another example, the formulation comprises L-arginine hydrochloride. In yet another example, the formulation comprises arginine and histidine (e.g., L-arginine and L-histidine). In yet another example, the formulation comprises L-histidine and L-histidine monohydrochloride monohydrate. In yet another example, the formulation comprises L-histidine, L-histidine monohydrochloride monohydrate, and L-methionine. In yet another example, the formulation comprises L-histidine, L-histidine monohydrochloride monohydrate, and L-arginine.

In many embodiments, a formulation, at a bare minimum, comprises an antibody and sodium chloride.

In many embodiments, a formulation, at a bare minimum, comprises an antibody and a buffer. In some embodiments, the buffer comprises a phosphate. In one example, the phosphate is selected from: monobasic sodium phosphate, dibasic sodium phosphate, sodium phosphate monobasic monohydrate, sodium phosphate dibasic heptahydrate, sodium phosphate monobasic dihydrate, and sodium phosphate dibasic dihydrate. In some embodiments, the buffer comprises a citrate. In one example, the citrate is selected from: sodium citrate and citric acid monohydrate. In some embodiments, the buffer comprises an acetate. In one example, the acetate is sodium acetate trihydrate. In some embodiments, a formulation, at a bare minimum, comprises an antibody and a buffer which is not phosphate or citrate. In one example, an amount of phosphate or citrate in the formulation is negligible or non-detectable.

In many embodiments, a formulation, at a bare minimum, comprises an antibody, a polyol, and a surfactant. In other embodiments, a formulation, at a bare minimum, comprises an antibody, a polyol, a surfactant, and at least one amino acid. In yet other embodiments, the formulation, at a bare minimum, comprises an antibody, a polyol, a surfactant, and a buffer. In yet other embodiments, a formulation, at a bare minimum, comprises an antibody, a polyol, a surfactant, at least one amino acid, and a buffer.

In some embodiments, a formulation, at a bare minimum, comprises an antibody, sodium chloride, a phosphate buffer (for example, containing sodium phosphate monobasic monohydrate, sodium phosphate dibasic heptahydrate), and polysorbate 80. In one example, the formulation is liquid and comprises water for injection. In some embodiments, the formulation consists of or consists essentially of the foregoing components.

In some embodiments, a formulation, at a bare minimum, comprises an antibody, a buffer, which is optionally a phosphate and/or citrate buffer, and an excipient selected from a polyol (such as a sugar or sugar alcohol) and a non-ionic surfactant, such as a polysorbate. In one example, the formulation is liquid and contains water for injection. In another example, the formulation contains low level of ionic excipients and low conductivity. In some embodiments, the formulation consists of or consists essentially of the foregoing components.

In some embodiments, a formulation, at a bare minimum, comprises an antibody, sodium chloride, a phosphate buffer (for example, containing sodium phosphate monobasic dihydrate, sodium phosphate dibasic dihydrate, or a combination thereof), L-arginine hydrochloride, and sucrose. In one example, the formulation is liquid and contains water for injection. In some embodiments, the formulation consists of or consists essentially of the foregoing components.

In some embodiments, a formulation, at a bare minimum, comprises an antibody, sodium chloride, a phosphate buffer (for example, containing sodium phosphate monobasic dihydrate, sodium phosphate dibasic dihydrate, or a combination thereof), a citrate buffer (for example, containing sodium citrate, citric acid monohydrate, or a combination thereof), mannitol, and polysorbate 80. In one example, the formulation is liquid and contains water for injection. In another example, pH of the liquid formulation is adjusted with NaOH to about 5.2. In some embodiments, the formulation consists of or consists essentially of the foregoing components.

In some embodiments, a formulation, at a bare minimum, comprises an antibody, a buffer, which is optionally a phosphate and/or citrate buffer, a polyol selected from: mannitol, sorbitol, sucrose, trehalose, raffinose, maltose; and a combination thereof, and a non-ionic surfactant selected from polysorbate 20, polysorbate 40, polysorbate 60, and polysorbate 80. In one example, the formulation contains low level of ionic excipients and low conductivity. In another example, concentration of the antibody in the formulation is high, e.g., at least about 10 mg/mL, about 50 mg/mL, about 100 mg/mL, about 150 mg/mL, about 200 mg/mL, or about 250 mg/mL. In some embodiments, the formulation consists of or consists essentially of the foregoing components.

In some embodiments, a formulation, at a bare minimum, comprises an antibody, a phosphate buffer (for example, containing monobasic sodium phosphate and dibasic sodium phosphate), sucrose, and polysorbate 80.

In some embodiments, a formulation, at a bare minimum, comprises an antibody, arginine, histidine, or a combination thereof, sucrose, and polysorbate 80. Optionally, the formulation further comprises a buffer. In one example, the formulation is a lyophilized powder. In some embodiments, the formulation consists of or consists essentially of the foregoing components.

In some embodiments, a formulation, at a bare minimum, comprises an antibody, a free amino acid selected from histidine, alanine, arginine, glycine, and glutamic acid, a polyol selected from mannitol, sorbitol, sucrose, trehalose, and a combination thereof, and a surfactant. Optionally, the formulation further comprises a buffer. In one example, the formulation is liquid. In another example, the formulation is solid (e.g., lyophilized powder for reconstitution). In some embodiments, the formulation consists of or consists essentially of the foregoing components.

In some embodiments, a formulation, at a bare minimum, comprises an antibody, an acetate salt, such as sodium acetate trihydrate, an amino acid which is histidine and/or a salt thereof, sorbitol, and a non-ionic surfactant such as polysorbate 80; optionally, the formulation further comprises arginine and/or a salt thereof. In one example, the formulation is liquid and comprises water for injection. In another example, pH of the liquid formulation is from about 5.1 to about 5.3. In yet another example, the formulation contains negligible or non-detectable amount of sodium chloride. In yet another example, the formulation does not contain phosphate or citrate. In some embodiments, the formulation consists of or consists essentially of the foregoing components.

In some embodiments, a formulation, at a bare minimum, comprises an antibody, an amino acid selected from L-histidine and/or a salt thereof (for example, wherein the L-histidine salt is L-histidine monohydrochloride monohydrate), and a combination thereof, sorbitol and polysorbate 80. In one example, the formulation is liquid and comprises water for injection. In some embodiments, the formulation consists of or consists essentially of the foregoing components.

In some embodiments, a formulation, at a bare minimum, comprises an antibody, an amino acid selected from L-histidine, a L-histidine salt (for example, L-histidine monohydrochloride monohydrate), L-methionine, and a combination thereof, sucrose, and polysorbate 80. In one example, the formulation also contains a metal chelating agent such as EDTA disodium salt dihydrate. In another example, the formulation is liquid and contains water for injection. In some embodiments, the formulation consists of or consists essentially of the foregoing components.

In some embodiments, a formulation, at a bare minimum, comprises an antibody, an amino acid selected from L-histidine, a L-histidine salt (for example, L-histidine monohydrochloride monohydrate), a L-arginine salt (for example, L-arginine hydrochloride), and a combination thereof, sucrose, and polysorbate 80. In some embodiments, the formulation consists of or consists essentially of the foregoing components.

In some embodiments, a formulation, at a bare minimum, comprises an antibody, an amino acid selected from L-histidine and L-arginine, and a combination thereof, polysorbate 20, and succinic acid. In some embodiments, the formulation consists of or consists essentially of the foregoing components.

In some embodiments, a formulation, at a bare minimum, comprises an antibody at a concentration of at least about 100 mg/mL, mannitol, and polysorbate 80. In one example, the formulation in liquid and contains water for injection. In some embodiments, the formulation consists of or consists essentially of the foregoing components.

In some embodiments, a formulation, at a bare minimum, comprises an antibody, a polyol such as mannitol, and a surfactant selected from a polysorbate (e.g., polysorbate 20 or 80) and a poloxamer (for example, poloxamer 188); and wherein the formulation contains negligible or non-detectable amount of salt, and negligible or non-detectable amount of buffer. In one example, the formulation has antibody concentration of least about 50 mg/mL, about 75 mg/mL, or about 100 mg/mL or greater, and has low conductivity. In some embodiments, the formulation consists of or consists essentially of the foregoing components.

In some embodiments, a formulation, at a bare minimum, comprises an antibody, a mineral salt such as sodium chloride and an acetate salt, such as sodium acetate. In one example, the formulation is a liquid formulation which comprises a water for injection. In some embodiments, the formulation consists of or consists essentially of the foregoing components.

In some embodiments, a formulation comprises an antibody, mannitol, and polysorbate 80. In one example, the formulation is a liquid formulation which comprises a water for injection.

In some embodiments, a formulation comprises an antibody, L-histidine, L-histidine monohydrochloride, L-arginine hydrochloride, sucrose, and polysorbate 80. In one example, the formulation is a liquid formulation which comprises a water for injection. In some embodiments, the formulation consists of or consists essentially of the foregoing components.

In some embodiments, a formulation comprises an antibody, sucrose, polysorbate 80, monobasic sodium phosphate, and dibasic sodium phosphate. In one example, the formulation is a liquid formulation which comprises a water for injection. In some embodiments, the formulation consists of or consists essentially of the foregoing components.

In some embodiments, a formulation comprises an antibody, L-histidine, L-arginine, succinic acid, and polysorbate 20. In one example, the formulation is a liquid formulation which comprises a water for injection. In some embodiments, the formulation consists of or consists essentially of the foregoing components.

In some embodiments, a formulation comprises an antibody, sorbitol, L-histidine, L-histidine monohydrochloride monohydrate, and polysorbate 80. In one example, the formulation is a liquid formulation which comprises a water for injection. In some embodiments, the formulation consists of or consists essentially of the foregoing components.

In some embodiments, a formulation comprises an antibody, sodium acetate, and sodium chloride. In one example, the formulation is a liquid formulation which comprises a water for injection. In some embodiments, the formulation consists of or consists essentially of the foregoing components.

In some embodiments, a formulation comprises an antibody, EDTA disodium salt dihydrate, L-histidine, L-histidine monohydrochloride monohydrate, L-methionine, polysorbate 80, and sucrose. In one example, the formulation is a liquid formulation which comprises a water for injection. In some embodiments, the formulation consists of or consists essentially of the foregoing components.

In some embodiments, a formulation comprises an antibody, sucrose, sodium chloride, L-arginine hydrochloride, sodium phosphate monobasic dihydrate, and sodium phosphate dibasic dihydrate. In one example, the formulation is a liquid formulation which comprises a water for injection. In some embodiments, the formulation consists of or consists essentially of the foregoing components.

In some embodiments, a formulation comprises an antibody, sodium phosphate monobasic monohydrate, sodium phosphate dibasic heptahydrate, sodium chloride, and polysorbate 80. In one example, the formulation is a liquid formulation which comprises a water for injection. In some embodiments, the formulation consists of or consists essentially of the foregoing components.

In one embodiment, the formulation comprises, consists essentially of or consists of a monoclonal antibody, a salt, a buffer system, a polyol and a non-ionic surfactant. The formulation may be provided in an aqueous medium or in dry powder form. In more particular embodiments, the buffer system includes a citrate buffer system (for example, sodium citrate and citric acid monohydrate), a phosphate buffer system (for example, monobasic sodium phosphate dihydrate and dibasic sodium phosphate) or both. In more particular embodiments, the polyol is mannitol, sorbitol, sucrose, trehalose, raffinose, maltose, or a combination thereof. In more particular embodiments still, the non-ionic surfactant is a polysorbate (e.g., polysorbate, 20, 40, 60, 80, or a combination thereof) and/or a poloxamer (e.g., 188). In some embodiments, the salt is sodium chloride. In some embodiments, the pH of the formulation ranges from about 5 to about 8. In other embodiments, the pH ranges from about 5 to about 5.5, from about 5.1 to about 5.3, or is about 5.2. Optionally, the monoclonal antibody is adalimumab or a biosimilar thereof.

In another embodiment, the formulation comprises, consists essentially of or consists of a monoclonal antibody, an acetate salt, a polyol, a non-ionic surfactant, one or more amino acids, and negligible or non-detectable levels of salts other than the acetate salt (e.g., the formulation may exclude sodium chloride); the formulation contains negligible or non-detectable levels of citrate and phosphate buffer systems. The formulation may be provided in an aqueous medium or in dry powder form. The aqueous formulation or the reconstituted dry powder has an acidic pH, e.g., less than 6. In more particular embodiments, the acetate salt is sodium acetate trihydrate. In more particular embodiments, the polyol is mannitol, sorbitol, sucrose, trehalose, raffinose, maltose, or a combination thereof; preferably, the polyol is sorbitol. In more particular embodiments still, the non-ionic surfactant is a polysorbate (e.g., polysorbate, 20, 40, 60, 80, or a combination thereof) and/or a poloxamer (e.g., 188);

preferably, the non-ionic surfactant is polysorbate 80. In yet more particular embodiments, the one or more amino acids is histidine or a salt thereof, optionally further including arginine or a salt thereof. Optionally, the monoclonal antibody is adalimumab or a biosimilar thereof. In some embodiments, the pH of the formulation ranges from about 5 to about 8.

In another embodiment, the formulation comprises, consists essentially of or consists of a monoclonal antibody, a polyol, a non-ionic surfactant and one or more free amino acids; the formulation contains negligible or non-detectable levels of ionic excipients, and thus negligible or non-detectable levels of an acetate buffer or salt, negligible or non-detectable levels a citrate buffering system and negligible or non-detectable levels of a phosphate buffering system. The formulation may be provided in an aqueous medium or in dry powder form. Accordingly, when the formulation is in an aqueous media or the dry powder form is reconstituted or exposed to an aqueous media, the resulting composition has a low conductivity. In more particular embodiments, the polyol is mannitol, sorbitol, sucrose, trehalose, raffinose, maltose, or a combination thereof; preferably, the polyol is mannitol or sucrose. In more particular embodiments, the non-ionic surfactant is a polysorbate (e.g., polysorbate, 20, 40, 60, 80, or a combination thereof) and/or a poloxamer (e.g., 188); preferably, the non-ionic surfactant is polysorbate 80. In yet more particular embodiments, the one or more free amino acids is selected from histidine, alanine, arginine, glycine, glutamic acid, and combinations of any two or more of the foregoing; preferably, the amino acid is histidine and/or arginine. Preferably, the monoclonal antibody is vedolizumab or a biosimilar thereof. In some embodiments, the pH of the formulation ranges from about 5 to about 8.

In another embodiment, the formulation consists essentially of or consists of a monoclonal antibody, a polyol, and a non-ionic surfactant; the formulation contains low, negligible or non-detectable levels of salts and/or buffering systems; for example, the formulation contains negligible or non-detectable levels of acetate salt, citrate buffers, phosphate buffers, and amino acids salts. The formulation may be provided in an aqueous medium or in dry powder form. In more particular embodiments, the polyol is mannitol, sorbitol, sucrose, trehalose, raffinose, maltose, or a combination thereof; preferably, the polyol is mannitol. In more particular embodiments, the non-ionic surfactant is a polysorbate (e.g., polysorbate, 20, 40, 60, 80, or a combination thereof) and/or a poloxamer (e.g., 188); preferably, the non-ionic surfactant is polysorbate 80. Preferably, the monoclonal antibody is adalimumab or a biosimilar thereof.

Aqueous/Liquid Formulations

In some embodiments, the present disclosure provides a liquid pharmaceutical formulation comprising a therapeutically effective amount of an antibody, which is a solution, suspension, or a dispersion (e.g., a buffered aqueous solution). A buffered solution can include a citrate buffer or a phosphate buffer, e.g., citric acid, sodium citrate, disodium phosphate dihydrate, and sodium dihydrogen phosphate dihydrate; polyols, such as mannitol or sucrose; salts, such as sodium chloride or sodium acetate; a detergent, such as a non-ionic surfactant, including polysorbate 20 or 80; and a mineral base or acid, such as sodium hydroxide or hydrochloric acid, for pH adjustment.

pH of Liquid Formulations

In some embodiments, the pH of a liquid composition can be from about 4 to about 8, from about 4.5 to about 6.0, from about 4.7 to about 5.7, from about 4.8 to about 5.5, or from about 5.0 to about 5.2. In some embodiments, the pH of a liquid composition can be from about 5 to about 8, from about 5.5 to about 7.5, about 6.0 to about 7.0, or about 6.0 to about 6.5, such as about 6.0, about 6.1, about 6.2, about 6.3, about 6.4 or about 6.5.

Concentration of Antibody in a Liquid Composition

In some embodiments, a liquid aqueous pharmaceutical formulation can include a high concentration of an antibody, e.g., ranging from about 40 to about 400 mg/ml, about 1 to about 150 mg/ml, or about 50 to about 200 mg/mL. In some embodiments, the formulation is stable without the need for any additional agents. Concentration of an antibody in a liquid aqueous pharmaceutical formulation may for example be greater than about 45 mg/ml, about 50 mg/ml, about 150 mg/ml, or about 200 mg/mL. In some embodiments, an antibody, or an antigen-binding portion or a biosimilar, or other therapeutic protein, can remain soluble at a high protein concentration (e.g., at least about 40 mg/ml, about 45 mg/ml, about 50 mg/ml, about 55 mg/ml, about 60 mg/ml, about 65 mg/ml, about 70 mg/ml, about 75 mg/ml, about 80 mg/ml, about 85 mg/ml, about 90 mg/ml, about 96 mg/ml, about 100 mg/ml, about 105 mg/ml, about 110 mg/ml, or more) and does not contain a buffer or a salt. In some embodiments, the concentration of an antibody, or an antigen-binding fragment or a biosimilar thereof, in the formulation can be about 90-110 mg/ml, about 95-105 mg/ml, or about 75-125 mg/mL.

Preferably, the formulation is a high concentration formulation wherein the concentration of the antibody in the formulation is greater than 100 mg/mL. In other aspects, the concentration of the antibody in the formulation is at least about 110 mg/mL or at least about or at least about 125 mg/mL. In other aspects, the concentration of the antibody in the formulation is at least about 150 mg/mL. In other aspects, the concentration of the antibody in the formulation is at least about 175 mg/mL. In yet other aspects, the concentration of the antibody in the formulation ranges from about 100 mg/mL to about 200 mg/mL, from about 110 mg/mL to about 250 mg/mL, from about 125 mg/mL to about 200 mg/mL, or from about 150 mg/mL to about 200 mg/mL. In some aspects, the concentration of the antibody in the formulation ranges from about 140 mg/mL to about 180 mg/mL. In some aspects, the concentration of the antibody is about 150 mg/mL. In some aspects, the concentration of the antibody is about 175 mg/mL.

Concentration of Surfactant in a Liquid Composition

In some embodiments, a surfactant used in a liquid formulation is a polysorbate (e.g., polysorbate 80). For example, the concentration of a surfactant (such as polysorbate) in a liquid formulation may be about 0.1-1.5 mg/ml, about 0.2-1.4 mg/ml, about 0.3-1.3 mg/ml, about 0.4-1.2 mg/ml, about 0.5-1.1 mg/ml, about 0.6-1.0 mg/ml, about 0.6-1.1 mg/ml, about 0.7-1.1 mg/ml, about 0.8-1.1 mg/ml, or about 0.9-1.1 mg/ml. In some embodiments, the polysorbate in a liquid formulation is at a concentration of about 0.1-10 mg/mL, about 0.5-5 mg/mL, about 0.1-2 mg/mL, or about 1 mg/mL. In another example, the concentration of the surfactant in a formulation may be from about 10 mg/mL to about 200 mg/ml, such as for example about 20 mg/ml, about 30 mg/ml, about 40 mg/ml, about 50 mg/ml, about 60 mg/ml, about 70 mg/ml, about 80 mg/ml, about 90 mg/ml, about 100 mg/ml, about 110 mg/ml, about 120 mg/ml, about 130 mg/ml, about 140 mg/ml, about 150 mg/ml, about 180 mg/ml, or about 200 mg/ml.

Concentration of a Polyol in a Liquid Composition

In some embodiments, the concentration of a polyol in a liquid formulation is less than about 50 mg/mL or about 45 mg/mL. In others, a liquid formulation contains about 38-46 mg/mL of the polyol (e.g., mannitol). That is, a liquid formulation can include about 35 mg/mL, about 36 mg/mL, about 37 mg/mL, about 38 mg/mL, about 39 mg/mL, about 40 mg/mL, about 41 mg/mL, about 42 mg/mL, about 43 mg/mL, about 44 mg/mL, about 45 mg/mL, about 46 mg/mL, about 47 mg/mL, about 48 mg/mL, about 49 mg/mL, about 50 mg/mL, about 51 mg/mL, about 52 mg/mL, about 53 mg/mL, about 54 mg/mL, or about 55 mg/mL of the polyol. In addition, ranges of values using a combination of any of the above recited values as upper and/or lower limits are intended to be included, e.g., there may be about 39-45 mg/ml, about 40-44 mg/ml, or about 37-47 mg/mL of polyol in the composition. In some embodiments, a liquid formulation includes about 12-72 mg/mL of polyol, e.g., mannitol. A liquid formulation may include mannitol or sorbitol.

In some embodiments, a liquid formulation comprises an antibody, or an antigen binding portion or a biosimilar thereof, at a concentration of more than about 50 mg/ml, less than about 50 mg/mL of a polyol (such as mannitol), and a surfactant, such as polysorbate. In some embodiments, a liquid formulation comprises an antibody at a concentration of about 90-110 mg/mL, and a polyol at a concentration of less than about 50 mg/ml, and a surfactant (e.g., polysorbate 80).

In some embodiments, the concentration of polyol (e.g., non-reducing sugar) in a liquid antibody formulation (e.g., pre-drying or post-reconstitution) can be in the range from about 10 mM to about 1 M, for example, from about 60 mM to about 600 mM, about 100 mM to about 450 mM, about 200 mM to about 350 mM, about 250 mM to about 325 mM, or about 275 mM to about 300 mM.

Amino Acids in Liquid Formulations

In some embodiments, a liquid formulation can include one or more amino acids and/or salts thereof, such as histidine or a combination of histidine and arginine, or more particularly, L-histidine and/or L-arginine. In some embodiments, the concentrations of the amino acid and/or salts thereof for liquid formulations are in the range from about 10 mM to about 0.5 M, about 15 mM to about 300 mM, about 20 mM to about 200 mM, about 25 mM to about 150 mM, about 50 mM, or about 125 mM.

in Exemplary Liquid Formulations

In some embodiments, a liquid aqueous formulation comprises an antibody or antigen-binding fragment thereof (or other therapeutic protein), a surfactant, and a polyol, and does not contain a buffer or a salt. In some embodiments, a liquid aqueous formulation comprises less than 50 mg/mL of a polyol. In some embodiments, a liquid aqueous formulation comprises an antibody or antigen-binding fragment thereof (or other therapeutic protein), a surfactant, and a polyol; wherein the concentration of the antibody, or antigen-binding portion or a biosimilar thereof, is at least about 50 mg/mL, about 75 mg/mL, about 100 mg/mL, or greater than about 100 mg/mL. In some embodiments, a liquid aqueous formulation comprises an antibody or antigen-binding fragment thereof (or other therapeutic protein), at a concentration of at least about 50 mg/mL, about 75 mg/mL, about 100 mg/mL, or greater than about 150 mg/mL, a surfactant, and a polyol; wherein the formulation does not contain a buffer and a salt. In some embodiments, a liquid aqueous formulation consists essentially of a surfactant and about 30-90 mg of an antibody or antigen-binding fragment thereof (or other therapeutic protein), wherein concentration of the antibody is about 90-110 mg/ml.

In one example, the polyol is mannitol and the surfactant is polysorbate 80. In another example, the liquid composition includes about 5-20 mg/mL of mannitol and about 0.1-10 mg/mL of polysorbate 80. In some embodiments, a liquid formulation comprises at least about 50 mg/mL to about 100 mg/mL of an antibody, a buffering agent (e.g., histidine), and at least about 9% (w/w) of a non-reducing sugar (e.g., sucrose, trehalose or mannitol). In some embodiments, a liquid formulation comprises at least about 50 mg/mL to about 80 mg/mL (or about 60 mg/ml) of an antibody, a buffering agent (e.g., histidine), a free amino acid (e.g., arginine) and at least about 9% or 10% (w/w) of a non-reducing sugar (e.g., sucrose, trehalose or mannitol). In some embodiments, a liquid formulation comprises at least about 60 mg/mL of an antibody, at least about 10% (w/v) of a non-reducing sugar, and at least about 125 mM of one or more free amino acids. In some embodiments, a liquid formulation comprises at least about 60 mg/mL of an antibody, at least about 10% (w/v) of a non-reducing sugar, and at least about 175 mM of one or more free amino acids. In some embodiments, a liquid formulation comprises from about 60 mg/mL to about 80 mg/mL of an antibody, a buffering agent and at least about 10% (w/w) of a sugar. In some embodiments, a liquid formulation comprises from about 60 mg/mL to about 80 mg/mL of an antibody, histidine and at least about 10% (w/w) of sucrose.

Special Properties of Liquid Formulations/Conductivity

An antibody or antigen-binding fragment thereof (or other therapeutic protein), may be formulated in an aqueous formulation essentially as described in US 2009/0291062 A1 and U.S. Pat. No. 8,420,081, each of which is incorporated herein by reference in its entirety. In some cases, despite the high concentration of protein, the formulation can have minimal aggregation and can be stored using various methods and forms, e.g., freezing, without deleterious effects that might be expected with high protein formulations. Formulations of the disclosure may in some embodiments not require excipients, such as, for example, surfactants and buffering systems, which are used in traditional formulations to stabilize proteins in solution. However, the formulations may contain these excipients for enhanced stability.

In some embodiments, an aqueous formulation of the disclosure can include low levels of ionic excipients, and thus has low conductivity, e.g., less than 2 mS/cm. The methods and compositions also provide aqueous antibody formulations having low osmolality, e.g., no greater than 30 mOsmol/kg. In some embodiments, a formulation has a low conductivity, including, for example, a conductivity of less than about 2.5 mS/cm, about 2 mS/cm, about 1.5 mS/cm, about 1 mS/cm, about 0.9 mS/cm, or about 0.5 mS/cm. In some embodiments, a formulation has an osmolality of no more than about 15 mOsmol/kg. In some embodiments, the disclosure provides for an aqueous formulation comprising an antibody, or an antigen-binding fragment thereof, wherein the protein has a hydrodynamic diameter ($D_h$) of less than about 5 µm, about 4 µm, about 3 µm, about 2 µm, or about 1 µm.

In some embodiments, the liquid aqueous formulation comprises an antibody or antigen-binding fragment thereof (or other therapeutic protein), at a concentration of at least about 50 mg/mL, a surfactant and a polyol, wherein the formulation has a conductivity of less than about 2 mS/cm. In some embodiments, the liquid aqueous formulation comprises an antibody or antigen-binding fragment thereof (or other therapeutic protein) at a concentration of at least about 50 mg/mL, a surfactant, and a polyol; wherein the antibody or antigen-binding fragment thereof (or other therapeutic protein), has a hydrodynamic diameter of less than about 5 nm, about 4 nm, or about 3 nm in the formulation. In some embodiments, a liquid aqueous formulation comprises an antibody or antigen-binding fragment thereof (or other therapeutic protein), a surfactant, and less than about 50 mg/mL of a polyol, wherein the formulation has a conductivity of less than about 2 mS/cm, a hydrodynamic diameter ($D_h$) which is at least about 50% less than the $D_h$ of the protein in a buffered solution at a given concentration; and a hydrodynamic diameter ($D_h$) of less than about 4 nm. In some embodiments, the formulation has a conductivity of less than about 1 mS/cm, or about 0.9 mS/cm.

Water-based formulations may comprise non-ionizable excipients that improve, for example, the osmolality or viscosity features of the formulation. Examples of non-ionizable excipients which may be included in aqueous formulations for altering desired characteristics of the formulation include, but are not limited to, mannitol, sorbitol, a non-ionic surfactant (e.g., polysorbate 20, polysorbate 40, polysorbate 60 or polysorbate 80), sucrose, trehalose, raffinose, and maltose.

In some embodiments, the disclosure provides for an aqueous formulation comprising an antibody or antigen-binding fragment thereof (or other therapeutic protein) at a concentration of at least 20 mg/mL and water, wherein the formulation has a conductivity of less than about 2.5 mS/cm and the antibody or antigen-binding fragment thereof (or other therapeutic protein), has a molecular weight greater than about 47 kDa. In some embodiments, the concentration of the antibody or antigen-binding fragment thereof is at least 50 mg/mL, and the formulation has an osmolality of no more than about 30 mOsmol/kg. In some embodiments, the antibody or antigen-binding fragment thereof has a hydrodynamic diameter ($D_h$) which is at least about 50% less than the $D_h$ of the antibody, or antigen-binding fragment thereof, in a buffered solution at the same concentration; more particularly, wherein the buffered solution is PBS.

Methods of Making Aqueous Formulations

Skilled practitioners will appreciate that any number of methods may be used to make an aqueous formulation. Methods of making aqueous formulations, as disclosed in US 2009/0291062 and U.S. Pat. No. 8,420,081, may be based on a diafiltration process wherein a first solution containing a protein is diafiltered using water as a diafiltration medium. Protein production operations often involve final diafiltration of a protein solution into a formulation buffer once the protein has been purified from impurities resulting from its expression. For example, an aqueous formulation may be made by subjecting a protein solution to diafiltration using water alone as a diafiltration solution. Proteins may be transferred into pure water for use in a stable formulation, wherein the protein remains in solution and can be concentrated at high levels without the use of other agents to maintain its stability. Diafiltration uses membranes to remove, replace, or lower the concentration of salts or solvents from the protein solutions. Diafiltration or diafiltration/ultrafiltration (DF/UF) selectively utilizes permeable (porous) membrane filters to separate the components of solutions and suspensions based on their molecular size. One parameter for selecting a membrane for concentration is its retention characteristics for the sample to be concentrated. To assure complete retention, the molecular weight cut-off (MWCO) of the membrane should be about $1/3^{rd}$ to about $1/6^{th}$ of the molecular weight of the molecule to be retained. In order to prepare a low-ionic protein formulation, the protein solution (which may be solubilized in a buffered formulation) is subjected to a DF/UF process, whereby water is used as a DF/UF medium. In some embodiments, the DF/UF medium consists of water and does not include any other excipients. Any water can be used in the DF/UF process, although particularly useful water is purified or deionized water. The process may be performed such that there is at least a determined volume exchange, e.g., a five-fold volume exchange, with the water. The resulting aqueous formulation has a significant decrease in the overall percentage of excipients in comparison to the initial protein solution. For example, 95-99% less excipients may be found in the aqueous formulation in comparison to the initial protein solution. Despite the decrease in excipients, the protein can remain soluble and retain its biological activity, even at high concentrations. In some embodiments, the methods of the present disclosure result in compositions comprising an increase in concentration of the protein while decreasing additional components, such as ionic excipients. As such, the hydrodynamic diameter of the protein in the aqueous formulation is smaller relative to the same protein in a standard buffering solution, such as phosphate buffered saline (PBS). Methods may include diafiltering a protein solution using water as a diafiltration medium and subsequently concentrating the resulting aqueous solution. Concentration following diafiltration results in an aqueous formulation containing water and an increased protein concentration relative to the first protein solution. Concentration of the diafiltered protein solution may be achieved through means known in the art, including centrifugation. There are two forms of DF/UF, including DF/UF in discontinuous mode and DF/UF in continuous mode. Useful methods described herein may be performed according to either mode.

In some embodiments, the first protein solution is subjected to a repeated volume exchange with the water, such that an aqueous formulation, which is essentially water and protein, is achieved. The diafiltration step may be performed any number of times, depending on the protein in solution, wherein one diafiltration step equals one total volume exchange. As a result of the diafiltration methods, the concentration of solutes in the first protein solution is significantly reduced in the final aqueous formulation comprising essentially water and protein. For example, the aqueous formulation may have a final concentration of excipients which is at least 95% less than the first protein solution, and preferably at least 99% less than the first protein solution. For example, in one embodiment, to dissolve a protein in WFI is a process that creates a theoretical final excipient concentration, reached by constant volume diafiltration with five diafiltration volumes, that is equal or approximate to Ci e=0.00674, i.e., an approximate 99.3% maximum excipient reduction.

The terms "excipient-free" or "free of excipients" indicate that the formulation is essentially free of excipients. In some embodiments, excipient-free indicates buffer-free, salt free, sugar-free, amino acid-free, surfactant-free, and/or polyol free. In some embodiments, the term "essentially free of excipients" indicates that the solution or formulation is at least 99% free of excipients. It should be noted, however, that in certain embodiments, a formulation may comprise a certain specified non-ionic excipient, e.g., sucrose or mannitol, and yet the formulation is otherwise excipient free. For example, a formulation may comprise water, a protein, and mannitol, wherein the formulation is otherwise excipient free. In another example, a formulation may comprise water, a protein, and polysorbate 80, wherein the formulation is otherwise excipient free. In yet another example, the formulation may comprise water, a protein, a sorbitol, and polysorbate 80, wherein the formulation is otherwise excipient free.

In some embodiments, certain characteristics of the formulation may be adjusted, such as the osmolality and/or viscosity, as desired in high protein concentration-water solutions, by adding non-ionic excipients (e.g., mannitol) without changing other desired features, such as non-opalescence. As such, either during or following the transfer of the protein to water or during the course of the diafiltration, excipients may be added that improve, for example, the osmolality or viscosity features of the formulation. Such non-ionic excipients could be added during the process of the transfer of the protein into the final low ionic formulation. Examples of non-ionizable excipients that may be added to the aqueous formulation for altering desired characteristics of the formulation include, but are not limited to, mannitol, sorbitol, a non-ionic surfactant (e.g., polysorbate 20, polysorbate 40, polysorbate 60 or polysorbate 80), sucrose, trehalose, raffinose, and maltose.

In some embodiments, a liquid formulation can be a solution or suspension prepared in a suitable aqueous solvent, e.g., water or aqueous/organic mixture, such as a water/alcohol mixture. Liquid formulations may be refrigerated (e.g., 2-8° C.) or frozen (e.g., at −20° C. or −80° C.) for storage.

In some embodiments, the present disclosure provides a method for generating a high concentration, aqueous protein suspension preparation, wherein proteins can be therapeutic antibodies. The suspension comprises a protein and a polyamino acid, which serves as a precipitant. The protein and polyamino acid (e.g., poly-L-lysine or poly-L-glutamic acid) form a complex at low ionic strength that is suspended in the buffer. In one example, proteins at about 1.0 mg/mL to about 200 mg/mL are fully precipitated by the addition of about 0.05-0.3 mg/mL poly(amino acid). The protein is stabilized and can be concentrated by removing water or supernatant from the aqueous suspension, for example, following centrifugation of the precipitates. The precipitates are then dissolved by addition of a buffer with salt, for example, at physiological ionic strength of 150 mM sodium chloride (NaCl).

These methods result in redissolved proteins that retain the original activity and native secondary structure of the protein. Also, the method of the present disclosure eliminates the need for the addition of additives that may be necessary for other formulations. In some embodiments, the suspension preparation does not need a dissolving step. The preparation method also has the advantage of producing a concentrated suspension with a relatively low viscosity as compared to other high concentration protein formulations. Exemplary methods and preparations for generating high concentration protein formulations via precipitation and re-dissolution using polyamino acid are described, for example, in US application publication No. 2016/0206752 and Kurinomaru, Takaaki, et al. "Protein poly(amino acid) complex precipitation for high-concentration protein formulation." Journal of pharmaceutical sciences 103.8 (2014): 2248-2254, the disclosure of which is incorporated herein by reference in its entirety.

Solid Formulations

In some aspects, the antibody is provide as a solid. In some aspects, the antibody is provided in crystalline form. In other embodiments, the antibody is provided in amorphous form. In some embodiments, the drug is provided as a lyophilized powder or in extruded form. In one embodiment, the solid drug formulation comprises, consists of or consists essentially of the antibody.

In the case of such solid formulations, such as powders (e.g., for direct incorporation into a device as disclosed herein, or for the preparation of solutions for incorporation into a device as disclosed herein), useful methods of preparation are vacuum drying and freeze-drying that yields a powder of the antibody plus any additional desired ingredient from a previously prepared solution thereof. In some embodiments, a solid formulation (e.g., in a dried state) can be stable for at least three months at about 40° C. and 75% relative humidity (RH). A solid formulation may also have a moisture content of no more than about 5%, about 4.5%, about 4%, about 3.5%, about 3%, about 2.5%, about 2%, about 1.5%, or about 1%; or the solid formulation is substantially anhydrous.

Amount of Antibody in Solid Formulations

In some embodiments, a lyophile after the lyophilization contains, for example, from about 50 wt. % to about 100 wt. %, from about 55 wt. % to about 95 wt. %, from about 60 wt. % to about 90 wt. %, or from about 70 wt. % to about 80 wt. % of an antibody. In some embodiments, a liquid formulation can be reconstituted from a solid lyophilized formulation (e.g., reconstituted to comprise a stable liquid formulation as described herein).

Amount of Polyol in Solid Formulations

The amount of a polyol (e.g., mannitol, sorbitol, sucrose, trehalose, raffinose, maltose, etc.), in a dry (e.g., lyophilized) antibody formulation can be, e.g., in the range from about 40% to about 70% (w/w of dry formulation). More particularly, an amount of the polyol in the dry (e.g., lyophilized) antibody formulation can be in the range from about 40% to about 60%, from about 45% to about 55% or about 51% (w/w). In some embodiments, an amount of the polyol in the dry (e.g., lyophilized) antibody formulation is greater than about 51% (w/w of dry formulation) when the antibody amount is about 31% (w/w of dry formulation) or greater than about a 1.6:1 mass ratio of the polyol (e.g., non-reducing sugar) to the antibody in the dry formulation.

Amount of Amino Acid in Solid Formulations

In some embodiments, an amount of a free amino acid (and/or salt thereof) in a dry, (e.g., lyophilized) formulation can be in the range from about 1% to about 10% (w/w of dry formulation), or from about 3% to about 6% (w/w). In some embodiments, an amount of amino acid in a dry, (e.g., lyophilized) formulation can be greater than about 4% (w/w of the dry formulation) when the antibody amount is about 31% (w/w of the dry formulation) or greater than about a 0.15:1 mass ratio of the amino acid to protein in the dry formulation. In still yet another embodiment, an amount of free amino acid in a dry (e.g., lyophilized) formulation can be in the range from about 4% to about 20% (w/w of dry formulation), or from about 10% to about 15% (w/w). In some embodiments, an amount of amino acid in a dry (e.g., lyophilized) formulation can be greater than about 13% (w/w of the dry formulation) when the protein amount is about 31% (w/w of the dry formulation) or greater than about a 0.4:1 mass ratio of amino acid to protein in the dry formulation. In some embodiments, the amino acid is histidine or arginine or a combination of both.

Amount of Surfactant in Solid Formulations

A surfactant concentration, e.g., in a pre-drying, (e.g., before lyophilization) or post-reconstitution formulation, can be, e.g., from about 0.0001% to about 1.0%, from about 0.01% to about 0.1%, for example about 0.02%, about 0.03%, about 0.04%, about 0.05%, about 0.06%, about 0.07%, about 0.08, %, about 0.09% (w/v), about 0.05% to about 0.07%, or about 0.06% (w/v). A surfactant amount, e.g., in a dry, (e.g., lyophilized) formulation, can generally be from about 0.01% to about 3.0% (w/w), from about 0.10% to about 1.0%, for example about 0.15%, about 0.20%, about 0.25%, about 0.30%, about 0.35%, about 0.40%, or about 0.50% (w/w). In some embodiments, the surfactant is polysorbate 80.

Exemplary Solid Formulations

In some embodiments, a solid (e.g., lyophilized) formulation comprises a mixture of a polyol, such as a non-reducing sugar, an antibody, histidine, arginine, and polysorbate 80, and the molar ratio of polyol (e.g., non-reducing sugar) to the antibody (mole:mole) is greater than about 600:1. In some embodiments, a solid (e.g., lyophilized) formulation comprises a mixture of a polyol, such as a non-reducing sugar, an antibody, histidine, arginine, and polysorbate 80, molar ratio of non-reducing sugar to the antibody (mole:mole) is greater than about 600:1, and the molar ratio of arginine to the antibody (mole:mole) in the formulation is greater than 250:1.

Methods of Making Solid Formulations

Freeze-drying is a commonly employed technique for preserving proteins; freeze-drying serves to remove water from the protein preparation of interest. Freeze-drying, or lyophilization, is a process by which the material to be dried is first frozen and then the ice or frozen solvent is removed by sublimation under vacuum. Excipients can be included in the pre-lyophilized formulation to stabilize proteins during the lyophilization process and/or to improve the stability of the lyophilized protein formulation (Pikal M., *Biopharm.* 3 (9) 26-30 (1990) and Arakawa et al. *Pharm. Res.* 8 (3): 285-291 (1991)).

Amorphous proteins can be obtained by any suitable means, including freeze drying, spray-drying, spray-freeze drying, or precipitation, for example, from supercritical fluids. The foregoing processes, being relatively mild, advantageously provide the biologic protein in stable form with retention of the therapeutic activity.

Reconstitution of Solid Formulations

In some embodiments, a solid formulation can be dissolved (e.g., reconstituted) in a suitable medium or solvent to become a liquid formulation as described herein, suitable for administration to a patient by any suitable route, including incorporation into a device as disclosed herein. Suitable examples of solvents for reconstituting the solid formulation include water, isotonic saline, buffer, e.g., phosphate-buffered saline, citrate-buffered saline, Ringer's (lactated or dextrose) solution, minimal essential medium, alcohol/aqueous solutions, dextrose solution, etc. The amount of solvent can result in an antibody concentration higher, the same, or lower than the concentration of the antibody in the composition prior to drying.

In some embodiments, a liquid formulation is lyophilized and stored as a single dose in a container which may contain at least about 120 mg, about 180 mg, about 240 mg, about 300 mg, about 360 mg, about 540 mg, or about 900 mg of an antibody. The final dosage form, e.g., after dilution of the reconstituted antibody (e.g., in a saline or 5% dextrose), concentration of the antibody can be from about 0.5 mg/mL to about 500 mg/ml, for example, about 50 mg/ml, about 100 mg/ml, about 110 mg/ml, about 125 mg/ml, about 150 mg/ml, about 175 mg/ml, about 200 mg/ml, or greater.

Controlled-Release Formulations and Formulations with Encapsulated Therapeutic Proteins An antibody or another therapeutic protein may be prepared with a carrier that will protect it against rapid release, such as in a controlled-release formulation, including micro-encapsulated delivery systems. Biodegradable, biocompatible polymers can be used in these formulations, such as ethylene vinyl acetate, polyanhydrides, polyglycolic acid, collagen, polyorthoesters, and polylactic acid. Many methods for preparing such formulations are known to skilled practitioners. See, e.g., Sustained and Controlled Release Drug Delivery Systems, J. R. Robinson, ed., Marcel Dekker, Inc., New York, 1978.

In some embodiments, when antibody is crystalline, the protein crystals in the formulation can be embedded in, or encapsulated by, an excipient. Suitable examples of such excipients include any one or more of the polymers described herein. In some embodiments, crystals can then be embedded by drying the crystals and combining these dried crystals with a carrier, e.g., by compression, melt dispersion, etc. In some embodiments, crystals may be encapsulated/embedded by combining a crystal suspension with a carrier solution that is not miscible with water. The carrier precipitates after removal of the solvent of the carrier. Subsequently, the material is dried. In some embodiments, antibody crystals are encapsulated/embedded by combining a crystal suspension with a water miscible carrier solution. The carrier precipitates as its solubility limit is exceeded in the mixture. In some embodiments, antibody crystals are embedded by combining dried crystals or a crystal suspension with a water miscible carrier solution.

Antibody crystals may be encapsulated within a polymeric carrier to form coated particles. The coated particles of an antibody crystal formulation may have a spherical morphology and be microspheres of up to 500 micrometers in diameter or they may have some other morphology and be microparticulates. Formulations and methods of preparing the formulations comprising antibody crystals are described in WO 02/072636, which is incorporated by reference herein.

Also useful are formulations comprising an antibody or other therapeutic protein, and a controlled release matrix comprising at least one lipid or lipophilic vehicle; at least one hydrophilic polymer; at least one hygroscopic polymer; and at least one non-ionic surfactant. In one example, the matrix dissolves in the colon. Suitable examples of liquid lipid or lipophilic vehicle include, e.g., olive oil, sunflower oil, canola oil, palmitoleic acid, oleic acid, myristoleic acid, linoleic acid, arachidonic acid, paraffin oil, and mineral oil. Suitable examples of hygroscopic polymers include, e.g., polyvinylpyrrolidone, copovidone, hydroxypropylmethylcellulose, hydroxypropylcellulose, ethyl cellulose, methylcellulose, and polyethylene oxide. Suitable examples of non-ionic surfactants include, e.g., pluronic, lutrol, tween 80, span 80, egetal, and triton X-100. Additional examples of extended release matrixes are provided, for example, in US 2016/0287525, which is incorporated herein by reference in its entirety.

A formulation may comprise a semi-crystalline matrix, and an antibody or other therapeutic protein in microparticulate or nanoparticulate form entrapped in the matrix. In some embodiments, the matrix can comprise at least one semi-crystalline water soluble polymer in an amount of at least 50% by weight of the total mass of the matrix. In one example, the matrix is characterized by a melting point of at least about 40° C. and is water soluble. Suitable examples of semi-crystalline water soluble polymers include, e.g., polyalkylene glycols, polyalkylene glycol copolymers, polyvinyl alcohols, hydroxyalkyl celluloses, polysorbates, polyoxyethylene stearates, carrageenans, and alignates, and mixtures thereof. Other examples of such formulations are described in US2017/0273909, which is incorporated by reference in its entirety.

Exemplified Controlled-Release Formulations

In some embodiments, a formulation of the present disclosure comprises oleic acid; a polyethylene glycol glyceride ester; a poloxamer non-ionic surfactant; a mixture of polyvinylpyrrolidone and polyvinyl acetate; a carbomer polymer; dimethylaminoethyl methacrylate copolymer; and an antibody.

In some embodiments, a formulation of the present disclosure comprises a controlled release matrix comprising about 40% to about 55% oleic acid; about 5% to about 20% GELUCIRE® 43/01; about 1% to about 10% LUTROL® 127U; about 2% to about 8% KOLLIDON® SR; about 1% to about 6% CARBOPOL® 971 A; about 2% to about 8% EUDRAGIT® EPO; and about 25% to about 33% of an antibody.

Formulations Containing Adalimumab

In some embodiments, the present application provides a pharmaceutical formulation comprising adalimumab (also known as antibody D2E7). The formulation may be a liquid, semi-solid, or solid formulation. As used herein, the term "adalimumab" includes antibody or monoclonal adalimumab, any antigen-binding portion thereof, any glycosylation pattern variant thereof, and any biosimilar thereof.

Low Acidic Species of Adalimumab in Liquid and Solid Formulations

In some embodiments, formulations of adalimumab comprise the antibody having a percentage of acidic species (AR) that is not the same as the percentage of AR present in adalimumab formulated as HUMIRA® as currently approved and described in the "Highlights of Prescribing Information" for HUMIRA® (adalimumab) Injection (Revised January 2008), the contents of which are hereby incorporated herein by reference. In one example, the low AR adalimumab has a percentage of AR that is lower than the percentage of AR present in adalimumab formulated as HUMIRA®. In some embodiments, the formulation comprises any one of the low acidic species described, e.g., in US 2015/0110799, the disclosure of which is incorporated herein by reference in its entirety.

In some embodiments, a formulation of adalimumab can include less than about 10% total acidic species of adalimumab, wherein the acidic species of adalimumab have a net negative charge relative to the adalimumab main species and the acidic species comprise species selected from the group consisting of charge variants, structure variants, fragmentation variants and any combinations thereof, and wherein the acidic species of adalimumab do not include process-related impurities selected from the group consisting of host cell proteins, host cell nucleic acids, chromatographic materials and media components.

Formulations Containing Crystalline Forms of Adalimumab

In some embodiments, a formulation of adalimumab comprises the antibody in a crystalline form. In one example, the formulation comprises a crystal of adalimumab wherein the crystal has a needle morphology with a length of about 2-500 μm, or about 100-300 μm, and an I/d ratio of about 3 to 30, as described in U.S. Pat. No. 8,436,149. Crystals may be obtained from a polyclonal antibody or a monoclonal antibody, or both.

The crystal of the antibody may be obtained by a batch crystallization method, which may include (a) combining an aqueous solution of adalimumab, an inorganic phosphate salt, and an acetate buffer to obtain an aqueous crystallization mixture, wherein the aqueous crystallization mixture has a pH about 3 to about 5, has an acetate buffer concentration of about 0 M to about 0.5 M, has an inorganic phosphate salt concentration of about 1 M to about 6 M, and has an antibody concentration of about 0.5 mg/mL to about 100 mg/mL; and incubating the aqueous crystallization mixture at a temperature of about 4° C. to 37° C. until a crystal of the antibody is formed. In some embodiments, the formulation is a crystal slurry, having adalimumab concentration greater than about 100 mg/mL or 100 mg/g.

pH of Aqueous Formulation of Adalimumab

In some embodiments, a formulation of adalimumab is a liquid pharmaceutical formulation as described herein. The pH of such a formulation can be, e.g., from about 4 to about 8, from about 4.5 to about 6.0, from about 4.7 to about 5.7, from about 4.8 to about 5.5, or from about 5.0 to about 5.2, inclusive. In some embodiments, the pH of the liquid formulation is from about 5 to about 8.

Concentration of Adalimumab in Liquid Formulations

In some embodiments, a liquid formulation of adalimumab contains a high concentration of adalimumab, including, for example, a concentration greater than about 45 mg/mL, greater than about 50 mg/mL, or up to 100 mg/mL. In other embodiments, the liquid formulation of adalimumab contains an even higher concentration of adalimumab, including, for example, a concentration greater than 100 mg/mL, greater than about 110 mg/mL, greater than about 125 mg/mL, greater than about 150 mg/mL, or greater than 175 mg/mL. In some embodiments, the formulation is an aqueous pharmaceutical composition comprising adalimumab, a polyol, a surfactant, and a buffer system comprising citrate and/or phosphate with a pH of about 4 to 8, in amounts sufficient to formulate the antibody for therapeutic use at a concentration of greater than 100 mg/mL. In some embodiments, a liquid formulation of adalimumab comprises the antibody at a concentration of at least about 110 mg/mL, at least about 125 mg/mL, at least about 150 mg/mL or at least about 175 mg/mL.

In some embodiments, the concentration of adalimumab in the formulation is between about 1 mg to about 150 mg, inclusive, of antibody per mL of a liquid formulation. In others, the concentration of is between about 5 mg to about 80 mg per mL. In still others, the concentration of adalimumab in the formulation is between about 25 mg/mL to about 50 mg/mL, inclusive. In some embodiments, the concentration of adalimumab in a liquid formulation is about 1-150 mg/mL, about 5-145 mg/mL, about 10-140 mg/mL, about 15-135 mg/mL, about 20-130 mg/mL, about 25-125 mg/mL, about 30-120 mg/mL, about 35-115 mg/mL, about 40-110 mg/mL, about 45-105 mg/mL, about 50-100 mg/mL, about 55-95 mg/mL, about 60-90 mg/mL, about 65-85 mg/mL, about 70-80 mg/mL, or about 75 mg/mL. Ranges intermediate to the above recited concentrations, e.g., about 6-144 mg/mL, are also intended to be part of this disclosure. For example, ranges of values using a combination of any of the above recited values as upper and/or lower limits are intended to be included. In some embodiments, the formulation of adalimumab contains a high antibody concentration, such as for example about 50 mg/mL, about 55 mg/mL, about 60 mg/mL, about 65 mg/mL, about 70 mg/mL, about 75 mg/mL, about 80 mg/mL, about 85 mg/mL, about 90 mg/mL, about 95 mg/mL, about 100 mg/mL, about 105 mg/mL, about 110 mg/mL, about 115 mg/mL (or higher) of adalimumab. In some embodiments, the concentration of adalimumab in a liquid formulation is about 40-125 mg/mL, about 50-150 mg/mL, about 55-150 mg/mL, about 60-150 mg/mL, about 65-150 mg/mL, about 70-150 mg/mL, about 75-150 mg/mL, about 80-150 mg/mL, about 85-150 mg/mL, about 90-150 mg/mL, about 90-110 mg/mL, about 95-105 mg/mL, about 95-150 mg/mL, about 100-150 mg/mL, about 105-150 mg/mL, about 110-150 mg/mL, about 115-150 mg/mL, about 120-150 mg/mL, about 125-150 mg/mL, about 125-200 mg/mL, about 50-130 mg/mL, about 95-105 mg/mL, about 75-125 mg/mL of adalimumab, or at least about 200 mg/mL.

In some embodiments, the formulation of adalimumab is a liquid, and the pH of the liquid formulation is from about 5 to about 8. In some embodiments, the liquid formulation includes a buffer. In some embodiments, the pH of the buffer, and/or the pH of the final liquid formulation containing the buffer, ranges from about 4 to about 8, from about 5 to about 8, from about 5 to about 7.5, from about 5 to about 7, from about 4.5 to about 6.0, from about 4.7 to about 5.7, from about 4.8 to about 5.5, or from about 5.0 to about 5.2.

Buffering Agents in Aqueous Solutions of Adalimumab

The present disclosure provides an aqueous formulation comprising adalimumab in a pH-buffered solution. In one example, a liquid formulation comprises adalimumab in combination with mannitol, citric acid monohydrate, sodium citrate, disodium phosphate dihydrate, sodium dihydrogen phosphate dihydrate, sodium chloride, polysorbate 80, water, and sodium hydroxide. The buffer may have a pH ranging from about 4 to about 8, from about 5 to about 8, from about 5 to about 7.5, from about 5 to about 7, from about 4.5 to about 6.0, from about 4.7 to about 5.7, from about 4.8 to about 5.5, or from about 5.0 to about 5.2. Suitable examples of buffers that will control the pH within the above ranges include acetate (e.g., sodium acetate), succinate (such as sodium succinate), gluconate, histidine, citrate and other organic acid buffers.

In some embodiments, a liquid formulation may be buffered with histidine (and optionally arginine) amino acids and an acetate, while minimizing sodium chloride, with the buffers enhancing the thermal and colloidal stability of the antibody, even more so than formulations of adalimumab currently approved for patient use (e.g., currently approved injectable solutions). In some embodiments, the formulation contains a fine balance of an acidic pH of about 5.2 with the appropriate salts and buffer components. High levels of salt may induce aggregation and degradation, which could be improved by lowering the salt level. Accordingly, the present disclosure provides a buffered formulation of adalimumab comprising an aqueous carrier comprising buffer comprising histidine (and optionally arginine) amino acids and an acetate, and comprising mannitol, a non-ionic surfactant, and a minimal amount of sodium chloride.

In some embodiments, a formulation of adalimumab comprises a buffer system that contains citrate and phosphate to maintain the pH in a range of about 4 to about 8, from about 4.5 to about 6.0, from about 4.8 to about 5.5, or from about 5.0 to about 5.2. In one example, the buffer system includes citric acid monohydrate, sodium citrate, disodium phosphate dihydrate, and/or sodium dihydrogen phosphate dihydrate. In another example, the buffer system includes about 1.3 mg/mL of citric acid (e.g., 1.305 mg/mL), about 0.3 mg/mL of sodium citrate (e.g., 0.305 mg/mL), about 1.5 mg/mL of disodium phosphate dihydrate (e.g., 1.53 mg/mL), about 0.9 mg/mL of sodium dihydrogen phosphate dihydrate (e.g., 0.86), and about 6.2 mg/mL of sodium chloride (e.g., 6.165 mg/mL). In additional examples, the buffer system includes about 1-1.5 mg/mL of citric acid, about 0.25 mg/mL to about 0.5 mg/mL of sodium citrate, about 1.25 mg/mL to about 1.75 mg/mL of disodium phosphate dihydrate, about 0.7 mg/mL to about 1.1 mg/mL of sodium dihydrogen phosphate dihydrate, and about 6.0 mg/mL to about 6.4 mg/mL of sodium chloride. The pH of a formulation can be adjusted with an appropriate amount of sodium hydroxide.

In some embodiments, a liquid pharmaceutical formulation of adalimumab comprises about 1.3 mg/mL of citric acid, about 0.3 mg/mL of sodium citrate, about 1.5 mg/mL of disodium phosphate dihydrate, about 0.9 mg/mL of sodium dihydrogen phosphate dihydrate, and about 6.2 mg/mL of sodium chloride. In other embodiments, a liquid aqueous pharmaceutical formulation of adalimumab comprises about 1.305 mg/mL of citric acid, about 0.305 mg/mL of sodium citrate, about 1.53 mg/mL of disodium phosphate dihydrate, about 0.86 mg/mL of sodium dihydrogen phosphate dihydrate, and about 6.165 mg/mL of sodium chloride.

Polyols in Solid and Liquid Formulations of Adalimumab

A polyol, which acts as a tonicifier and may stabilize adalimumab, may be included in a formulation of adalimumab. The polyol can be added to the formulation in an amount that may vary with respect to the desired isotonicity of the formulation. In some embodiments, the aqueous formulation is isotonic. The amount of polyol added may also vary with respect to the molecular weight of the polyol. For example, a lower amount of a monosaccharide (e.g. mannitol) may be added, compared to a disaccharide (such as trehalose). In some embodiments, the polyol used in the formulation as a tonicity agent can be mannitol. For example, the mannitol concentration can be about 5-20 mg/mL, about 7.5-15 mg/mL, about 10-14 mg/mL, or about 12 mg/mL. In some embodiments, the polyol sorbitol is included in the formulation.

Surfactants in Solid and Liquid Formulations of Adalimumab

A detergent or surfactant may be added to a formulation of adalimumab. Exemplary detergents include nonionic surfactants such as polysorbates (e.g., polysorbates 20, 80 etc.) or poloxamers (e.g., poloxamer 188 or 407). The amount of detergent added can be such that it reduces aggregation of adalimumab, minimizes the formation of particulates in the formulation and reduces adsorption. In some embodiments, the formulation includes a surfactant which is a polysorbate such as polysorbate 80 or Tween 80. Tween 80 is a term used to describe polyoxyethylene (20) sorbitanmonooleate (see Fiedler, Lexikon der Hifsstoffe, Editio Cantor Verlag Aulendorf, 4th edi., 1996). In some embodiments, the formulation can be liquid and contain from about 0.1 mg/mL to about 10 mg/mL, from about 0.5 mg/mL to about 5 mg/mL, about 0.1%, or about 0.2% of polysorbate 80. In some embodiments, the formulation of adalimumab contains about 0.1-2 mg/mL, about 0.1-1.5 mg/mL, about 0.2-1.4 mg/mL, about 0.3-1.3 mg/mL, about 0.4-1.2 mg/mL, about 0.5-1.1 mg/mL, about 0.6-1.0 mg/mL, about 0.6-1.1 mg/mL, about 0.7-1.1 mg/mL, about 0.8-1.1 mg/mL, or about 0.9-1.1 mg/mL of a surfactant such as polysorbate 80.

Exemplary Dosage of Adalimumab in Solid and Liquid Formulations

In some embodiments, a formulation of adalimumab can include about 20-100 mg, about 20-110 mg, about 20-90 mg, about 30-80 mg, about 30-90 mg, about 30-100 mg, about 60-100 mg, about 40-90 mg, or about 40-100 mg of adalimumab. In some embodiments, the formulation includes about 30 mg, about 31 mg, about 32 mg, about 33 mg, about 34 mg, about 35 mg, about 36 mg, about 37 mg, about 38 mg, about 39 mg, about 40 mg, about 41 mg, about 42 mg, about 43 mg, about 44 mg, about 45 mg, about 46 mg, about 47 mg, about 48 mg, about 49 mg, about 50 mg, about 51 mg, about 52 mg, about 53 mg, about 54 mg, about 55 mg, about 56 mg, about 57 mg, about 58 mg, about 59 mg, about 60 mg, about 61 mg, about 62 mg, about 63 mg, about 64 mg, about 65 mg, about 66 mg, about 67 mg, about 68 mg, about 69 mg, about 70 mg, about 71 mg, about 72 mg, about 73 mg, about 74 mg, about 75 mg, about 76 mg, about 77 mg, about 78 mg, about 79 mg, about 80 mg, about 81 mg, about 82 mg, about 83 mg, about 84 mg, 85 mg, about 86 mg, about 87 mg, about 88 mg, about 89 mg, about 90 mg, about 91 mg, about 92 mg, about 93 mg, about 94 mg, about 95 mg, about 96 mg, about 97 mg, about 98 mg, about 99 mg, about 100 mg, about 101 mg, about 102 mg, about 103 mg, about 104 mg, about 105 mg, about 106 mg, about 107 mg, about 108 mg, about 109 mg, or about 110 mg of adalimumab. Ranges including the aforementioned numbers are also included in the disclosure, e.g., about 70-90 mg, about 65-95 mg, about 75-85 mg, or about 60-85 mg of adalimumab. In some embodiments, an effective amount of adalimumab is about 20 mg, about 25 mg, about 30 mg, about 35 mg, about 40 mg, about 45 mg, about 50 mg, about 55 mg, about 60 mg, about 65 mg, about 70 mg, about 75 mg, about 80 mg, about 85 mg, about 90 mg, about 95 mg, or about 100 mg.

In some embodiments, a formulation of adalimumab can include about 1 mg to about 500 mg, about 1 mg to about 100 mg, about 5 mg to about 40 mg, about 40 mg to about 80 mg, about 160 mg, about 80 mg or about 40 mg of adalimumab. In some embodiments, the formulation contains an induction dose of about 160 mg of adalimumab. In other embodiments, the formulation contains a maintenance dose of about 80 mg, about 40 mg, or about 40 mg to about 80 mg of adalimumab.

Special Properties of Liquid Formulations of Adalimumab/Conductivity

In some embodiments, a formulation of adalimumab does not contain any buffer(s) (e.g., citrate and phosphate) or salt(s). It should be noted, however, that although said formulation may not contain buffer or salt (e.g., NaCl), a small trace amount of a buffer and/or a salt may be present in the formulation. In some embodiments, the formulation does not contain detectable levels of a buffer(s) and/or a salt.

In some embodiments, the formulation contains adalimumab at a concentration of about 100 mg/mL (or about 75-125 mg/mL), a surfactant (e.g., polysorbate 80), and has a conductivity of less than about 2 mS/cm. In one example, the formulation also contains a polyol (e.g., sorbitol or mannitol).

In some embodiments, a formulation contains adalimumab at a concentration of about 100 mg/mL (or about 75-125 mg/mL), about 0.8-1.3 mg/mL of a surfactant (e.g., polysorbate 80), and has a conductivity of less than 2 mS/cm. In one example, the formulation also contains less than about 50 mg/mL of a polyol (e.g., sorbitol or mannitol).

In some embodiments, a liquid aqueous formulation of adalimumab comprises adalimumab, a surfactant, and less than 50 mg/mL of a polyol, where the formulation has a conductivity of less than about 2 mS/cm and a hydrodynamic diameter ($D_h$) which is at least about 50% less than the $D_h$ of the protein in a buffered solution at a given concentration.

Formulations of Adalimumab for Administration in Combination with Methotrexate

In some embodiments, a formulation of adalimumab is administered to a patient in combination with methotrexate, or a pharmaceutically acceptable salt thereof. In one example, the formulation of adalimumab and methotrexate, or a pharmaceutically acceptable salt thereof, are administered to a patient simultaneously or consecutively, for example, in separate dosage forms. In another example, formulation of adalimumab is administered to the subject in a device as described herein, and methotrexate, or a pharmaceutically acceptable salt thereof, is administered to the subject in a conventional dosage form, such as a tablet or gelatin capsule. In some embodiments, a formulation of adalimumab and a therapeutically effective amount of methotrexate, or a pharmaceutically acceptable salt thereof, is administered to a patient in the same dosage form (e.g., in a device as described herein).

Exemplified Adalimumab Formulations

In some embodiments, a formulation comprises adalimumab, polysorbate 80, mannitol, and water for injection. In some more particular embodiments, the formulation consists essentially of or consists of adalimumab, polysorbate 80, mannitol, and water for injection. In even more particular embodiments, the concentration of adalimumab in the formulation is about 100 mg/mL. In one particular embodiment, the formulation is HUMIRA® 40 mg concentrate for injection, as provided in commercially available pre-filled syringes or pens (AbbVie Limited, Summary of Product Characteristics Updated 2 May 2018). In other embodiments, the formulation comprises, consists of or consists essentially of adalimumab, polysorbate 80, mannitol and water for injection, and the concentration of adalimumab in the formulation is greater than about 100 mg/mL. In yet other embodiments, the formulation comprises, consists of or consists essentially of adalimumab, polysorbate 80, mannitol and water for injection, and the concentration of adalimumab in the formulation is at least about 110 mg/mL, at least about 125 mg/mL, at least about 150 mg/mL or at least about 175 mg/mL.

In some embodiments, a formulation comprises, consists essentially of or consists of adalimumab, sodium chloride, a buffer including sodium phosphate monobasic monohydrate, sodium phosphate dibasic heptahydrate, and polysorbate 80. In one example, the formulation is liquid and comprises water for injection. In some embodiments, the formulation consists essentially of or consists of the foregoing components.

In some embodiments, a formulation comprises, consists essentially of or consists of an adalimumab, a buffer which is optionally a phosphate or citrate buffer, and an excipient selected from a polyol (such as a sugar or sugar alcohol) and a non-ionic surfactant, such as a polysorbate. In one example, the formulation is liquid and contains water for injection. In another example, the formulation contains low levels of ionic excipients and has low conductivity.

In some embodiments, a formulation comprises, consists essentially of or consists of adalimumab, sodium chloride, a buffer containing a phosphate such as sodium phosphate monobasic dihydrate, sodium phosphate dibasic dihydrate, or a combination thereof, L-arginine hydrochloride, and sucrose. In one example, the formulation is liquid and contains water for injection.

In some embodiments, a formulation comprises, consists essentially of or consists of adalimumab, sodium chloride, a buffer containing a phosphate such as sodium phosphate monobasic dihydrate, sodium phosphate dibasic dihydrate, or a combination thereof, a citrate such as sodium citrate, citric acid monohydrate, or a combination thereof, mannitol, and polysorbate 80. In one example, the formulation is liquid and contains water for injection. In another example, the pH of the liquid formulation is adjusted with NaOH to about 5.2. In one embodiment, the formulation is HUMIRA® (adalimumab) for injection, for subcutaneous use, for example, as initially approved in the U.S. in 2002. In some embodiments, a formulation comprises, consists essentially of or consists of adalimumab, a buffer, which is optionally a phosphate or citrate buffer, a polyol selected from mannitol, sorbitol, sucrose, trehalose, raffinose, maltose, and a combination thereof, and a non-ionic surfactant selected from polysorbate 20, polysorbate 40, polysorbate 60, and polysorbate 80. In one example, the formulation contains low levels of ionic excipients and has low conductivity. In another example, the concentration of adalimumab in the formulation is at least about 10 mg/mL, about 50 mg/mL, about 100 mg/mL, about 150 mg/mL, about 200 mg/mL, or about 250 mg/mL.

In some embodiments, a formulation comprises, consists essentially of or consists of adalimumab, a buffer containing a phosphate selected from monobasic sodium phosphate and dibasic sodium phosphate, sucrose, and polysorbate 80.

In some embodiments, a formulation comprises, consists essentially of or consists of adalimumab, arginine, histidine, or a combination thereof, sucrose, and polysorbate 80. Optionally, the formulation further comprises a buffer. In one example, the formulation is a lyophilized powder.

In some embodiments, a formulation comprises, consists essentially of or consists of adalimumab, a free amino acid selected from histidine, alanine, arginine, glycine, and glutamic acid, a polyol selected from mannitol, sorbitol, sucrose, trehalose, and a combination thereof, and a surfactant. Optionally, the formulation further comprises a buffer. In one example, the formulation is liquid. In another example, the formulation is solid (e.g., lyophilized powder for reconstitution).

In some embodiments, a formulation comprises, consists essentially of or consists of adalimumab, an acetate salt, such as sodium acetate trihydrate, an amino acid which is histidine and/or a salt thereof, sorbitol, and a non-ionic surfactant such as polysorbate 80; optionally, the formulation further comprises arginine and/or a salt thereof. In one example, the formulation is liquid and comprises water for injection. In another example, the pH of the liquid formulation is from about 5.1 to about 5.3. In yet another example, the formulation contains negligible or non-detectable amount of sodium chloride. In yet another example, the formulation does not contain phosphate or citrate.

In some embodiments, a formulation comprises, consists essentially of or consists of adalimumab, an amino acid selected from L-histidine, L-histidine monohydrochloride monohydrate, and a combination thereof, sorbitol and polysorbate 80. In one example, the formulation is liquid and comprises water for injection.

In some embodiments, a formulation comprises, consists essentially of or consists of adalimumab, an amino acid selected from L-histidine, L-histidine monohydrochloride monohydrate, L-methionine, and a combination thereof, sucrose, and polysorbate 80. In one example, the formulation also contains a metal chelating agent such as EDTA disodium salt dihydrate. In another example, the formulation is liquid and contains water for injection.

In some embodiments, a formulation comprises, consists essentially of or consists of adalimumab, an amino acid selected from L-histidine, L-histidine monohydrochloride monohydrate, L-arginine hydrochloride, and a combination thereof, sucrose, and polysorbate 80.

In some embodiments, a formulation comprises, consists essentially of or consists of adalimumab, an amino acid selected from L-histidine and L-arginine, and a combination thereof, polysorbate 20, and succinic acid.

In some embodiments, a formulation comprises, consists essentially of or consists of adalimumab at a concentration of at least about 100 mg/mL, mannitol, and polysorbate 80.

In one example, the formulation is liquid and contains water for injection. In one embodiment, the formulation is HUMIRA® 40 mg concentrate for injection, as provided in commercially available pre-filled syringes or pens (AbbVie Limited, Summary of Product Characteristics Updated 2 May 2018).

In some embodiments, a formulation comprises, consists essentially of or consists of adalimumab, a buffer containing a negligible or non-detectable amount of sodium chloride, phosphate and citrate, a polyol such as mannitol, and a surfactant selected from a polysorbate and a poloxamer. In one example, the formulation has an adalimumab concentration of at least about 50 mg/mL, about 75 mg/mL, or about 100 mg/mL or greater, and has low conductivity.

In some embodiments, a formulation comprises, consists essentially of or consists of adalimumab, sodium chloride, and an acetate such as sodium acetate.

In some embodiments, a formulation comprises about 80 mg of adalimumab, water for injection, about 42 mg/mL of mannitol, and about 1 mg/mL of polysorbate 80. In some embodiments, a formulation comprises about 80 mg of adalimumab, water for injection, and about 1 mg/mL polysorbate 80.

In some embodiments, a liquid aqueous pharmaceutical formulation comprises about 1-150 mg/mL of adalimumab, about 5-20 mg/mL of mannitol, about 0.1-10 mg/mL of Tween-80, and a buffer system comprising citrate and/or phosphate, with a pH of about 4 to about 8. In one example, the formulation comprises about 40 mg of adalimumab.

In some embodiments, a liquid aqueous pharmaceutical formulation comprises about 50 mg/mL of adalimumab, about 12 mg/mL of mannitol, about 1 mg/mL of Tween-80, and a buffer system comprising citrate and/or phosphate, with a pH of about 4 to about 8. In one example, the formulation comprises about 40 mg of adalimumab.

In some embodiments, a liquid aqueous formulation of adalimumab consists essentially of a surfactant and about 30-90 mg of adalimumab, wherein the formulation has an antibody concentration of about 90-110 mg/mL.

In some embodiments, a liquid aqueous formulation comprises about 100 mg/mL of adalimumab; about 1.0 mg/mL of polysorbate-80; and about 42 mg/mL of mannitol; where the formulation has a pH of about 4.7 to about 5.7 and does not contain a buffer or a salt.

In some embodiments, a liquid aqueous formulation consists essentially of about 100 mg/mL of adalimumab; about 1.0 mg/mL of polysorbate-80; and about 42 mg/mL of mannitol, where the formulation has a pH of about 4.7 to about 5.7.

In some embodiments, a liquid aqueous formulation comprises about 100 mg/mL of adalimumab; about 1.0 mg/mL of polysorbate-80; and about 42 mg/mL of mannitol; where the formulation has a pH of about 4.7 to about 5.7, and where the formulation is stable up to about 30° C. for at least 6 days.

In some embodiments, a liquid aqueous formulation comprises about 100 mg/mL of adalimumab; about 1.0 mg/mL of polysorbate-80; and about 42 mg/mL of mannitol; where the formulation has a pH of about 4.7 to about 5.7, and where the formulation has a characteristic selected from the group consisting of a conductivity of less than about 2 mS/cm; a hydrodynamic diameter ($D_h$) which is at least about 50% less than the $D_h$ of the protein in a buffered solution at a given concentration; and a hydrodynamic diameter ($D_h$) of less than about 4 nm.

In some embodiments, a liquid aqueous formulation consists essentially of about 1.0 mg/mL of polysorbate-80 and about 40 mg of adalimumab, where the concentration of adalimumab is about 100 mg/mL, and where the formulation has a pH of about 4.7 to about 5.7.

In some embodiments, a liquid aqueous pharmaceutical formulation comprises about 20 to about 150 mg/mL of adalimumab, about 5-20 mg/mL of mannitol, about 0.1-10 mg/mL of polysorbate-80, and a buffer system comprising citrate and phosphate, with a pH of about 4 to about 8.

In some embodiments, a liquid aqueous pharmaceutical formulation comprises about 40 mg/mL to about 100 mg/mL of adalimumab, about 7.5 to about 15 mg/mL of mannitol, and about 0.5 to about 5 mg/mL of polysorbate 80.

In some embodiments, a liquid aqueous formulation comprises about 50-100 mg/mL of adalimumab, about 7.5-15 mg/mL of mannitol, and about 0.5-5 mg/mL of polysorbate 80, where the pH of the formulation is about 5.0-6.5.

In some embodiments, a liquid aqueous formulation comprises 50 mg/mL of adalimumab, about 7.5-15 mg/mL of mannitol, and about 0.5-5 mg/mL of polysorbate 80, where the pH of the formulation is about 4.5 to about 6.0.

In some embodiments, a liquid aqueous formulation comprises about 45-105 mg/mL of adalimumab, a polyol, about 0.1-10 mg/mL of polysorbate 80, and a buffer system having a pH of about 4.5 to about 7.0.

In some embodiments, a liquid aqueous formulation comprises about 45-150 mg/mL of adalimumab, a polyol, about 0.1-10 mg/mL of polysorbate 80, and a buffer system having a pH of about 4.5 to about 7.0.

In some embodiments, a liquid aqueous formulation comprises about 50 mg/mL to about 100 mg/mL of adalimumab, trehalose, and about 0.5-5 mg/mL of polysorbate 80, where the formulation has a pH of about 5.0 to about 6.5.

In some embodiments, a liquid aqueous formulation comprises about 45 to about 105 mg/mL of adalimumab, trehalose, about 0.1-10 mg/mL of polysorbate 80, and a buffer system comprising acetate and having a pH of about 4.5 to about 7.0.

In some embodiments, a liquid aqueous formulation comprises about 100 mg/mL of adalimumab; about 1.0 mg/mL of polysorbate-80; and about 42 mg/mL of mannitol; where the formulation has a pH of about 4.7 to about 5.7.

In some embodiments, a liquid aqueous formulation comprises about 50 to about 100 mg/mL adalimumab, trehalose, and about 0.5-5 mg/mL of polysorbate 80, where the formulation has a pH of about 5.0 to about 6.5.

In some embodiments, a liquid formulation of adalimumab comprises an aqueous buffer comprising from about 10 mM to about 30 mM of acetate or an acetate salt (e.g., sodium acetate trihydrate), from about 15 mM to about 20 mM of histidine and/or a histidine salt and from about 0 mM to about 30 mM of arginine, from about 200 mM to about 206 mM of sorbitol, and about 0.07% (v/v) to about 0.15% (v/v) of a non-ionic surfactant (e.g., polysorbate 80). In these embodiments, the formulation has a pH of from about 5.1 to about 5.3 (e.g., about 5.2).

In some embodiments, a liquid formulation of adalimumab comprises a buffer comprising from about 1 mM to about 30 mM of an acetate salt, from about 10 mM to about 30 mM of histidine and/or a histidine salt, about 201 mM to about 205 mM of sorbitol, and about 0.08% (v/v) to about 0.12% (v/v) of polysorbate 80. In one example, the antibody formulation has a pH of from about 5.1 to about 5.3 (e.g., about 5.2). In another example, the buffer comprises from about 0.1 to about 30 mM of arginine and/or an arginine salt. In another example, the acetate salt comprises sodium acetate trihydrate. In another example, the formulation comprises from about 35 mg to about 45 mg of adalimumab, e.g., from about 37 mg to about 43 mg, or about 40 mg of adalimumab. In another example, the formulation does not comprise NaCl, a citrate, or a phosphate.

In some embodiments, a formulation of adalimumab comprises adalimumab, sodium chloride, monobasic sodium phosphate dihydrate, dibasic sodium phosphate dihydrate, sodium citrate, citric acid monohydrate, mannitol, and polysorbate 80. In one example, the formulation is a liquid formulation (e.g., aqueous solution) or a solid formulation (e.g., lyophilized cake).

In some embodiments, a liquid formulation of adalimumab comprises adalimumab, sodium chloride, monobasic sodium phosphate dihydrate, dibasic sodium phosphate dihydrate, sodium citrate, citric acid monohydrate, mannitol, polysorbate 80, and water.

In some embodiments, an aqueous formulation of adalimumab comprises about 0.8 mL of a solution for injection comprising:

| Name of ingredient | Quantity | Function |
| --- | --- | --- |
| Adalimumab (used as a concentrate) | 40.0 mg | 40.0 mg Active substance |
| Mannitol | 9.6 mg | Tonicity agent |
| Citric acid monohydrate Citric acid | 1.044 mg | Buffer |
| Sodium citrate | 0.244 mg | Buffer |
| Sodium phosphate dihydrate Dibasic sodium phosphate dihydrate | 1.224 mg | Buffer |
| Sodium dihydrogen phosphate dihydrate Monobasic sodium phosphate dihydrate | 0.688 mg | Buffer |
| Sodium chloride | 4.932 mg | Tonicity agent |
| Polysorbate 80 | 0.8 mg | Detergent |
| Water for injection | 759.028-759.048 mg | Solvent |
| Sodium hydroxide (1M solution) | 0.02-0.04 mg | pH adjustment |
| total | 817.6 mg | |

In some embodiments, the density of the solution for injection is about 1.022 g/mL. In some embodiments, smaller volumes may be used, for example, for incorporation into a device of the present disclosure, for example, a volume of about 0.4 mg/mL may be incorporated into the device or device reservoir.

In some embodiments, each 0.8 mL of a liquid formulation of adalimumab comprises about 40 mg adalimumab, about 4.93 mg sodium chloride, about 0.69 mg monobasic sodium phosphate dihydrate, about 1.22 mg dibasic sodium phosphate dihydrate, about 0.24 mg sodium citrate, about 1.04 mg citric acid monohydrate, about 9.6 mg mannitol, about 0.8 mg polysorbate 80, and water for injection. In some embodiments, the pH of the liquid formulation is about 5.2.

In some embodiments, each 0.2 mL of a liquid formulation of adalimumab comprises about 20 mg adalimumab, mannitol and polysorbate 80. In one example, the formulation also comprises citric acid monohydrate, sodium citrate, sodium dihydrogen phosphate dihydrate, disodium phosphate dihydrate, sodium chloride and sodium hydroxide.

In some embodiments, each 0.8 mL of a liquid formulation of adalimumab comprises about 80 mg adalimumab, about 33.6 mg mannitol, about 0.8 mg polysorbate 80, and water for injection. In some embodiments, the pH of the liquid formulation is about 5.2.

In some embodiments, each 0.4 mL of a liquid formulation of adalimumab comprises about 40 mg adalimumab, about 16.8 mg mannitol, about 0.4 mg polysorbate 80, and water for injection. In some embodiments, the pH of the liquid formulation is about 5.2.

In some embodiments, each 0.4 mL of a liquid formulation of adalimumab comprises about 20 mg adalimumab, about 0.52 mg citric acid monohydrate, about 0.61 mg dibasic sodium phosphate dihydrate, about 4.8 mg mannitol, about 0.34 mg monobasic sodium phosphate dihydrate, about 0.4 mg polysorbate 80, about 2.47 mg sodium chloride, about 0.12 mg sodium citrate, and water for injection. In some embodiments, the pH of the liquid formulation is about 5.2.

In some embodiments, each 0.2 mL of a liquid formulation of adalimumab comprises about 10 mg adalimumab, about 0.26 mg citric acid monohydrate, about 0.31 mg dibasic sodium phosphate dihydrate, about 2.4 mg mannitol, about 0.17 mg monobasic sodium phosphate dihydrate, about 0.2 mg polysorbate 80, about 1.23 mg sodium chloride, about 0.06 mg sodium citrate, and water for injection. In some embodiments, the pH of the liquid formulation is about 5.2.

Additional pharmaceutical formulations of adalimumab are disclosed, for example, in US Publication Nos. US 2015/0110799, US 2012/026373, US 2012/0263731, US 2010/0034823; U.S. Pat. Nos. 8,821,865, 8,034,906, and 8,436,149; and PCT Publication Nos. WO 2004/016286 and WO 2017/136433, the disclosures of each of which are incorporated herein by reference in their entirety.

Formulations Containing Vedolizumab

In some embodiments, the present application provides a pharmaceutical formulation comprising vedolizumab. The formulation may be a liquid, semi-solid, or solid formulation. As used herein, the term "vedolizumab" includes antibody or monoclonal vedolizumab, any antigen-binding portion thereof, any glycosylation pattern variant thereof, and any biosimilar thereof.

In some embodiments, an aqueous formulation comprises vedolizumab, at least one amino acid, a sugar, and a surfactant. In one example, the amino acid is histidine, arginine, or a combination thereof. In other aspects, the sugar is sucrose. In yet other aspects, the surfactant is polysorbate 80.

In some embodiments, a formulation of vedolizumab is stable for a prolonged period of time. A dry, (e.g., lyophilized) formulation of vedolizumab may be stable at about 40° C., at about 75% RH for at least about 2-4 weeks, at least about 2 months, at least about 3 months, at least about 6 months, at least about 9 months, at least about 12 months, or at least about 18 months. In some embodiments, a formulation (liquid or dry (e.g., lyophilized)) of vedolizumab is stable at about 5° C. and/or 25° C. and about 60% RH for at least about 3 months, at least about 6 months, at least about 9 months, at least about 12 months, at least about 18 months, at least about 24 months, at least about 30 months, at least about 36 months, or at least about 48 months. In another example, a formulation (liquid or dry (e.g., lyophilized)) of vedolizumab is stable at about −20° C. for at least about 3 months, at least about 6 months, at least about 9 months, at least about 12 months, at least about 18 months, at least about 24 months, at least about 30 months, at least about 36 months, at least about 42 months, or at least about 48 months. Furthermore, the liquid formulation may, in some embodiments, be stable following freezing (to, e.g., −80° C.) and thawing, such as, for example, following 1, 2 or 3 cycles of freezing and thawing.

Concentration of Vedolizumab in Liquid Formulations

In some embodiments, a liquid (e.g., aqueous) formulation of vedolizumab contains a high concentration of the antibody, for example, from about 1 mg/mL to about 200 mg/mL of vedolizumab. In some embodiments, a liquid formulation of vedolizumab contains a high concentration of vedolizumab, including, for example, a concentration greater than about 45 mg/mL, greater than about 50 mg/mL, greater than about 100 mg/mL, greater than about 110 mg/mL, greater than about 125 mg/mL, greater than about 150 mg/mL, or greater than about 175 mg/mL.

In some embodiments, the pH of the liquid formulation of vedolizumab is from about 5 to about 8. The liquid formulation may include a buffer having a pH ranging from about 4 to about 8, from about 5 to about 8, from about 5 to about 7.5, from about 5 to about 7, from about 4.5 to about 6.0, from about 4.7 to about 5.7, from about 4.8 to about 5.5, or from about 5.0 to about 5.2.

Polyols in Solid and Liquid Vedolizumab Formulations

A polyol or sugar in the vedolizumab composition can be a non-reducing sugar. In some embodiments, the polyol or sugar is selected from the group consisting of: mannitol, sorbitol, sucrose, trehalose, raffinose, stachyose, melezitose, dextran, maltitol, lactitol, isomaltulose, palatinit, and a combination thereof. A molar ratio of the sugar to vedolizumab can be at least about 600:1; about 625:1; about 650:1; about 675:1, about 700:1; about 750:1; about 800:1, about 1000:1, about 1200:1, about 1400:1, about 1500:1, about 1600:1, about 1700:1, about 1800:1, about 1900:1, or about 2000:1. In some embodiments, the non-reducing sugar concentration in a liquid vedolizumab formulation (e.g., pre-drying or post-reconstitution) is in the range from about 10 mM to about 1 M, for example, from about 60 mM to about 600 mM, about 100 mM to about 450 mM, about 200 mM to about 350 mM, about 250 mM to about 325 mM, or about 275 mM to about 300 mM. In some embodiments, the amount of non-reducing sugar in a dry (e.g., lyophilized) vedolizumab formulation is in the range from about 40% to about 70% (w/w of dry formulation). In some embodiments, the amount of non-reducing sugar in a dry (e.g., lyophilized) vedolizumab formulation is in the range from about 40% to about 60%, from about 45% to about 55% or about 51% (w/w). In some embodiments, the amount of non-reducing sugar in a dry (e.g., lyophilized) vedolizumab formulation is greater than about 51% (w/w of dry formulation) when the vedolizumab amount is about 31% (w/w of dry formulation) or greater than about a 1.6:1 mass ratio of the non-reducing sugar to the antibody in the dry formulation. In some embodiments, sucrose is the non-reducing sugar for use in the vedolizumab formulation.

Methods of Preparation of Liquid and Solid Vedolizumab Formulations

A formulation of vedolizumab may be prepared, for example, as follows. Bottles of frozen, high concentration antibody preparation (vedolizumab, 50 mM histidine, 125 mM arginine, 0.06% polysorbate 80, pH 6.3) are thawed at room temperature for about 16-24 hours. Thawed bottles are pooled into a stainless steel compounding vessel and mixed. The preparation is then diluted with dilution buffer A (50 mM histidine, 125 mM arginine, 0.06% polysorbate 80, pH 6.3) to 80 mg/mL of vedolizumab and mixed. Sucrose is then added by diluting the preparation with dilution buffer B, which contains sucrose (50 mM histidine, 125 mM arginine, 40% sucrose, 0.06% polysorbate 80, pH 6.3). This step dilutes the antibody preparation to a liquid formulation of 60 mg/mL vedolizumab, 50 mM histidine, 125 mM arginine, 10% sucrose, 0.06% polysorbate 80, pH of about 6.3.

In some embodiments, the pre-lyophilization vedolizumab formulation volume is the same as the pre-administration reconstituted solution volume. For example, a formulation that is about 5.5 mL pre-lyophilization can be reconstituted to a volume of about 5.5 mL, by adding an amount of liquid, e.g., water or saline, that takes into account the volume of the dry solids. In other embodiments, it may be desirable to lyophilize the formulation in a different volume than the reconstituted solution volume. For example, the vedolizumab formulation can be lyophilized as a dilute solution, e.g., 0.25×, 0.5×, or 0.75× and reconstituted to 1× by adding less liquid, e.g., 75% less, half, or 25% less than the pre-lyophilization volume. In some embodiments, a 300 mg dose of vedolizumab can be lyophilized as a 30 mg/mL antibody solution in 5% sucrose and reconstituted to a 60 mg/mL antibody solution in 10% sucrose. Alternatively, a lyophilized vedolizumab formulation can be reconstituted into a more dilute solution than the pre-lyophilized formulation.

Exemplary Dosage of Liquid and Solid Vedolizumab Formulations

In some embodiments, a formulation of vedolizumab as described herein is administered to a patient, for example in a device as described herein, to achieve a therapeutically effective dose of about 0.2 mg/kg, about 0.5 mg/kg, about 2.0 mg/kg, about 6.0 mg/kg, or about 10.0 mg/kg. In some embodiments, effective dose of vedolizumab in the formulation is about 30 mg, about 40 mg, about 50 mg, about 60 mg, about 80 mg, about 100 mg, about 120 mg, about 150 mg, about 180 mg, about 200 mg, about 225 mg, about 250 mg, about 300 mg, about 350 mg, 400 mg, about 450 mg, about 500 mg, about 600 mg, about 700 mg, or about 750 mg. In some embodiments, a 750 mg dose is about 2.5 times the recommended dose for administration to a patient. In some embodiments, the effective dose is about 0.2-10 mg/kg, or about 1-100 mg/kg. In some embodiments, the effective dose of vedolizumab is about 0.1 mg/kg body weight to about 10.0 mg/kg body weight per treatment, for example about 2 mg/kg to about 7 mg/kg, about 3 mg/kg to about 6 mg/kg, or about 3.5 mg/kg to about 5 mg/kg. In some embodiments, the dose administered is about 0.3 mg/kg, about 0.5 mg/kg, about 1 mg/kg, about 2 mg/kg, about 3 mg/kg, about 4 mg/kg, about 5 mg/kg, about 6 mg/kg, about 7 mg/kg, about 8 mg/kg, about 9 mg/kg, or about 10 mg/kg. In some embodiments, the vedolizumab is administered at a dose of about 50 mg, about 100 mg, about 300 mg, about 500 mg or about 600 mg. In some embodiments, the vedolizumab is administered at a dose of about 108 mg, about 216 mg, about 160 mg, about 165 mg, about 155 to about 180 mg, about 170 mg or about 180 mg.

In some embodiments, a formulation of vedolizumab includes about 1 mg to about 500 mg, about 1 mg to about 100 mg, or about 5 mg to about 40 mg of vedolizumab.

Exemplary Liquid and Solid Vedolizumab Formulations

In some embodiments, a formulation comprises, consists essentially of, or consists of vedolizumab, sodium chloride, a buffer including sodium phosphate monobasic monohydrate, sodium phosphate dibasic heptahydrate, and polysorbate 80. In one example, the formulation is liquid and comprises water for injection.

In some embodiments, a formulation comprises, consists essentially of, or consists of vedolizumab, a buffer which is optionally a phosphate or citrate buffer, and an excipient selected from a polyol (such as a sugar or sugar alcohol) and a non-ionic surfactant, such as a polysorbate. In one example, the formulation is liquid and contains water for injection. In another example, the formulation contains low levels of ionic excipients and has low conductivity.

In some embodiments, a formulation comprises, consists essentially of, or consists of vedolizumab, sodium chloride, a buffer containing a phosphate such as sodium phosphate monobasic dihydrate, sodium phosphate dibasic dihydrate, or a combination thereof, L-arginine hydrochloride, and sucrose. In one example, the formulation is liquid and contains water for injection.

In some embodiments, a formulation comprises, consists essentially of, or consists of vedolizumab, sodium chloride, a buffer containing a phosphate such as sodium phosphate monobasic dihydrate, sodium phosphate dibasic dihydrate, or a combination thereof, a citrate such as sodium citrate, citric acid monohydrate, or a combination thereof, mannitol, and polysorbate 80. In one example, the formulation is liquid and contains water for injection. In another example, the pH of the liquid formulation is adjusted with NaOH to about 5.2.

In some embodiments, a formulation comprises, consists essentially of, or consists of vedolizumab, a buffer, which is optionally a phosphate or citrate buffer, a polyol selected from mannitol, sorbitol, sucrose, trehalose, raffinose, maltose, and a combination thereof, and a non-ionic surfactant selected from polysorbate 20, polysorbate 40, polysorbate 60, and polysorbate 80. In one example, the formulation contains low levels of ionic excipients and has low conductivity. In another example, the concentration of the antibody in the formulation is at least about 10 mg/mL, about 50 mg/mL, about 100 mg/mL, about 150 mg/mL, about 200 mg/mL, or about 250 mg/mL.

In some embodiments, a formulation comprises, consists essentially of, or consists of vedolizumab, a buffer containing a phosphate selected from monobasic sodium phosphate and dibasic sodium phosphate, sucrose, and polysorbate 80.

In some embodiments, a formulation comprises, consists essentially of, or consists of vedolizumab, arginine, histidine, or a combination thereof, sucrose, and polysorbate 80. Optionally, the formulation further comprises a buffer. In one example, the formulation is a lyophilized powder.

In some embodiments, a formulation comprises, consists essentially of, or consists of vedolizumab, a free amino acid selected from histidine, alanine, arginine, glycine, and glutamic acid, a polyol selected from mannitol, sorbitol, sucrose, trehalose, and a combination thereof, and a surfactant. Optionally, the formulation further comprises a buffer. In one example, the formulation is liquid. In another example, the formulation is solid (e.g., lyophilized powder for reconstitution).

In some embodiments, a formulation comprises, consists essentially of, or consists of vedolizumab, an acetate salt, such as sodium acetate trihydrate, an amino acid which is histidine and/or a salt thereof, sorbitol, and a non-ionic surfactant such as polysorbate 80; optionally, the formulation further comprises arginine and/or a salt thereof. In one example, the formulation is liquid and comprises water for injection. In another example, the pH of the liquid formulation is from about 5.1 to about 5.3. In yet another example, the formulation contains a negligible or non-detectable amount of sodium chloride. In yet another example, the formulation does not contain phosphate or citrate.

In some embodiments, a formulation comprises, consists essentially of, or consists of vedolizumab, an amino acid selected from L-histidine, L-histidine monohydrochloride monohydrate, and a combination thereof, sorbitol and polysorbate 80. In one example, the formulation is liquid and comprises water for injection.

In some embodiments, a formulation comprises, consists essentially of, or consists of vedolizumab, an amino acid selected from L-histidine, L-histidine monohydrochloride monohydrate, L-methionine, and a combination thereof, sucrose, and polysorbate. In one example, the formulation also contains a metal chelating agent such as EDTA disodium salt dihydrate. In another example, the formulation is liquid and contains water for injection.

In some embodiments, a formulation comprises, consists essentially of, or consists of vedolizumab, an amino acid selected from L-histidine, L-histidine monohydrochloride monohydrate, L-arginine hydrochloride, and a combination thereof, sucrose, and polysorbate 80. In one particular embodiment, the formulation is ENTYVIO®.

In some embodiments, a formulation comprises, consists essentially of, or consists of vedolizumab, an amino acid selected from L-histidine and L-arginine, and a combination thereof, polysorbate 20, and succinic acid.

In some embodiments, a formulation comprises, consists essentially of, or consists of vedolizumab at a concentration of at least about 100 mg/mL, mannitol, and polysorbate 80. In one example, the formulation is liquid and contains water for injection.

In some embodiments, a formulation comprises, consists essentially of, or consists of vedolizumab, a buffer containing a negligible or non-detectable amount of sodium chloride, phosphate and citrate, a polyol such as mannitol, and a surfactant selected from a polysorbate and a poloxamer. In one example, the formulation has an antibody concentration of at least about 50 mg/mL, about 75 mg/mL, or about 100 mg/mL or greater, and low conductivity.

In some embodiments, a formulation comprises, consists essentially of, or consists of vedolizumab, sodium chloride, and an acetate such as sodium acetate.

In some embodiments, a formulation of vedolizumab is a liquid formulation comprising at least about 50 mg/mL to about 100 mg/mL of vedolizumab, a buffering agent (e.g., histidine), and at least about 9% (w/w) non-reducing sugar (e.g., sucrose, trehalose or mannitol). In some embodiments, the formulation comprises at least about 50 mg/mL to about 80 mg/mL (e.g., about 60 mg/mL) of vedolizumab, a buffering agent (e.g., histidine), a free amino acid (e.g., arginine) and at least about 9% or about 10% (w/w) non-reducing sugar (e.g., sucrose, trehalose or mannitol).

A formulation of vedolizumab can be lyophilized and stored as a single dose in one container (e.g., a device as described herein). The container can be stored at about 2-8° C. until it is administered to a subject in need thereof. The container may contain, for example, a 60 mg/mL dose of vedolizumab. The container may contain at least about 120 mg, about 180 mg, about 240 mg, about 300 mg, about 360 mg, about 540 mg, or about 900 mg of the total amount of vedolizumab.

In some embodiments, an aqueous formulation comprises vedolizumab, about 50 mM histidine, about 125 mM arginine, about 0.06% polysorbate 80, and the pH of the formulation is about 6.3.

In some embodiments, an aqueous composition comprises about 5 mg/mL of vedolizumab, about 20 mM of citrate/citric acid, about 125 mM of sodium chloride, and about 0.05% polysorbate 80, and has a pH of about 6.0. This formulation may be stored long term at about −70° C. and up to 3 months at about −20° C.

In some embodiments, an aqueous formulation comprises about 60 mg/mL vedolizumab, about 25 mM histidine, about 75 mM arginine, about 2% sucrose, about 0.05% polysorbate 80, and has a pH of about 6.3.

In some embodiments, an aqueous formulation comprises about 60 mg/mL vedolizumab, about 25 mM histidine, about 75 mM arginine, about 4% sucrose, about 0.05% polysorbate 80, and has a pH of about 6.9.

In some embodiments, an aqueous formulation comprises about 60 mg/mL vedolizumab, about 50 mM histidine, about 125 mM arginine, about 2% sucrose, about 0.05% polysorbate 80, and has a pH of about 6.7.

In some embodiments, an aqueous formulation comprises about 60 mg/mL vedolizumab, about 50 mM histidine, about 125 mM arginine, about 4% sucrose, about 0.05% polysorbate 80, and has a pH of about 6.9.

In some embodiments, an aqueous formulation comprises about 60 mg/mL vedolizumab, about 50 mM histidine, about 125 mM arginine, about 6% sucrose, about 1.5% mannitol, about 0.06% polysorbate 80, and has a pH of about 6.3.

In some embodiments, an aqueous formulation comprises about 60 mg/mL vedolizumab, about 50 mM histidine, about 125 mM arginine, about 9% sucrose, about 0.06% polysorbate 80, and has a pH of about 6.3.

In some embodiments, a single dose of a liquid formulation contains about 300 mg vedolizumab, about 23 mg L-histidine, about 21.4 mg L-histidine monohydrochloride, about 131.7 mg L-arginine hydrochloride, about 500 mg sucrose and about 3 mg polysorbate 80. In some embodiments, this formulation is a lyophilized cake, and when reconstituted with about 4.8 mL of water for injection, the pH of the formulation is about 6.3. The formulation can be stored for up to about four hours at about 2-8° C. (about 36° F. to about 46° F.) without freezing.

In some embodiments, a dosage form (e.g., a container as described herein) contains about 1-20 mL of a 60 mg/mL solution of vedolizumab for a total dose of the antibody of about 60-1200 mg, for example about 300 mg. In some embodiments, the formulation is lyophilized and stored as a single dose in one container at about 2-8° C. until it is administered to a subject in need thereof.

Additional pharmaceutical formulations of vedolizumab are disclosed, for example, in US Publication Nos. US 2012/0282249 and US 2017/0002078; U.S. Pat. No. 9,764,033; and PCT Publication Nos. 2012/151248, 2016/086147, and 2016/105572, the disclosures of each of which are incorporated herein by reference in their entireties.

Formulations Containing Infliximab

In some embodiments, a pharmaceutical formulation described herein includes infliximab. The formulation may be a liquid, semi-solid, or solid formulation. The term "infliximab" includes antibody or monoclonal infliximab, any antigen-binding portion thereof, any glycosylation pattern variant thereof, and any biosimilar thereof.

Exemplary Dosage of Infliximab in Solid and Liquid Formulations

In some embodiments, a formulation of infliximab as described herein is administered to a patient, for example in a device as described herein, to achieve a therapeutically effective dose of, e.g., about 0.2 mg/kg, about 0.5 mg/kg, about 2.0 mg/kg, about 3.0 mg/kg, about 6.0 mg/kg, about 10.0 mg/kg, about 20.0 mg/kg, or about 40.0 mg/kg. In some embodiments, infliximab can be administered at a dose of, e.g., about 80 mg, about 90 mg, about 100 mg, about 120 mg, about 150, about 160 mg, about 170 mg, about 180 mg, or about 200 mg.

In some embodiments, a liquid formulation of infliximab contains a high concentration of infliximab, including, for example, a concentration greater than about 45 mg/mL, greater than about 50 mg/mL, greater than about 100 mg/mL, greater than about 110 mg/mL, greater than about 125 mg/mL, greater than about 150 mg/mL, greater than about 175 mg/mL, or greater than about 200 mg/mL.

In some embodiments, the formulation of infliximab is a liquid, and the pH of the liquid formulation is from about 5 to about 8. In some embodiments, the liquid formulation includes a buffer. In some embodiments, the pH of the buffer, and/or the pH of the final liquid formulation containing the buffer, ranges from about 4 to about 8, from about 5 to about 8, from about 5 to about 7.5, from about 5 to about 7, from about 4.5 to about 6.0, from about 4.7 to about 5.7, from about 4.8 to about 5.5, or from about 5.0 to about 5.2.

Exemplary Formulations of Infliximab

In some embodiments, a formulation comprises, consists essentially of or consists of infliximab, sodium chloride, a buffer including sodium phosphate monobasic monohydrate, sodium phosphate dibasic heptahydrate, and polysorbate 80. In one example, the formulation is liquid and comprises water for injection.

In some embodiments, a formulation comprises, consists essentially of or consists of infliximab, a buffer which is optionally a phosphate or citrate buffer, and an excipient selected from a polyol (such as a sugar or sugar alcohol) and a non-ionic surfactant, such as a polysorbate. In one example, the formulation is liquid and contains water for injection. In another example, the formulation contains low levels of ionic excipients and has low conductivity.

In some embodiments, a formulation comprises, consists essentially of or consists of infliximab, sodium chloride, a buffer containing a phosphate such as sodium phosphate monobasic dihydrate, sodium phosphate dibasic dihydrate, or a combination thereof, L-arginine hydrochloride, and sucrose. In one example, the formulation is liquid and contains water for injection.

In some embodiments, a formulation comprises, consists essentially of or consists of infliximab, sodium chloride, a buffer containing a phosphate such as sodium phosphate monobasic dihydrate, sodium phosphate dibasic dihydrate, or a combination thereof, a citrate such as sodium citrate, citric acid monohydrate, or a combination thereof, mannitol, and polysorbate 80. In one example, the formulation is liquid and contains water for injection. In another example, the pH of the liquid formulation is adjusted with NaOH to about 5.2.

In some embodiments, a formulation comprises, consists essentially of or consists of infliximab, a buffer, which is optionally a phosphate or citrate buffer, a polyol selected from mannitol, sorbitol, sucrose, trehalose, raffinose, maltose, and a combination thereof, and a non-ionic surfactant selected from polysorbate 20, polysorbate 40, polysorbate 60, and polysorbate 80. In one example, the formulation contains low levels of ionic excipients and has low conductivity. In another example, the concentration of the antibody in the formulation is at least about 10 mg/mL, about 50 mg/mL, about 100 mg/mL, about 150 mg/mL, about 200 mg/mL, or about 250 mg/mL.

In some embodiments, a formulation comprises, consists essentially of or consists of infliximab, a buffer containing a phosphate selected from monobasic sodium phosphate and dibasic sodium phosphate, sucrose, and polysorbate 80. In some embodiments, the formulation is REMICADE®.

In some embodiments, a formulation comprises, consists essentially of or consists of infliximab, arginine, histidine, or a combination thereof, sucrose, and polysorbate 80. Optionally, the formulation further comprises a buffer. In one example, the formulation is a lyophilized powder.

In some embodiments, a formulation comprises, consists essentially of or consists of infliximab, a free amino acid selected from histidine, alanine, arginine, glycine, and glutamic acid, a polyol selected from mannitol, sorbitol, sucrose, trehalose, and a combination thereof, and a surfactant. Optionally, the formulation further comprises a buffer. In one example, the formulation is liquid. In another example, the formulation is solid (e.g., lyophilized powder for reconstitution).

In some embodiments, a formulation comprises, consists essentially of or consists of infliximab, an acetate salt, such as sodium acetate trihydrate, an amino acid which is histidine and/or a salt thereof, sorbitol, and a non-ionic surfactant such as polysorbate 80; optionally, the formulation further comprises arginine and/or a salt thereof. In one example, the formulation is liquid and comprises water for injection. In another example, the pH of the liquid formulation is from about 5.1 to about 5.3. In yet another example, the formulation contains a negligible or non-detectable amount of sodium chloride. In yet another example, the formulation does not contain phosphate or citrate.

In some embodiments, a formulation comprises, consists essentially of or consists of infliximab, an amino acid selected from L-histidine, L-histidine monohydrochloride monohydrate, and a combination thereof, sorbitol and polysorbate 80. In one example, the formulation is liquid and comprises water for injection.

In some embodiments, a formulation comprises, consists essentially of or consists of infliximab, an amino acid selected from L-histidine, L-histidine monohydrochloride monohydrate, L-methionine, and a combination thereof, sucrose, and polysorbate 80. In one example, the formulation also contains a metal chelating agent such as EDTA disodium salt dihydrate. In another example, the formulation is liquid and contains water for injection.

In some embodiments, a formulation comprises, consists essentially of or consists of infliximab, an amino acid selected from L-histidine, L-histidine monohydrochloride monohydrate, L-arginine hydrochloride, and a combination thereof, sucrose, and polysorbate 80.

In some embodiments, a formulation comprises, consists essentially of or consists of infliximab, an amino acid selected from L-histidine and L-arginine, and a combination thereof, polysorbate 20, and succinic acid.

In some embodiments, a formulation comprises, consists essentially of or consists of infliximab at a concentration of at least about 100 mg/mL, mannitol, and polysorbate 80. In one example, the formulation is liquid and contains water for injection.

In some embodiments, a formulation comprises, consists essentially of or consists of infliximab, a buffer containing a negligible or non-detectable amount of sodium chloride, phosphate and citrate, a polyol such as mannitol, and a surfactant selected from a polysorbate and a poloxamer. In one example, the formulation has an antibody concentration of at least about 50 mg/mL, about 75 mg/mL, or about 100 mg/mL or greater, and low conductivity.

In some embodiments, a formulation, at a bare minimum, comprises, consists essentially of or consists of infliximab, sodium chloride, and an acetate such as sodium acetate.

In some embodiments, a single dose of a formulation of infliximab (e.g., in a device as described herein) includes about 100 mg infliximab, about 500 mg sucrose, about 0.5 mg polysorbate 80, about 2.2 mg monobasic sodium phosphate, monohydrate, and about 6.1 mg dibasic sodium phosphate, dihydrate. In some embodiments, the pH of the formulation is about 7.2. In some embodiments, the formulation does not contain any preservatives. In some embodiments, a formulation of infliximab is a lyophilized powder that may be reconstituted.

Infliximab may be supplied in a single container (e.g., a device as described herein) as a liquid formulation containing about 10 mg/mL. In some embodiments, the formulation comprises about 100 mg infliximab, sucrose, polysorbate 80, monobasic sodium phosphate, monohydrate, and dibasic sodium phosphate.

Formulations Containing Etrolizumab

In some embodiments, a pharmaceutical formulation includes etrolizumab. The formulation can be a liquid, semi-solid, or solid formulation. As used herein, the term "etrolizumab" includes antibody or monoclonal etrolizumab, any antigen-binding portion thereof, any glycosylation pattern variant thereof, and any biosimilar thereof.

Exemplary Dosage of Etrolizumab in Solid and Liquid Formulations

In some embodiments, etrolizumab is administered at a dose of about 80 mg, about 90 mg, about 100 mg, about 105 mg, about 120 mg, about 150, about 160 mg, about 170 mg, about 180 mg, or about 200 mg. In some embodiments, an effective dose of etrolizumab is about 100 mg, about 200 mg, about 210 mg, about 300 mg, about 400 mg, or about 450 mg. In certain embodiments, the effective dose is about 105 mg or about 210 mg.

In some embodiments, a formulation of etrolizumab includes about 1 mg to about 500 mg, about 1 mg to about 100 mg, or about 5 mg to about 40 mg of etrolizumab.

In some embodiments, a liquid formulation of etrolizumab contains a high concentration of etrolizumab, including, for example, a concentration greater than about 45 mg/mL, greater than about 50 mg/mL, greater than about 100 mg/mL, greater than about 110 mg/mL, greater than about 125 mg/mL, greater than about 150 mg/mL, greater than about 175 mg/mL, or greater than about 200 mg/mL.

In some embodiments, the formulation of etrolizumab is a liquid, and the pH of the liquid formulation is from about 5 to about 8. In some embodiments, the liquid formulation includes a buffer. In some embodiments, the pH of the buffer, and/or the pH of the final liquid formulation containing the buffer, ranges from about 4 to about 8, from about 5 to about 8, from about 5 to about 7.5, from about 5 to about 7, from about 4.5 to about 6.0, from about 4.7 to about 5.7, from about 4.8 to about 5.5, or from about 5.0 to about 5.2.

Exemplary Formulations of Etrolizumab

In some embodiments, a formulation comprises, consists essentially of, or consists of etrolizumab, sodium chloride, a buffer including sodium phosphate monobasic monohydrate, sodium phosphate dibasic heptahydrate, and polysorbate 80. In one example, the formulation is liquid and comprises water for injection.

In some embodiments, a formulation comprises, consists essentially of, or consists of etrolizumab, a buffer which is optionally a phosphate or citrate buffer, and an excipient selected from a polyol (such as a sugar or sugar alcohol) and a non-ionic surfactant, such as a polysorbate. In one example, the formulation is liquid and contains water for injection. In another example, the formulation contains low levels of ionic excipients and has low conductivity.

In some embodiments, a formulation comprises, consists essentially of, or consists of etrolizumab, sodium chloride, a buffer containing a phosphate such as sodium phosphate monobasic dihydrate, sodium phosphate dibasic dihydrate, or a combination thereof, L-arginine hydrochloride, and sucrose. In one example, the formulation is liquid and contains water for injection.

In some embodiments, a formulation comprises, consists essentially of, or consists of etrolizumab, sodium chloride, a buffer containing a phosphate such as sodium phosphate monobasic dihydrate, sodium phosphate dibasic dihydrate, or a combination thereof, a citrate such as sodium citrate, citric acid monohydrate, or a combination thereof, mannitol, and polysorbate 80. In one example, the formulation is liquid and contains water for injection. In another example, the pH of the liquid formulation is adjusted with NaOH to about 5.2.

In some embodiments, a formulation comprises, consists essentially of, or consists of etrolizumab, a buffer, which is optionally a phosphate or citrate buffer, a polyol selected from mannitol, sorbitol, sucrose, trehalose, raffinose, maltose, and a combination thereof, and a non-ionic surfactant selected from polysorbate 20, polysorbate 40, polysorbate 60, and polysorbate 80. In one example, the formulation contains low levels of ionic excipients and has low conductivity. In another example, the concentration of the antibody in the formulation is at least about 10 mg/mL, about 50 mg/mL, about 100 mg/mL, about 150 mg/mL, about 200 mg/mL, or about 250 mg/mL.

In some embodiments, a formulation comprises, consists essentially of, or consists of etrolizumab, a buffer containing a phosphate selected from monobasic sodium phosphate and dibasic sodium phosphate, sucrose, and polysorbate 80.

In some embodiments, a formulation comprises, consists essentially of, or consists of etrolizumab, arginine, histidine, or a combination thereof, sucrose, and polysorbate 80. Optionally, the formulation further comprises a buffer. In one example, the formulation is a lyophilized powder.

In some embodiments, a formulation comprises, consists essentially of, or consists of etrolizumab, a free amino acid selected from histidine, alanine, arginine, glycine, and glutamic acid, a polyol selected from mannitol, sorbitol, sucrose, trehalose, and a combination thereof, and a surfactant. Optionally, the formulation further comprises a buffer. In one example, the formulation is liquid. In another example, the formulation is solid (e.g., lyophilized powder for reconstitution).

In some embodiments, a formulation comprises, consists essentially of, or consists of etrolizumab, an acetate salt, such as sodium acetate trihydrate, an amino acid which is histidine and/or a salt thereof, sorbitol, and a non-ionic surfactant such as polysorbate 80; optionally, the formulation further comprises arginine and/or a salt thereof. In one example, the formulation is liquid and comprises water for injection. In another example, the pH of the liquid formulation is from about 5.1 to about 5.3. In yet another example, the formulation contains a negligible or non-detectable amount of sodium chloride. In yet another example, the formulation does not contain phosphate or citrate.

In some embodiments, a formulation comprises, consists essentially of, or consists of etrolizumab, an amino acid selected from L-histidine, L-histidine monohydrochloride monohydrate, and a combination thereof, sorbitol and polysorbate 80. In one example, the formulation is liquid and comprises water for injection.

In some embodiments, a formulation comprises, consists essentially of, or consists of etrolizumab, an amino acid selected from L-histidine, L-histidine monohydrochloride monohydrate, L-methionine, and a combination thereof, sucrose, and polysorbate 80. In one example, the formulation also contains a metal chelating agent such as EDTA disodium salt dihydrate. In another example, the formulation is liquid and contains water for injection.

In some embodiments, a formulation comprises, consists essentially of, or consists of etrolizumab, an amino acid selected from L-histidine, L-histidine monohydrochloride monohydrate, L-arginine hydrochloride, and a combination thereof, sucrose, and polysorbate 80.

In some embodiments, a formulation comprises, consists essentially of, or consists of etrolizumab, an amino acid selected from L-histidine and L-arginine, and a combination thereof, polysorbate 20, and succinic acid.

In some embodiments, a formulation comprises, consists essentially of, or consists of etrolizumab at a concentration of at least about 100 mg/mL, mannitol, and polysorbate 80. In one example, the formulation is liquid and contains water for injection.

In some embodiments, a formulation comprises, consists essentially of, or consists of etrolizumab, a buffer containing a negligible or non-detectable amount of sodium chloride, phosphate and citrate, a polyol such as mannitol, and a surfactant selected from a polysorbate and a poloxamer. In one example, the formulation has an antibody concentration of at least about 50 mg/mL, about 75 mg/mL, or about 100 mg/mL or greater, and low conductivity.

In some embodiments, a formulation comprises, consists essentially of, or consists of etrolizumab, sodium chloride, and an acetate such as sodium acetate.

In some embodiments, a formulation of etrolizumab is a liquid formulation comprising about 105 mg at a concentration of the antibody of about 150 mg/mL. Additional pharmaceutical formulations of etrolizumab are disclosed, for example, in PCT publication No. 2016/138207, the disclosure of which is incorporated herein by reference in its entirety.

Formulations Containing Golimumab

In some embodiments, a pharmaceutical formulation comprises golimumab. The formulation may be a liquid, semi-solid, or solid formulation. As used herein, the term "golimumab" includes antibody or monoclonal golimumab, any antigen-binding portion thereof, any glycosylation pattern variant thereof, and any biosimilar thereof.

Exemplary Dosage of Golimumab in Solid and Liquid Formulations

In some embodiments, golimumab is administered to a patient at a dose of about 20 mg, about 30 mg, about 40 mg, about 50 mg, about 60 mg, about 70 mg, about 80 mg, about 100 mg, about 150 mg, or about 200 mg. In some embodiments, a formulation of golimumab includes about 1 mg to about 500 mg, about 1 mg to about 100 mg, about 5 mg to about 40 mg, about 40 mg to about 80 mg, about 160 mg, about 80 mg or about 40 mg of golimumab. In some embodiments, the formulation contains an induction dose of about 160 mg of golimumab. In other embodiments, the formulation contains a maintenance dose of about 80 mg, about 40 mg, or about 40 mg to about 80 mg of golimumab.

In some embodiments, a liquid formulation of golimumab contains a high concentration of golimumab, including, for example, a concentration greater than about 45 mg/mL, greater than about 50 mg/mL, greater than about 100 mg/mL, greater than about 110 mg/mL, greater than about 125 mg/mL, greater than about 150 mg/mL, greater than about 175 mg/mL, or greater than about 200 mg/mL.

In some embodiments, the formulation of golimumab is a liquid, and the pH of the liquid formulation is from about 5 to about 8. In some embodiments, the liquid formulation includes a buffer. In some embodiments, the pH of the buffer, and/or the pH of the final liquid formulation containing the buffer, ranges from about 4 to about 8, from about 5 to about 8, from about 5 to about 7.5, from about 5 to about 7, from about 4.5 to about 6.0, from about 4.7 to about 5.7, from about 4.8 to about 5.5, or from about 5.0 to about 5.2.

Exemplary Formulations of Golimumab

In some embodiments, a formulation comprises, consists essentially of or consists of golimumab, sodium chloride, a buffer including sodium phosphate monobasic monohydrate, sodium phosphate dibasic heptahydrate, and polysorbate 80. In one example, the formulation is liquid and comprises water for injection.

In some embodiments, a formulation comprises, consists essentially of or consists of golimumab, a buffer which is optionally a phosphate or citrate buffer, and an excipient selected from a polyol (such as a sugar or sugar alcohol) and a non-ionic surfactant, such as a polysorbate. In one example, the formulation is liquid and contains water for injection. In another example, the formulation contains low levels of ionic excipients and has low conductivity.

In some embodiments, a formulation comprises, consists essentially of or consists of golimumab, sodium chloride, a buffer containing a phosphate such as sodium phosphate monobasic dihydrate, sodium phosphate dibasic dihydrate, or a combination thereof, L-arginine hydrochloride, and sucrose. In one example, the formulation is liquid and contains water for injection.

In some embodiments, a formulation comprises, consists essentially of or consists of golimumab, sodium chloride, a buffer containing a phosphate such as sodium phosphate monobasic dihydrate, sodium phosphate dibasic dihydrate, or a combination thereof, a citrate such as sodium citrate, citric acid monohydrate, or a combination thereof, mannitol, and polysorbate 80. In one example, the formulation is liquid and contains water for injection. In another example, the pH of the liquid formulation is adjusted with NaOH to about 5.2.

In some embodiments, a formulation comprises, consists essentially of or consists of golimumab, a buffer, which is optionally a phosphate or citrate buffer, a polyol selected from mannitol, sorbitol, sucrose, trehalose, raffinose, maltose, and a combination thereof, and a non-ionic surfactant selected from polysorbate 20, polysorbate 40, polysorbate 60, and polysorbate 80. In one example, the formulation contains low levels of ionic excipients and has low conductivity. In another example, concentration of the antibody in the formulation is at least about 10 mg/mL, about 50 mg/mL, about 100 mg/mL, about 150 mg/mL, about 200 mg/mL, or about 250 mg/mL.

In some embodiments, a formulation comprises, consists essentially of or consists of golimumab, a buffer containing a phosphate selected from monobasic sodium phosphate and dibasic sodium phosphate, sucrose, and polysorbate 80.

In some embodiments, a formulation comprises, consists essentially of or consists of golimumab, arginine, histidine, or a combination thereof, sucrose, and polysorbate 80. Optionally, the formulation further comprises a buffer. In one example, the formulation is a lyophilized powder.

In some embodiments, a formulation comprises, consists essentially of or consists of golimumab, a free amino acid selected from histidine, alanine, arginine, glycine, and glutamic acid, a polyol selected from mannitol, sorbitol, sucrose, trehalose, and a combination thereof, and a surfactant. Optionally, the formulation further comprises a buffer. In one example, the formulation is liquid. In another example, the formulation is solid (e.g., lyophilized powder for reconstitution).

In some embodiments, a formulation comprises, consists essentially of or consists of golimumab, an acetate salt, such as sodium acetate trihydrate, an amino acid which is histidine and/or a salt thereof, sorbitol, and a non-ionic surfactant such as polysorbate 80; optionally, the formulation further comprises arginine and/or a salt thereof. In one example, the formulation is liquid and comprises water for injection. In another example, pH of the liquid formulation is from about 5.1 to about 5.3. In yet another example, the formulation contains a negligible or non-detectable amount of sodium chloride. In yet another example, the formulation does not contain phosphate or citrate.

In some embodiments, a formulation comprises, consists essentially of or consists of golimumab, an amino acid selected from L-histidine, L-histidine monohydrochloride monohydrate, and a combination thereof, sorbitol and polysorbate 80. In one example, the formulation is liquid and comprises water for injection. In one particular embodiment, the formulation is SIMPONI® 50 mg solution for injection (e.g., the solution as commercially provided in pre-filled syringes).

In some embodiments, a formulation comprises, consists essentially of or consists of golimumab, an amino acid selected from L-histidine, L-histidine monohydrochloride monohydrate, L-methionine, and a combination thereof, sucrose, and polysorbate 80. In one example, the formulation also contains a metal chelating agent such as EDTA disodium salt dihydrate. In another example, the formulation is liquid and contains water for injection.

In some embodiments, a formulation comprises, consists essentially of or consists of golimumab, an amino acid selected from L-histidine, L-histidine monohydrochloride monohydrate, L-arginine hydrochloride, and a combination thereof, sucrose, and polysorbate 80.

In some embodiments, a formulation comprises, consists essentially of or consists of golimumab, an amino acid selected from L-histidine and L-arginine, and a combination thereof, polysorbate 20, and succinic acid.

In some embodiments, a formulation comprises, consists essentially of or consists of golimumab at a concentration of at least about 100 mg/mL, mannitol, and polysorbate 80. In one example, the formulation is liquid and contains water for injection.

In some embodiments, a formulation comprises, consists essentially of or consists of golimumab, a buffer containing a negligible or non-detectable amount of sodium chloride, phosphate and citrate, a polyol such as mannitol, and a surfactant selected from a polysorbate and a poloxamer. In one example, the formulation has an antibody concentration of at least about 50 mg/mL, about 75 mg/mL, or about 100 mg/mL or greater, and low conductivity.

In some embodiments, a formulation comprises about 50 mg of the golimumab antibody, about 0.44 mg of L-histidine and L-histidine monohydrochloride monohydrate, about 20.5 mg of sorbitol, about 0.08 mg of polysorbate 80, and water for injection. In some embodiments, the formulation is liquid and the pH of the formulation is about 5.5. In some embodiments, the formulation is a solid lyophilized powder. In some embodiments, neither the liquid nor the solid formulation contains preservatives.

In some embodiments, a formulation comprises about 100 mg of the golimumab antibody, about 0.87 mg of L-histidine and L-histidine monohydrochloride monohydrate, about 41.0 mg of sorbitol, about 0.15 mg of polysorbate 80, and water for injection. In some embodiments, the formulation is liquid and the pH of the formulation is about 5.5. In some embodiments, the formulation is a solid lyophilized powder. In some embodiments, neither the liquid nor the solid formulation contains preservatives.

In some embodiments, a single container (e.g., a device as described herein) comprises about 50 mg or about 100 mg of golimumab, sorbitol, L-histidine, L-histidine monohydrochloride monohydrate, and polysorbate 80.

Additional pharmaceutical formulations of golimumab are disclosed, for example, in US Publication Nos. 2011/0014189, 2012/0263731, 2014/0127227, 2016/0287525, and 2017/0273909; U.S. Pat. Nos. 8,226,949 and 8,420,081; and PCT Publication Nos. 2017/106595 and 2018/067987, the disclosures of each of which are incorporated herein by reference in their entirety.

Formulations Containing Certolizumab Pegol

In some embodiments, a pharmaceutical formulation includes certolizumab pegol. The formulation may be a liquid, semi-solid, or solid formulation. As used herein, the term "certolizumab pegol" includes antibody or monoclonal certolizumab pegol, any antigen-binding portion thereof, any glycosylation pattern variant thereof, and any biosimilar thereof.

Exemplary Dosage of Certolizumab Pegol in Solid and Liquid Formulations

In some embodiments, certolizumab pegol is administered at a dose of about 50 mg, about 60 mg, about 70 mg, about 80 mg, about 100 mg, about 150 mg, about 200 mg, about 250 mg, about 400 mg, about 500 mg, about 600 mg, about 800 mg, or about 1000 mg. In some embodiments, a formulation of certolizumab pegol includes about 1 mg to about 500 mg, about 1 mg to about 100 mg, about 5 mg to about 40 mg, about 40 mg to about 80 mg, about 160 mg, about 80 mg or about 40 mg of certolizumab pegol. In some embodiments, the formulation contains an induction dose of about 160 mg of certolizumab pegol. In other embodiments, the formulation contains a maintenance dose of about 80 mg, about 40 mg, or about 40 mg to about 80 mg of certolizumab pegol.

In some embodiments, the formulation is liquid and the concentration of certolizumab pegol in the formulation is about 200 mg/mL. In some embodiments, a single dosage form (e.g., a device as described herein) comprises about 200 mg of a liquid formulation comprising about 200 mg/mL concentration of certolizumab pegol. In some embodiments, an effective dose of certolizumab pegol is about 10-20 mg/kg.

In some embodiments, a liquid formulation of certolizumab pegol contains a high concentration of certolizumab pegol, including, for example, a concentration greater than about 45 mg/mL, greater than about 50 mg/mL, greater than about 100 mg/mL, greater than about 110 mg/mL, greater than about 125 mg/mL, greater than about 150 mg/mL, greater than about 175 mg/mL, or greater than about 200 mg/mL.

In some embodiments, the formulation of certolizumab pegol is a liquid, and the pH of the liquid formulation is from about 5 to about 8. In some embodiments, the liquid formulation includes a buffer. In some embodiments, the pH of the buffer, and/or the pH of the final liquid formulation containing the buffer, ranges from about 4 to about 8, from about 5 to about 8, from about 5 to about 7.5, from about 5 to about 7, from about 4.5 to about 6.0, from about 4.7 to about 5.7, from about 4.8 to about 5.5, or from about 5.0 to about 5.2.

Exemplary Formulations of Certolizumab Pegol

In some embodiments, a formulation comprises, consists essentially of or consists of certolizumab pegol, sodium chloride, a buffer including sodium phosphate monobasic monohydrate, sodium phosphate dibasic heptahydrate, and polysorbate 80. In one example, the formulation is liquid and comprises water for injection.

In some embodiments, a formulation comprises, consists essentially of or consists of certolizumab pegol, a buffer which is optionally a phosphate or citrate buffer, and an excipient selected from a polyol (such as a sugar or sugar alcohol) and a non-ionic surfactant, such as a polysorbate. In one example, the formulation is liquid and contains water for injection. In another example, the formulation contains low levels of ionic excipients and has low conductivity.

In some embodiments, a formulation comprises, consists essentially of or consists of certolizumab pegol, sodium chloride, a buffer containing a phosphate such as sodium phosphate monobasic dihydrate, sodium phosphate dibasic dihydrate, or a combination thereof, L-arginine hydrochloride, and sucrose. In one example, the formulation is liquid and contains water for injection.

In some embodiments, a formulation comprises, consists essentially of or consists of certolizumab pegol, sodium chloride, a buffer containing a phosphate such as sodium phosphate monobasic dihydrate, sodium phosphate dibasic dihydrate, or a combination thereof, a citrate such as sodium citrate, citric acid monohydrate, or a combination thereof, mannitol, and polysorbate 80. In one example, the formulation is liquid and contains water for injection. In another example, the pH of the liquid formulation is adjusted with NaOH to about 5.2.

In some embodiments, a formulation comprises, consists essentially of or consists of certolizumab pegol, a buffer, which is optionally a phosphate or citrate buffer, a polyol selected from mannitol, sorbitol, sucrose, trehalose, raffinose, maltose, and a combination thereof, and a non-ionic surfactant selected from polysorbate 20, polysorbate 40, polysorbate 60, and polysorbate 80. In one example, the formulation contains low levels of ionic excipients and has low conductivity. In another example, the concentration of the antibody in the formulation is at least about 10 mg/mL, about 50 mg/mL, about 100 mg/mL, about 150 mg/mL, about 200 mg/mL, or about 250 mg/mL.

In some embodiments, a formulation comprises, consists essentially of or consists of certolizumab pegol, a buffer containing a phosphate selected from monobasic sodium phosphate and dibasic sodium phosphate, sucrose, and polysorbate 80.

In some embodiments, a formulation comprises, consists essentially of or consists of certolizumab pegol, arginine, histidine, or a combination thereof, sucrose, and polysorbate 80. Optionally, the formulation further comprises a buffer. In one example, the formulation is a lyophilized powder.

In some embodiments, a formulation comprises, consists essentially of or consists of certolizumab pegol, a free amino acid selected from histidine, alanine, arginine, glycine, and glutamic acid, a polyol selected from mannitol, sorbitol, sucrose, trehalose, and a combination thereof, and a surfactant. Optionally, the formulation further comprises a buffer. In one example, the formulation is liquid. In another example, the formulation is solid (e.g., lyophilized powder for reconstitution).

In some embodiments, a formulation comprises, consists essentially of or consists of certolizumab pegol, an acetate salt, such as sodium acetate trihydrate, an amino acid which is histidine and/or a salt thereof, sorbitol, and a non-ionic surfactant such as polysorbate 80; optionally, the formulation further comprises arginine and/or a salt thereof. In one example, the formulation is liquid and comprises water for injection. In another example, the pH of the liquid formulation is from about 5.1 to about 5.3. In yet another example, the formulation contains a negligible or non-detectable amount of sodium chloride. In yet another example, the formulation does not contain phosphate or citrate.

In some embodiments, a formulation comprises, consists essentially of or consists of certolizumab pegol, an amino acid selected from L-histidine, L-histidine monohydrochloride monohydrate, and a combination thereof, sorbitol and polysorbate 80. In one example, the formulation is liquid and comprises water for injection.

In some embodiments, a formulation comprises, consists essentially of or consists of certolizumab pegol, an amino acid selected from L-histidine, L-histidine monohydrochloride monohydrate, L-methionine, and a combination thereof, sucrose, and polysorbate 80. In one example, the formulation also contains a metal chelating agent such as EDTA disodium salt dihydrate. In another example, the formulation is liquid and contains water for injection.

In some embodiments, a formulation comprises, consists essentially of or consists of certolizumab pegol, an amino acid selected from L-histidine, L-histidine monohydrochloride monohydrate, L-arginine hydrochloride, and a combination thereof, sucrose, and polysorbate 80.

In some embodiments, a formulation comprises, consists essentially of or consists of certolizumab pegol, an amino acid selected from L-histidine and L-arginine, and a combination thereof, polysorbate 20, and succinic acid.

In some embodiments, a formulation comprises, consists essentially of or consists of certolizumab pegol at a concentration of at least about 100 mg/mL, mannitol, and polysorbate 80. In one example, the formulation is liquid and contains water for injection.

In some embodiments, a formulation comprises, consists essentially of or consists of certolizumab pegol, a buffer containing a negligible or non-detectable amount of sodium chloride, phosphate and citrate, a polyol such as mannitol, and a surfactant selected from a polysorbate and a poloxamer. In one example, the formulation has an antibody concentration of at least about 50 mg/mL, about 75 mg/mL, or about 100 mg/mL or greater, and low conductivity.

In some embodiments, a formulation comprises, consists essentially of or consists of certolizumab pegol, sodium chloride, and an acetate such as sodium acetate. In one particular embodiment, the formulation is CIMZIA®.

In some embodiments, a formulation comprises about 200 mg certolizumab pegol, about 0.9 mg lactic acid, about 0.1 mg polysorbate, and about 100 mg sucrose. In some embodiments, the formulation is liquid and the pH of the formulation is about 5.2. In some embodiments, the formulation is a solid lyophilized powder. In some embodiments, a formulation is a liquid formulation which comprises about 200 mg certolizumab pegol, about 1.36 mg sodium acetate, about 7.31 mg sodium chloride, and water for injection. In some embodiments, the pH of the formulation is about 4.7.

Formulations Containing Ustekinumab

In some embodiments, a pharmaceutical formulation comprises ustekinumab. The formulation may be a liquid, semi-solid, or solid formulation. As used herein, the term "ustekinumab" includes antibody or monoclonal ustekinumab, any antigen-binding portion thereof, any glycosylation pattern variant thereof, and any biosimilar thereof.

Exemplary Dosages of Ustekinumab in Solid and Liquid Formulations

In some embodiments, ustekinumab is administered at a dose of about 20 mg, about 30 mg, about 40 mg, about 45 mg, about 50 mg, about 60 mg, about 70 mg, about 80 mg, about 90 mg, about 100 mg, about 130 mg, about 150 mg, about 200 mg, about 260 mg, about 300 mg, 390 mg, about 500 mg, about 520 mg, or about 600 mg. In some embodiments, a formulation of ustekinumab includes about 1 mg to about 650 mg, about 1 mg to about 600 mg, about 1 mg to about 500 mg, about 1 mg to about 100 mg, or about 5 mg to about 40 mg of ustekinumab.

In some embodiments, the formulation is liquid and the concentration of ustekinumab in the formulation is from about 5 mg/mL to about 90 mg/mL. In some embodiments, a single dosage form (e.g., a device as described herein) comprises about 130 mg of a liquid formulation comprising about 5 mg/mL concentration of ustekinumab. In some embodiments, an effective dose of ustekinumab can be about 1-50 mg/kg. In some embodiments, an effective dose of ustekinumab can be about 6 mg/kg.

In some embodiments, a liquid formulation of ustekinumab contains a high concentration of ustekinumab, including, for example, a concentration greater than about 45 mg/mL, greater than about 50 mg/mL, greater than about 100 mg/mL, greater than about 110 mg/mL, greater than about 125 mg/mL, greater than about 150 mg/mL, greater than about 175 mg/mL, or greater than about 200 mg/mL.

In some embodiments, the formulation of ustekinumab is a liquid, and the pH of the liquid formulation is from about 5 to about 8. In some embodiments, the liquid formulation includes a buffer. In some embodiments, the pH of the buffer, and/or the pH of the final liquid formulation containing the buffer, ranges from about 4 to about 8, from about 5 to about 8, from about 5 to about 7.5, from about 5 to about 7, from about 4.5 to about 6.0, from about 4.7 to about 5.7, from about 4.8 to about 5.5, or from about 5.0 to about 5.2.

Exemplary Formulations of Ustekinumab

In some embodiments, a formulation comprises, consists essentially of or consists of ustekinumab, sodium chloride, a buffer including sodium phosphate monobasic monohydrate, sodium phosphate dibasic heptahydrate, and polysorbate 80. In one example, the formulation is liquid and comprises water for injection.

In some embodiments, a formulation comprises, consists essentially of or consists of ustekinumab, a buffer which is optionally a phosphate or citrate buffer, and an excipient selected from a polyol (such as a sugar or sugar alcohol) and a non-ionic surfactant, such as a polysorbate. In one example, the formulation is liquid and contains water for injection. In another example, the formulation contains low levels of ionic excipients and has low conductivity.

In some embodiments, a formulation comprises, consists essentially of or consists of ustekinumab, sodium chloride, a buffer containing a phosphate such as sodium phosphate monobasic dihydrate, sodium phosphate dibasic dihydrate, or a combination thereof, L-arginine hydrochloride, and sucrose. In one example, the formulation is liquid and contains water for injection.

In some embodiments, a formulation comprises, consists essentially of or consists of ustekinumab, sodium chloride, a buffer containing a phosphate such as sodium phosphate monobasic dihydrate, sodium phosphate dibasic dihydrate, or a combination thereof, a citrate such as sodium citrate, citric acid monohydrate, or a combination thereof, mannitol, and polysorbate 80. In one example, the formulation is liquid and contains water for injection. In another example, the pH of the liquid formulation is adjusted with NaOH to about 5.2.

In some embodiments, a formulation comprises, consists essentially of or consists of ustekinumab, a buffer, which is optionally a phosphate or citrate buffer, a polyol selected from mannitol, sorbitol, sucrose, trehalose, raffinose, maltose, and a combination thereof, and a non-ionic surfactant selected from polysorbate 20, polysorbate 40, polysorbate 60, and polysorbate 80. In one example, the formulation contains low levels of ionic excipients and has low conductivity. In another example, the concentration of the antibody in the formulation is at least about 10 mg/mL, about 50 mg/mL, about 100 mg/mL, about 150 mg/mL, about 200 mg/mL, or about 250 mg/mL.

In some embodiments, a formulation comprises, consists essentially of or consists of ustekinumab, a buffer containing a phosphate selected from monobasic sodium phosphate and dibasic sodium phosphate, sucrose, and polysorbate 80.

In some embodiments, a formulation comprises, consists essentially of or consists of ustekinumab, arginine, histidine, or a combination thereof, sucrose, and polysorbate 80. Optionally, the formulation further comprises a buffer. In one example, the formulation is a lyophilized powder.

In some embodiments, a formulation comprises, consists essentially of or consists of ustekinumab, a free amino acid selected from histidine, alanine, arginine, glycine, and glutamic acid, a polyol selected from mannitol, sorbitol, sucrose, trehalose, and a combination thereof, and a surfactant. Optionally, the formulation further comprises a buffer. In one example, the formulation is liquid. In another example, the formulation is solid (e.g., lyophilized powder for reconstitution).

In some embodiments, a formulation comprises, consists essentially of or consists of ustekinumab, an acetate salt, such as sodium acetate trihydrate, an amino acid which is histidine and/or a salt thereof, sorbitol, and a non-ionic surfactant such as polysorbate 80; optionally, the formulation further comprises arginine and/or a salt thereof. In one example, the formulation is liquid and comprises water for injection. In another example, the pH of the liquid formulation is from about 5.1 to about 5.3. In yet another example, the formulation contains a negligible or non-detectable amount of sodium chloride. In yet another example, the formulation does not contain phosphate or citrate.

In some embodiments, a formulation comprises, consists essentially of or consists of ustekinumab, an amino acid selected from L-histidine, L-histidine monohydrochloride monohydrate, and a combination thereof, sorbitol and polysorbate 80. In one example, the formulation is liquid and comprises water for injection.

In some embodiments, a formulation comprises, consists essentially of or consists of ustekinumab, an amino acid selected from L-histidine, L-histidine monohydrochloride monohydrate, L-methionine, and a combination thereof, sucrose, and polysorbate 80. In one example, the formulation also contains a metal chelating agent such as EDTA disodium salt dihydrate. In another example, the formulation is liquid and contains water for injection. In one particular embodiment, the formulation is STELARA®.

In some embodiments, a formulation comprises, consists essentially of or consists of ustekinumab, an amino acid selected from L-histidine, L-histidine monohydrochloride monohydrate, L-arginine hydrochloride, and a combination thereof, sucrose, and polysorbate 80.

In some embodiments, a formulation comprises, consists essentially of or consists of ustekinumab, an amino acid selected from L-histidine and L-arginine, and a combination thereof, polysorbate 20, and succinic acid.

In some embodiments, a formulation comprises, consists essentially of or consists of ustekinumab at a concentration of at least about 100 mg/mL, mannitol, and polysorbate 80. In one example, the formulation is liquid and contains water for injection.

In some embodiments, a formulation comprises, consists essentially of or consists of ustekinumab, a buffer containing a negligible or non-detectable amount of sodium chloride, phosphate and citrate, a polyol such as mannitol, and a surfactant selected from a polysorbate and a poloxamer. In one example, the formulation has an antibody concentration of at least about 50 mg/mL, about 75 mg/mL, or about 100 mg/mL or greater, and low conductivity.

In some embodiments, a formulation comprises, consists essentially of or consists of ustekinumab, sodium chloride, and an acetate such as sodium acetate.

In some embodiments, each 0.5 mL of a liquid formulation of ustekinumab comprises about 45 mg ustekinumab, about 0.5 mg of L-histidine and L-histidine monohydrochloride monohydrate, about 0.02 mg of polysorbate 80, and about 38 mg of sucrose.

In some embodiments, each 1 mL of a liquid formulation of ustekinumab comprises about 90 mg ustekinumab, about 1 mg of L-histidine and L-histidine monohydrochloride monohydrate, about 0.04 mg of polysorbate 80, and about 76 mg of sucrose.

In some embodiments, a formulation of ustekinumab comprises about 130 mg of ustekinumab, about 0.52 mg of EDTA disodium salt dihydrate, about 20 mg of L-histidine, about 27 mg of L-histidine hydrochloride monohydrate, about 10.4 mg of L-methionine, about 10.4 mg of polysorbate 80 and about 2210 mg of sucrose. In some embodiments, the formulation is liquid. In others, the formulation is a solid lyophilized powder.

In some embodiments, a formulation of ustekinumab comprises about 130 mg, about 260 mg, about 390 mg, or about 520 mg of ustekinumab, L-histidine, L-histidine monohydrochloride monohydrate, L-methionine, polysorbate 80, and sucrose. In one example, when the formulation is a liquid formulation, the formulation comprises water for injection.

Formulations Containing Risankizumab

In some embodiments, a pharmaceutical formulation comprises risankizumab. The formulation may be a liquid, semi-solid, or solid formulation. As used herein, the term "risankizumab" includes antibody or monoclonal risankizumab, any antigen-binding portion thereof, any glycosylation pattern variant thereof, and any biosimilar thereof.

Exemplary Dosages of Risankizumab in Solid and Liquid Formulations

In some embodiments, risankizumab is administered at a dose of about 15 mg, about 18 mg, about 20 mg, about 30 mg, about 36 mg, about 40 mg, about 50 mg, about 60 mg, about 70 mg, about 80 mg, about 90 mg, about 100 mg, about 130 mg, about 150 mg, about 200 mg, or about 500 mg. In some embodiments, a formulation of risankizumab includes about 1 mg to about 650 mg, about 1 mg to about 600 mg, about 1 mg to about 500 mg, about 1 mg to about 100 mg, or about 5 mg to about 40 mg of risankizumab.

In some embodiments, a liquid formulation of risankizumab contains a high concentration of risankizumab, including, for example, a concentration greater than about 45 mg/mL, greater than about 50 mg/mL, greater than about 100 mg/mL, greater than about 110 mg/mL, greater than about 125 mg/mL, greater than about 150 mg/mL, greater than about 175 mg/mL, or greater than about 200 mg/mL.

In some embodiments, the formulation of risankizumab is a liquid, and the pH of the liquid formulation is from about 5 to about 8. In some embodiments, the liquid formulation includes a buffer. In some embodiments, the pH of the buffer, and/or the pH of the final liquid formulation containing the buffer, ranges from about 4 to about 8, from about 5 to about 8, from about 5 to about 7.5, from about 5 to about 7, from about 4.5 to about 6.0, from about 4.7 to about 5.7, from about 4.8 to about 5.5, or from about 5.0 to about 5.2.

Exemplary Formulations of Risankizumab

In some embodiments, a formulation comprises, consists essentially of or consists of risankizumab, sodium chloride, a buffer including sodium phosphate monobasic monohydrate, sodium phosphate dibasic heptahydrate, and polysorbate 80. In one example, the formulation is liquid and comprises water for injection.

In some embodiments, a formulation comprises, consists essentially of or consists of risankizumab, a buffer which is optionally a phosphate or citrate buffer, and an excipient selected from a polyol (such as a sugar or sugar alcohol) and a non-ionic surfactant, such as a polysorbate. In one example, the formulation is liquid and contains water for injection. In another example, the formulation contains low levels of ionic excipients and has low conductivity.

In some embodiments, a formulation comprises, consists essentially of or consists of risankizumab, sodium chloride, a buffer containing a phosphate such as sodium phosphate monobasic dihydrate, sodium phosphate dibasic dihydrate, or a combination thereof, L-arginine hydrochloride, and sucrose. In one example, the formulation is liquid and contains water for injection.

In some embodiments, a formulation comprises, consists essentially of or consists of risankizumab, sodium chloride, a buffer containing a phosphate such as sodium phosphate monobasic dihydrate, sodium phosphate dibasic dihydrate, or a combination thereof, a citrate such as sodium citrate, citric acid monohydrate, or a combination thereof, mannitol, and polysorbate 80. In one example, the formulation is liquid and contains water for injection. In another example, the pH of the liquid formulation is adjusted with NaOH to about 5.2.

In some embodiments, a formulation comprises, consists essentially of or consists of risankizumab, a buffer, which is optionally a phosphate or citrate buffer, a polyol selected from mannitol, sorbitol, sucrose, trehalose, raffinose, maltose, and a combination thereof, and a non-ionic surfactant selected from polysorbate 20, polysorbate 40, polysorbate 60, and polysorbate 80. In one example, the formulation contains low levels of ionic excipients and has low conductivity. In another example, concentration of the antibody in the formulation is at least about 10 mg/mL, about 50 mg/mL., about 100 mg/mL, about 150 mg/mL, about 200 mg/mL, or about 250 mg/mL.

In some embodiments, a formulation comprises, consists essentially of or consists of risankizumab, a buffer containing a phosphate selected from monobasic sodium phosphate and dibasic sodium phosphate, sucrose, and polysorbate 80.

In some embodiments, a formulation comprises, consists essentially of or consists of risankizumab, arginine, histidine, or a combination thereof, sucrose, and polysorbate 80. Optionally, the formulation further comprises a buffer. In one example, the formulation is a lyophilized powder.

In some embodiments, a formulation comprises, consists essentially of or consists of risankizumab, a free amino acid selected from histidine, alanine, arginine, glycine, and glutamic acid, a polyol selected from mannitol, sorbitol, sucrose, trehalose, and a combination thereof, and a surfactant. Optionally, the formulation further comprises a buffer. In one example, the formulation is liquid. In another example, the formulation is solid (e.g., lyophilized powder for reconstitution).

In some embodiments, a formulation comprises, consists essentially of or consists of risankizumab, an acetate salt, such as sodium acetate trihydrate, an amino acid which is histidine and/or a salt thereof, sorbitol, and a non-ionic surfactant such as polysorbate 80; optionally, the formulation further comprises arginine and/or a salt thereof. In one example, the formulation is liquid and comprises water for injection. In another example, the pH of the liquid formulation is from about 5.1 to about 5.3. In yet another example, the formulation contains a negligible or non-detectable amount of sodium chloride. In yet another example, the formulation does not contain phosphate or citrate.

In some embodiments, a formulation comprises, consists essentially of or consists of risankizumab, an amino acid selected from L-histidine, L-histidine monohydrochloride monohydrate, and a combination thereof, sorbitol and polysorbate 80. In one example, the formulation is liquid and comprises water for injection.

In some embodiments, a formulation comprises, consists essentially of or consists of risankizumab, an amino acid selected from L-histidine, L-histidine monohydrochloride monohydrate, L-methionine, and a combination thereof, sucrose, and polysorbate 80. In one example, the formulation also contains a metal chelating agent such as EDTA disodium salt dihydrate. In another example, the formulation is liquid and contains water for injection.

In some embodiments, a formulation comprises, consists essentially of or consists of risankizumab, an amino acid selected from L-histidine, L-histidine monohydrochloride monohydrate, L-arginine hydrochloride, and a combination thereof, sucrose, and polysorbate 80.

In some embodiments, a formulation comprises, consists essentially of or consists of risankizumab, an amino acid selected from L-histidine and L-arginine, and a combination thereof, polysorbate 20, and succinic acid.

In some embodiments, a formulation comprises, consists essentially of or consists of risankizumab at a concentration of at least about 100 mg/mL, mannitol, and polysorbate 80. In one example, the formulation is liquid and contains water for injection.

In some embodiments, a formulation comprises, consists essentially of or consists of risankizumab, a buffer containing a negligible or non-detectable amount of sodium chloride, phosphate and citrate, a polyol such as mannitol, and a surfactant selected from a polysorbate and a poloxamer. In one example, the formulation has an antibody concentration of at least about 50 mg/mL, about 75 mg/mL, or about 100 mg/mL or greater, and low conductivity.

In some embodiments, a formulation comprises, consists essentially of or consists of risankizumab, sodium chloride, and an acetate such as sodium acetate.

Formulations Containing Etanercept

In some embodiments, a pharmaceutical formulation comprises etanercept. The formulation may be a liquid, semi-solid, or solid formulation. As used herein, the term "etanercept" includes antibody or monoclonal etanercept, any antigen-binding portion thereof, any glycosylation pattern variant thereof, and any biosimilar thereof.

Exemplary Dosages of Etanercept in Solid and Liquid Formulations

In some embodiments, etanercept is administered to a patient at a dose of about 5 mg, about 10 mg, about 15 mg, about 20 mg, about 25 mg, about 30 mg, about 40 mg, about 50 mg, about 60 mg, about 70 mg, about 80 mg, about 90 mg, or about 100 mg.

In some embodiments, a formulation of etanercept includes about 1 mg to about 500 mg, about 1 mg to about 100 mg, about 5 mg to about 40 mg, about 40 mg to about 80 mg, about 160 mg, about 80 mg or about 40 mg of etanercept. In some embodiments, the formulation contains an induction dose of about 160 mg of etanercept. In other embodiments, the formulation contains a maintenance dose of about 80 mg, about 40 mg, or about 40 mg to about 80 mg of etanercept.

In some embodiments, when the formulation is liquid, the formulation comprises about 10 mg, about 25 mg, or about 50 mg of etanercept at a concentration of about 50 mg/mL.

In some embodiments, a liquid formulation of etanercept contains a high concentration of etanercept, including, for example, a concentration greater than about 45 mg/mL, greater than about 50 mg/mL, greater than about 100 mg/mL, greater than about 110 mg/mL, greater than about 125 mg/mL, greater than about 150 mg/mL, greater than about 175 mg/mL, or greater than about 200 mg/mL.

In some embodiments, the formulation of etanercept is a liquid, and the pH of the liquid formulation is from about 5 to about 8. In some embodiments, the liquid formulation includes a buffer. In some embodiments, the pH of the buffer, and/or the pH of the final liquid formulation containing the buffer, ranges from about 4 to about 8, from about 5 to about 8, from about 5 to about 7.5, from about 5 to about 7, from about 4.5 to about 6.0, from about 4.7 to about 5.7, from about 4.8 to about 5.5, or from about 5.0 to about 5.2.

Exemplary Formulations of Etanercept

In some embodiments, a formulation comprises, consists essentially of or consists of etanercept, sodium chloride, a buffer including sodium phosphate monobasic monohydrate, sodium phosphate dibasic heptahydrate, and polysorbate 80. In one example, the formulation is liquid and comprises water for injection.

In some embodiments, a formulation comprises, consists essentially of or consists of etanercept, a buffer which is optionally a phosphate or citrate buffer, and an excipient selected from a polyol (such as a sugar or sugar alcohol) and a non-ionic surfactant, such as a polysorbate. In one example, the formulation is liquid and contains water for injection. In another example, the formulation contains low levels of ionic excipients and has low conductivity.

In some embodiments, a formulation comprises, consists essentially of or consists of etanercept, sodium chloride, a buffer containing a phosphate such as sodium phosphate monobasic dihydrate, sodium phosphate dibasic dihydrate, or a combination thereof, L-arginine hydrochloride, and sucrose. In one example, the formulation is liquid and contains water for injection. In one particular embodiment, the formulation is ENBREL®.

In some embodiments, a formulation comprises, consists essentially of or consists of etanercept, sodium chloride, a buffer containing a phosphate such as sodium phosphate monobasic dihydrate, sodium phosphate dibasic dihydrate, or a combination thereof, a citrate such as sodium citrate, citric acid monohydrate, or a combination thereof, mannitol, and polysorbate 80. In one example, the formulation is liquid and contains water for injection. In another example, the pH of the liquid formulation is adjusted with NaOH to about 5.2.

In some embodiments, a formulation comprises, consists essentially of or consists of etanercept, a buffer, which is optionally a phosphate or citrate buffer, a polyol selected from mannitol, sorbitol, sucrose, trehalose, raffinose, maltose, and a combination thereof, and a non-ionic surfactant selected from polysorbate 20, polysorbate 40, polysorbate 60, and polysorbate 80. In one example, the formulation contains low levels of ionic excipients and has low conductivity. In another example, the concentration of the antibody in the formulation is at least about 10 mg/mL, about 50 mg/mL, about 100 mg/mL, about 150 mg/mL, about 200 mg/mL, or about 250 mg/mL.

In some embodiments, a formulation comprises, consists essentially of or consists of etanercept, a buffer containing a phosphate selected from monobasic sodium phosphate and dibasic sodium phosphate, sucrose, and polysorbate 80.

In some embodiments, a formulation comprises, consists essentially of or consists of etanercept, arginine, histidine, or a combination thereof, sucrose, and polysorbate 80. Optionally, the formulation further comprises a buffer. In one example, the formulation is a lyophilized powder.

In some embodiments, a formulation comprises, consists essentially of or consists of etanercept, a free amino acid selected from histidine, alanine, arginine, glycine, and glutamic acid, a polyol selected from mannitol, sorbitol, sucrose, trehalose, and a combination thereof, and a surfactant. Optionally, the formulation further comprises a buffer. In one example, the formulation is liquid. In another example, the formulation is solid (e.g., lyophilized powder for reconstitution).

In some embodiments, a formulation comprises, consists essentially of or consists of etanercept, an acetate salt, such as sodium acetate trihydrate, an amino acid which is histidine and/or a salt thereof, sorbitol, and a non-ionic surfactant such as polysorbate 80; optionally, the formulation further comprises arginine and/or a salt thereof. In one example, the formulation is liquid and comprises water for injection. In another example, the pH of the liquid formulation is from about 5.1 to about 5.3. In yet another example, the formulation contains a negligible or non-detectable amount of sodium chloride. In yet another example, the formulation does not contain phosphate or citrate.

In some embodiments, a formulation comprises, consists essentially of or consists of etanercept, an amino acid selected from L-histidine, L-histidine monohydrochloride monohydrate, and a combination thereof, sorbitol and polysorbate 80. In one example, the formulation is liquid and comprises water for injection.

In some embodiments, a formulation comprises, consists essentially of or consists of etanercept, an amino acid selected from L-histidine, L-histidine monohydrochloride monohydrate, L-methionine, and a combination thereof, sucrose, and polysorbate 80. In one example, the formulation also contains a metal chelating agent such as EDTA disodium salt dihydrate. In another example, the formulation is liquid and contains water for injection.

In some embodiments, a formulation comprises, consists essentially of or consists of etanercept, an amino acid selected from L-histidine, L-histidine monohydrochloride monohydrate, L-arginine hydrochloride, and a combination thereof, sucrose, and polysorbate 80.

In some embodiments, a formulation comprises, consists essentially of or consists of etanercept, an amino acid selected from L-histidine and L-arginine, and a combination thereof, polysorbate 20, and succinic acid.

In some embodiments, a formulation comprises, consists essentially of or consists of etanercept at a concentration of at least about 100 mg/mL, mannitol, and polysorbate 80. In one example, the formulation is liquid and contains water for injection.

In some embodiments, a formulation comprises, consists essentially of or consists of etanercept, a buffer containing a negligible or non-detectable amount of sodium chloride, phosphate and citrate, a polyol such as mannitol, and a surfactant selected from a polysorbate and a poloxamer. In one example, the formulation has an antibody concentration of at least about 50 mg/mL, about 75 mg/mL, or about 100 mg/mL or greater, and low conductivity.

In some embodiments, a formulation comprises, consists essentially of or consists of etanercept, sodium chloride, and an acetate such as sodium acetate.

In some embodiments, a liquid formulation of etanercept comprises from about 25 to about 50 mg/mL of etanercept, about 25 mM L-arginine, about 25 mM sodium phosphate, about 100 mM sodium chloride, and about 1% sucrose. In some embodiments, the pH of the formulation is about 6.0 to about 7.0.

In some embodiments, a liquid formulation comprises from about 10 mg/mL to about 100 mg/mL of etanercept, and further comprises L-arginine, sodium phosphate, sodium chloride and sucrose.

In some embodiments, a liquid formulation comprises from about 10 mg/mL to about 100 mg/mL etanercept, from about 10 mM to about 75 mM of L-arginine, from about 5 mM to about 100 mM of sodium phosphate, from about 5 mM to about 200 mM of sodium chloride, from about 0.5% to about 1.5% of sucrose. In some embodiments, the pH of the formulation is from about 5.5 to about 7.8.

In some embodiments, a liquid formulation comprises from about 25 mg to about 50 mg of etanercept, from about 10 mM to about 100 mM of L-arginine, from about 10 mM to about 50 mM of sodium phosphate, from about 0.75% to about 1.25% of sucrose, from about 50 mM to about 150 mM of NaCl, and the pH of the formulation is from about 6.0 to about 7.0.

In some embodiments, a liquid formulation comprises about 50 mg etanercept, about 1% sucrose, about 100 mM sodium chloride, about 25 mM L-arginine hydrochloride, and about 25 mM sodium phosphate.

In some embodiments, a liquid formulation comprises about 25 mg etanercept, about 1% sucrose, about 100 mM sodium chloride, about 25 mM L-arginine hydrochloride, and about 25 mM sodium phosphate.

In some embodiments, a formulation comprises about 25 mg etanercept, about 40 mg mannitol, about 10 mg sucrose, and about 1.2 mg tromethamine. In one example, the formulation is a liquid formulation or a solid (e.g., lyophilized cake) formulation.

In some embodiments, a formulation of etanercept comprises about 10 mg, about 25 mg, or about 50 mg of etanercept, mannitol, sucrose, and tromethamine. In some embodiments, when the formulation is a liquid formulation, the formulation also comprises water for injection.

In some embodiments, a formulation of etanercept comprises about 10 mg, about 25 mg, or about 50 mg of etanercept, sucrose, sodium chloride, L-arginine hydrochloride, sodium phosphate monobasic dihydrate, and sodium phosphate dibasic dihydrate. In other embodiments, when the formulation is a liquid formulation, the formulation also comprises water for injection.

Additional pharmaceutical formulations of etanercept are disclosed, for example, in U.S. Pat. Nos. 7,648,702, 8,163, 522, and 8,063,182; and EP U.S. Pat. No. 1,478,394, the disclosures of each of which are incorporated herein by reference in their entireties.

Additional pharmaceutical formulations of etanercept are disclosed, for example, in U.S. Pat. Nos. 7,648,702; 8,163, 522; and 8,063,182; and EP U.S. Pat. No. 1,478,394, the disclosures of each of which are incorporated herein by reference in their entireties.

Formulations Containing Brazikumab

In some embodiments, a pharmaceutical formulation comprises brazikumab. The formulation may be a liquid, semi-solid, or solid formulation. As used herein, the term "brazikumab" includes antibody or monoclonal brazikumab, any antigen-binding portion thereof, any glycosylation pattern variant thereof, and any biosimilar thereof.

Exemplary Dosages of Brazikumab in Solid and Liquid Formulations

In some embodiments, brazikumab is administered at a dose of about 15 mg, about 20 mg, about 30 mg, about 40 mg, about 50 mg, about 60 mg, about 70 mg, about 80 mg, about 90 mg, about 100 mg, about 105 mg, about 130 mg, about 150 mg, about 200 mg, about 210 mg, about 500 mg, about 700 mg, or about 1000 mg. In some embodiments, a formulation of brazikumab includes about 1 mg to about 650 mg, about 1 mg to about 600 mg, about 1 mg to about 500 mg, about 1 mg to about 100 mg, or about 5 mg to about 40 mg of brazikumab.

In some embodiments, a liquid formulation of brazikumab contains a high concentration of brazikumab, including, for example, a concentration greater than about 45 mg/mL, greater than about 50 mg/mL, greater than about 100 mg/mL, greater than about 110 mg/mL, greater than about 125 mg/mL, greater than about 150 mg/mL, greater than about 175 mg/mL, or greater than about 200 mg/mL.

In some embodiments, the formulation of brazikumab is a liquid, and the pH of the liquid formulation is from about 5 to about 8. In some embodiments, the liquid formulation includes a buffer. In some embodiments, the pH of the buffer, and/or the pH of the final liquid formulation containing the buffer, ranges from about 4 to about 8, from about 5 to about 8, from about 5 to about 7.5, from about 5 to about 7, from about 4.5 to about 6.0, from about 4.7 to about 5.7, from about 4.8 to about 5.5, or from about 5.0 to about 5.2.

Exemplary Formulations of Brazikumab

In some embodiments, a formulation comprises, consists essentially of or consists of brazikumab, sodium chloride, a buffer including sodium phosphate monobasic monohydrate, sodium phosphate dibasic heptahydrate, and polysorbate 80. In one example, the formulation is liquid and comprises water for injection.

In some embodiments, a formulation comprises, consists essentially of or consists of brazikumab, a buffer which is optionally a phosphate or citrate buffer, and an excipient selected from a polyol (such as a sugar or sugar alcohol) and a non-ionic surfactant, such as a polysorbate. In one example, the formulation is liquid and contains water for injection. In another example, the formulation contains low levels of ionic excipients and has low conductivity.

In some embodiments, a formulation comprises, consists essentially of or consists of brazikumab, sodium chloride, a buffer containing a phosphate such as sodium phosphate monobasic dihydrate, sodium phosphate dibasic dihydrate, or a combination thereof, L-arginine hydrochloride, and sucrose. In one example, the formulation is liquid and contains water for injection.

In some embodiments, a formulation comprises, consists essentially of or consists of brazikumab, sodium chloride, a buffer containing a phosphate such as sodium phosphate monobasic dihydrate, sodium phosphate dibasic dihydrate, or a combination thereof, a citrate such as sodium citrate, citric acid monohydrate, or a combination thereof, mannitol, and polysorbate 80. In one example, the formulation is liquid and contains water for injection. In another example, the pH of the liquid formulation is adjusted with NaOH to about 5.2.

In some embodiments, a formulation comprises, consists essentially of or consists of brazikumab, a buffer, which is optionally a phosphate or citrate buffer, a polyol selected from mannitol, sorbitol, sucrose, trehalose, raffinose, maltose, and a combination thereof, and a non-ionic surfactant selected from polysorbate 20, polysorbate 40, polysorbate 60, and polysorbate 80. In one example, the formulation contains low levels of ionic excipients and has low conductivity. In another example, the concentration of the antibody in the formulation is at least about 10 mg/mL, about 50 mg/mL, about 100 mg/mL., about 150 mg/mL, about 200 mg/mL, or about 250 mg/mL.

In some embodiments, a formulation comprises, consists essentially of or consists of brazikumab, a buffer containing a phosphate selected from monobasic sodium phosphate and dibasic sodium phosphate, sucrose, and polysorbate 80.

In some embodiments, a formulation comprises, consists essentially of or consists of brazikumab, arginine, histidine, or a combination thereof, sucrose, and polysorbate 80. Optionally, the formulation further comprises a buffer. In one example, the formulation is a lyophilized powder.

In some embodiments, a formulation comprises, consists essentially of or consists of brazikumab, a free amino acid selected from histidine, alanine, arginine, glycine, and glutamic acid, a polyol selected from mannitol, sorbitol, sucrose, trehalose, and a combination thereof, and a surfactant. Optionally, the formulation further comprises a buffer. In one example, the formulation is liquid. In another example, the formulation is solid (e.g., lyophilized powder for reconstitution).

In some embodiments, a formulation comprises, consists essentially of or consists of brazikumab, an acetate salt, such as sodium acetate trihydrate, an amino acid which is histidine and/or a salt thereof, sorbitol, and a non-ionic surfactant such as polysorbate 80; optionally, the formulation further comprises arginine and/or a salt thereof. In one example, the formulation is liquid and comprises water for injection. In another example, the pH of the liquid formulation is from about 5.1 to about 5.3. In yet another example, the formulation contains a negligible or non-detectable amount of sodium chloride. In yet another example, the formulation does not contain phosphate or citrate.

In some embodiments, a formulation comprises, consists essentially of or consists of brazikumab, an amino acid selected from L-histidine, L-histidine monohydrochloride monohydrate, and a combination thereof, sorbitol and polysorbate 80. In one example, the formulation is liquid and comprises water for injection.

In some embodiments, a formulation comprises, consists essentially of or consists of brazikumab, an amino acid selected from L-histidine, L-histidine monohydrochloride monohydrate, L-methionine, and a combination thereof, sucrose, and polysorbate 80. In one example, the formulation also contains a metal chelating agent such as EDTA disodium salt dihydrate. In another example, the formulation is liquid and contains water for injection.

In some embodiments, a formulation comprises, consists essentially of or consists of brazikumab, an amino acid selected from L-histidine, L-histidine monohydrochloride monohydrate, L-arginine hydrochloride, and a combination thereof, sucrose, and polysorbate 80.

In some embodiments, a formulation comprises, consists essentially of or consists of brazikumab, an amino acid selected from L-histidine and L-arginine, and a combination thereof, polysorbate 20, and succinic acid.

In some embodiments, a formulation comprises, consists essentially of or consists of brazikumab at a concentration of at least about 100 mg/mL, mannitol, and polysorbate 80. In one example, the formulation is liquid and contains water for injection.

In some embodiments, a formulation comprises, consists essentially of or consists of brazikumab, a buffer containing a negligible or non-detectable amount of sodium chloride, phosphate and citrate, a polyol such as mannitol, and a surfactant selected from a polysorbate and a poloxamer. In one example, the formulation has an antibody concentration of at least about 50 mg/mL, about 75 mg/mL, or about 100 mg/mL or greater, and low conductivity.

In some embodiments, a formulation comprises, consists essentially of or consists of brazikumab, sodium chloride, and an acetate such as sodium acetate.

Formulations Containing Natalizumab

In some embodiments, a pharmaceutical formulation comprises natalizumab. The formulation may be a liquid, semi-solid, or solid formulation. As used herein, the term "natalizumab" includes antibody or monoclonal natalizumab, any antigen-binding portion thereof, any glycosylation pattern variant thereof, and any biosimilar thereof.

Exemplary Dosages of Natalizumab in Solid and Liquid Formulations

In some embodiments, a formulation comprises an effective amount of natalizumab of about 1 mg, about 1.7 mg, about 5 mg, about 10 mg, about 20 mg, about 50 mg, about 100 mg, about 150 mg, about 200 mg, about 250 mg, about 300 mg, about 400 mg, about 500 mg, about 600 mg, about 700 mg, or about 1000 mg.

In some embodiments, a formulation of natalizumab includes about 1 mg to about 500 mg, about 1 mg to about 100 mg, about 5 mg to about 40 mg of natalizumab.

Natalizumab may be administered to a subject (e.g., a human) at a concentration of about 0.01 mg/mL to about 200 mg/mL. For example, natalizumab may range in concentration from about 0.1 mg/mL to about 150 mg/mL. However, embodiments exist when greater concentrations are required for administration to a patient, e.g., about 15 to about 200 mg/mL, about 15 mg/mL to 150 mg/mL, about 20 to about 50 mg/mL, or about 20 mg/mL of natalizumab, and any integer value in between. In some embodiments, a liquid formulation of natalizumab contains a high concentration of natalizumab, including, for example, a concentration greater than about 45 mg/mL, greater than about 50 mg/mL, greater than about 100 mg/mL, greater than about 110 mg/mL., greater than about 125 mg/mL, greater than about 150 mg/mL, greater than about 175 mg/mL, or greater than about 200 mg/mL.

In some embodiments, the formulation of natalizumab is a liquid, and the pH of the liquid formulation is from about 5 to about 8. In some embodiments, the liquid formulation includes a buffer. In some embodiments, the pH of the buffer, and/or the pH of the final liquid formulation containing the buffer, ranges from about 4 to about 8, from about 5 to about 8, from about 5 to about 7.5, from about 5 to about 7, from about 4.5 to about 6.0, from about 4.7 to about 5.7, from about 4.8 to about 5.5, or from about 5.0 to about 5.2.

Exemplary Formulations of Natalizumab

In some embodiments, a formulation comprises, consists essentially of, or consists of natalizumab, sodium chloride, a buffer including sodium phosphate monobasic monohydrate, sodium phosphate dibasic heptahydrate, and polysorbate 80. In one example, the formulation is liquid and comprises water for injection. In one particular embodiment, the formulation is TYSABRI®.

In some embodiments, a formulation comprises, consists essentially of, or consists of natalizumab, a buffer which is optionally a phosphate or citrate buffer, and an excipient selected from a polyol (such as a sugar or sugar alcohol) and a non-ionic surfactant, such as a polysorbate. In one example, the formulation is liquid and contains water for injection. In another example, the formulation contains low levels of ionic excipients and has low conductivity.

In some embodiments, a formulation comprises, consists essentially of, or consists of natalizumab, sodium chloride, a buffer containing a phosphate such as sodium phosphate monobasic dihydrate, sodium phosphate dibasic dihydrate, or a combination thereof, L-arginine hydrochloride, and sucrose. In one example, the formulation is liquid and contains water for injection.

In some embodiments, a formulation comprises, consists essentially of, or consists of natalizumab, sodium chloride, a buffer containing a phosphate such as sodium phosphate monobasic dihydrate, sodium phosphate dibasic dihydrate, or a combination thereof, a citrate such as sodium citrate, citric acid monohydrate, or a combination thereof, mannitol, and polysorbate 80. In one example, the formulation is liquid and contains water for injection. In another example, the pH of the liquid formulation is adjusted with NaOH to about 5.2.

In some embodiments, a formulation comprises, consists essentially of, or consists of natalizumab, a buffer, which is optionally a phosphate or citrate buffer, a polyol selected from mannitol, sorbitol, sucrose, trehalose, raffinose, maltose, and a combination thereof, and a non-ionic surfactant selected from polysorbate 20, polysorbate 40, polysorbate 60, and polysorbate 80. In one example, the formulation contains low levels of ionic excipients and has low conductivity. In another example, the concentration of the antibody in the formulation is at least about 10 mg/mL, about 50 mg/mL, about 100 mg/mL, about 150 mg/mL, about 200 mg/mL, or about 250 mg/mL.

In some embodiments, a formulation comprises, consists essentially of, or consists of natalizumab, a buffer containing a phosphate selected from monobasic sodium phosphate and dibasic sodium phosphate, sucrose, and polysorbate 80.

In some embodiments, a formulation comprises, consists essentially of, or consists of natalizumab, arginine, histidine, or a combination thereof, sucrose, and polysorbate 80. Optionally, the formulation further comprises a buffer. In one example, the formulation is a lyophilized powder.

In some embodiments, a formulation comprises, consists essentially of, or consists of natalizumab, a free amino acid selected from histidine, alanine, arginine, glycine, and glutamic acid, a polyol selected from mannitol, sorbitol, sucrose, trehalose, and a combination thereof, and a surfactant. Optionally, the formulation further comprises a buffer. In one example, the formulation is liquid. In another example, the formulation is solid (e.g., lyophilized powder for reconstitution).

In some embodiments, a formulation comprises, consists essentially of, or consists of natalizumab, an acetate salt, such as sodium acetate trihydrate, an amino acid which is histidine and/or a salt thereof, sorbitol, and a non-ionic surfactant such as polysorbate 80; optionally, the formulation further comprises arginine and/or a salt thereof. In one example, the formulation is liquid and comprises water for injection. In another example, the pH of the liquid formulation is from about 5.1 to about 5.3. In yet another example, the formulation contains a negligible or non-detectable amount of sodium chloride. In yet another example, the formulation does not contain phosphate or citrate.

In some embodiments, a formulation comprises, consists essentially of, or consists of natalizumab, an amino acid selected from L-histidine, L-histidine monohydrochloride monohydrate, and a combination thereof, sorbitol and polysorbate 80. In one example, the formulation is liquid and comprises water for injection.

In some embodiments, a formulation comprises, consists essentially of, or consists of natalizumab, an amino acid selected from L-histidine, L-histidine monohydrochloride monohydrate, L-methionine, and a combination thereof, sucrose, and polysorbate 80. In one example, the formulation also contains a metal chelating agent such as EDTA disodium salt dihydrate. In another example, the formulation is liquid and contains water for injection.

In some embodiments, a formulation comprises, consists essentially of, or consists of natalizumab, an amino acid selected from L-histidine, L-histidine monohydrochloride monohydrate, L-arginine hydrochloride, and a combination thereof, sucrose, and polysorbate 80.

In some embodiments, a formulation comprises, consists essentially of, or consists of natalizumab, an amino acid selected from L-histidine and L-arginine, and a combination thereof, polysorbate 20, and succinic acid.

In some embodiments, a formulation comprises, consists essentially of, or consists of natalizumab at a concentration of at least about 100 mg/mL, mannitol, and polysorbate 80. In one example, the formulation is liquid and contains water for injection.

In some embodiments, a formulation comprises, consists essentially of, or consists of natalizumab, a buffer containing a negligible or non-detectable amount of sodium chloride, phosphate and citrate, a polyol such as mannitol, and a surfactant selected from a polysorbate and a poloxamer. In one example, the formulation has an antibody concentration of at least about 50 mg/mL, about 75 mg/mL, or about 100 mg/mL or greater, and low conductivity.

In some embodiments, a formulation comprises, consists essentially of, or consists of natalizumab, sodium chloride, and an acetate such as sodium acetate.

In some embodiments, a liquid formulation comprises about 300 mg of natalizumab at a concentration of about 20 mg/mL.

In some embodiments, a liquid formulation comprises about 20 mg/mL of natalizumab, about 10 mM sodium phosphate buffer, about 8.18 mg/mL of sodium chloride, and about 0.2 mg/mL of polysorbate 80, and has a pH of about 6.1.

In some embodiments, a liquid formulation comprises about 20.0 mg/mL of natalizumab, about 140 mM NaCl, about 0.02% Polysorbate 80 (w/v), and about 10 mM sodium phosphate. In these embodiments, the pH of the formulation is about 6.0.

In some embodiments, a formulation comprises about 10.0 mg or natalizumab, about 1.4 mg of sodium phosphate, about 8.2 mg of sodium chloride, and about 0.1 mg of polysorbate 80. In these embodiments, the pH of the formulation is about 6.0.

In some embodiments, a formulation comprises about 10.0 mg or natalizumab, about 1.4 mg of sodium phosphate, about 8.2 mg of sodium chloride, and about 0.2 mg of polysorbate 80. In these embodiments, the pH of the formulation is about 6.0.

In some embodiments, a liquid formulation comprises about 5.0 mg/mL natalizumab, about 140 mM NaCl, about 0.02% Polysorbate 80 (w/v), and about 10 mM sodium phosphate. In these embodiments, the pH of the formulation is about 6.0.

In some embodiments, a formulation comprises about 50.0 mg of natalizumab, about 1.4 mg of sodium phosphate, about 8.2 mg sodium chloride, and about 0.2 mg of polysorbate 80. In these embodiments, when the formulation is liquid, the pH of the formulation is about 6.0.

In some embodiments, a formulation comprises about 20.0 mg of natalizumab, about 1.4 mg of sodium phosphate, about 8.2 mg sodium chloride, and about 0.2 mg of polysorbate 80. In these embodiments, when the formulation is liquid, the pH of the formulation is about 6.0.

In some embodiments, a formulation comprises about 5.0 mg of natalizumab, about 1.4 mg of sodium phosphate, about 8.2 mg sodium chloride, and about 0.2 mg of polysorbate 80. In these embodiments, when the formulation is liquid, the pH of the formulation is about 6.0.

In some embodiments, a formulation comprises about 1.7 mg of natalizumab, about 1.4 mg of sodium phosphate, about 8.2 mg sodium chloride, and about 0.2 mg of polysorbate 80. In these embodiments, when the formulation is liquid, the pH of the formulation is about 6.0.

In some embodiments, a liquid formulation comprises from about 20 mg/mL to about 150 mg/mL of natalizumab, about 10 mM phosphate buffer, about 140 mM sodium chloride, and from about 0.001% to about 2% (w/v) of polysorbate 80.

In some embodiments, a formulation comprises about 300 mg natalizumab, about 123 mg sodium chloride, about 17.0 mg sodium phosphate, monobasic, monohydrate, about 7.24 mg sodium phosphate, dibasic, heptahydrate, and about 3.0 mg polysorbate 80. In some embodiments, the formulation is liquid (e.g., an aqueous solution). In other embodiments, the formulation is solid (e.g., a lyophilized cake).

In some embodiments, each 15 mL unit dose (e.g., in a device as described herein) comprises about 300 mg natalizumab, about 123 mg sodium chloride, about 17.0 mg sodium phosphate monobasic monohydrate, about 7.24 mg sodium phosphate dibasic heptahydrate, about 3.0 mg polysorbate 80, and water for injection. In some embodiments, the pH of the formulation is about 6.1.

In some embodiments, a liquid formulation comprises natalizumab at a concentration of about 2.6 mg/mL.

In some embodiments, a formulation comprises about 300 mg of natalizumab, sodium phosphate monobasic monohydrate, sodium phosphate dibasic heptahydrate, sodium chloride, and polysorbate 80. In one example, the formulation is liquid (e.g., an aqueous solution). In another example, the formulation is solid (e.g., lyophilized cake).

Additional pharmaceutical formulations of natalizumab are disclosed, for example, in US Publication No. 2015/0044206; and U.S. Pat. Nos. 8,349,321, 8,815,236, and 8,900,577;

the disclosures of each of which are incorporated herein by reference in their entireties.

Formulations Containing PF-00547659

In some embodiments, a pharmaceutical formulation may comprise PF-00547659. The formulation may be a liquid, semi-solid, or solid formulation. As used herein, the term "PF-00547659" includes antibody or monoclonal PF-00547659, any antigen-binding portion thereof, any glycosylation pattern variant thereof, and any biosimilar thereof.

Exemplary Dosages of PF-00547659 in Solid and Liquid Formulations

In some embodiments, a formulation comprises an effective amount of PF-00547659 of about 7.5 mg, about 15 mg, about 22.5 mg, about 45 mg, about 75 mg, about 150 mg, about 225 mg, about 450 mg, or about 900 mg.

In some embodiments, a liquid formulation of PF-00547659 contains a high concentration of PF-00547659, including, for example, a concentration greater than about 45 mg/mL, greater than about 50 mg/mL, greater than about 100 mg/mL, greater than about 110 mg/mL, greater than about 125 mg/mL, greater than about 150 mg/mL, greater than about 175 mg/mL, or greater than about 200 mg/mL.

In some embodiments, the formulation of PF-00547659 is a liquid, and the pH of the liquid formulation is from about 5 to about 8. In some embodiments, the liquid formulation includes a buffer. In some embodiments, the pH of the buffer, and/or the pH of the final liquid formulation containing the buffer, ranges from about 4 to about 8, from about 5 to about 8, from about 5 to about 7.5, from about 5 to about 7, from about 4.5 to about 6.0, from about 4.7 to about 5.7, from about 4.8 to about 5.5, or from about 5.0 to about 5.2.

Exemplary Formulations of PF-00547659

In some embodiments, a formulation comprises, consists essentially of, or consists of PF-00547659, sodium chloride, a buffer including sodium phosphate monobasic monohydrate, sodium phosphate dibasic heptahydrate, and polysorbate 80. In one example, the formulation is liquid and comprises water for injection.

In some embodiments, a formulation comprises, consists essentially of, or consists of PF-00547659, a buffer which is optionally a phosphate or citrate buffer, and an excipient selected from a polyol (such as a sugar or sugar alcohol) and a non-ionic surfactant, such as a polysorbate. In one example, the formulation is liquid and contains water for injection. In another example, the formulation contains low levels of ionic excipients and has low conductivity.

In some embodiments, a formulation comprises, consists essentially of, or consists of PF-00547659, sodium chloride, a buffer containing a phosphate such as sodium phosphate monobasic dihydrate, sodium phosphate dibasic dihydrate, or a combination thereof, L-arginine hydrochloride, and sucrose. In one example, the formulation is liquid and contains water for injection.

In some embodiments, a formulation comprises, consists essentially of, or consists of PF-00547659, sodium chloride, a buffer containing a phosphate such as sodium phosphate monobasic dihydrate, sodium phosphate dibasic dihydrate, or a combination thereof, a citrate such as sodium citrate, citric acid monohydrate, or a combination thereof, mannitol, and polysorbate 80. In one example, the formulation is liquid and contains water for injection. In another example, the pH of the liquid formulation is adjusted with NaOH to about 5.2.

In some embodiments, a formulation comprises, consists essentially of, or consists of PF-00547659, a buffer, which is optionally a phosphate or citrate buffer, a polyol selected from mannitol, sorbitol, sucrose, trehalose, raffinose, maltose, and a combination thereof, and a non-ionic surfactant selected from polysorbate 20, polysorbate 40, polysorbate 60, and polysorbate 80. In one example, the formulation contains low levels of ionic excipients and has low conductivity. In another example, the concentration of the antibody in the formulation is at least about 10 mg/mL, about 50 mg/mL, about 100 mg/mL, about 150 mg/mL, about 200 mg/mL, or about 250 mg/mL.

In some embodiments, a formulation comprises, consists essentially of, or consists of PF-00547659, a buffer containing a phosphate selected from monobasic sodium phosphate and dibasic sodium phosphate, sucrose, and polysorbate 80.

In some embodiments, a formulation comprises, consists essentially of, or consists of PF-00547659, arginine, histidine, or a combination thereof, sucrose, and polysorbate 80. Optionally, the formulation further comprises a buffer. In one example, the formulation is a lyophilized powder.

In some embodiments, a formulation comprises, consists essentially of, or consists of PF-00547659, a free amino acid selected from histidine, alanine, arginine, glycine, and glutamic acid, a polyol selected from mannitol, sorbitol, sucrose, trehalose, and a combination thereof, and a surfactant. Optionally, the formulation further comprises a buffer. In one example, the formulation is liquid. In another example, the formulation is solid (e.g., lyophilized powder for reconstitution).

In some embodiments, a formulation comprises, consists essentially of, or consists of PF-00547659, an acetate salt, such as sodium acetate trihydrate, an amino acid which is histidine and/or a salt thereof, sorbitol, and a non-ionic surfactant such as polysorbate 80; optionally, the formulation further comprises arginine and/or a salt thereof. In one example, the formulation is liquid and comprises water for injection. In another example, the pH of the liquid formulation is from about 5.1 to about 5.3. In yet another example, the formulation contains a negligible or non-detectable amount of sodium chloride. In yet another example, the formulation does not contain phosphate or citrate.

In some embodiments, a formulation comprises, consists essentially of, or consists of PF-00547659, an amino acid selected from L-histidine, L-histidine monohydrochloride monohydrate, and a combination thereof, sorbitol and polysorbate 80. In one example, the formulation is liquid and comprises water for injection.

In some embodiments, a formulation comprises, consists essentially of, or consists of PF-00547659, an amino acid selected from L-histidine, L-histidine monohydrochloride monohydrate, L-methionine, and a combination thereof, sucrose, and polysorbate 80. In one example, the formulation also contains a metal chelating agent such as EDTA disodium salt dihydrate. In another example, the formulation is liquid and contains water for injection.

In some embodiments, a formulation comprises, consists essentially of, or consists of PF-00547659, an amino acid selected from L-histidine, L-histidine monohydrochloride monohydrate, L-arginine hydrochloride, and a combination thereof, sucrose, and polysorbate 80.

In some embodiments, a formulation comprises, consists essentially of, or consists of PF-00547659, an amino acid selected from L-histidine and L-arginine, and a combination thereof, polysorbate 20, and succinic acid.

In some embodiments, a formulation comprises, consists essentially of, or consists of PF-00547659 at a concentration of at least about 100 mg/mL, mannitol, and polysorbate 80. In one example, the formulation is liquid and contains water for injection.

In some embodiments, a formulation comprises, consists essentially of, or consists of PF-00547659, a buffer containing a negligible or non-detectable amount of sodium chloride, phosphate and citrate, a polyol such as mannitol, and a surfactant selected from a polysorbate and a poloxamer. In one example, the formulation has an antibody concentration of at least about 50 mg/mL, about 75 mg/mL, or about 100 mg/mL or greater, and low conductivity.

In some embodiments, a formulation comprises, consists essentially of, or consists of PF-00547659, sodium chloride, and an acetate such as sodium acetate.

Formulations Containing Guselkumab

In some embodiments, a pharmaceutical formulation comprises guselkumab. The formulation may be a liquid, semi-solid, or solid formulation. As used herein, the term "guselkumab" includes antibody or monoclonal guselkumab, any antigen-binding portion thereof, any glycosylation pattern variant thereof, and any biosimilar thereof.

Exemplary Dosages of Guselkumab in Solid and Liquid Formulations

In some embodiments, guselkumab is administered at a dose of about 30 mg, about 40 mg, about 50 mg, about 60 mg, about 70 mg, about 80 mg, about 90 mg, about 100 mg, about 130 mg, about 150 mg, about 200 mg, about 500 mg, about 700 mg, or about 1000 mg. In some embodiments, a dosage form (e.g., a device as described herein) comprises a liquid formulation of guselkumab at a concentration of about 100 mg/mL.

In some embodiments, a liquid formulation of guselkumab contains a high concentration of guselkumab, including, for example, a concentration greater than about 45 mg/mL, greater than about 50 mg/mL, greater than about 100 mg/mL, greater than about 110 mg/mL, greater than about 125 mg/mL, greater than about 150 mg/mL, greater than about 175 mg/mL, or greater than about 200 mg/mL.

In some embodiments, the formulation of guselkumab is a liquid, and the pH of the liquid formulation is from about 5 to about 8. In some embodiments, the liquid formulation includes a buffer. In some embodiments, the pH of the buffer, and/or the pH of the final liquid formulation containing the buffer, ranges from about 4 to about 8, from about 5 to about 8, from about 5 to about 7.5, from about 5 to about 7, from about 4.5 to about 6.0, from about 4.7 to about 5.7, from about 4.8 to about 5.5, or from about 5.0 to about 5.2.

Exemplary Formulations of Guselkumab

In some embodiments, a formulation comprises, consists essentially of or consists of guselkumab, sodium chloride, a buffer including sodium phosphate monobasic monohydrate, sodium phosphate dibasic heptahydrate, and polysorbate 80. In one example, the formulation is liquid and comprises water for injection.

In some embodiments, a formulation comprises, consists essentially of or consists of guselkumab, a buffer which is optionally a phosphate or citrate buffer, and an excipient selected from a polyol (such as a sugar or sugar alcohol) and a non-ionic surfactant, such as a polysorbate. In one example, the formulation is liquid and contains water for injection. In another example, the formulation contains low levels of ionic excipients and has low conductivity.

In some embodiments, a formulation comprises, consists essentially of or consists of guselkumab, sodium chloride, a buffer containing a phosphate such as sodium phosphate monobasic dihydrate, sodium phosphate dibasic dihydrate, or a combination thereof, L-arginine hydrochloride, and sucrose. In one example, the formulation is liquid and contains water for injection.

In some embodiments, a formulation comprises, consists essentially of or consists of guselkumab, sodium chloride, a buffer containing a phosphate such as sodium phosphate monobasic dihydrate, sodium phosphate dibasic dihydrate, or a combination thereof, a citrate such as sodium citrate, citric acid monohydrate, or a combination thereof, mannitol, and polysorbate 80. In one example, the formulation is liquid and contains water for injection. In another example, the pH of the liquid formulation is adjusted with NaOH to about 5.2.

In some embodiments, a formulation comprises, consists essentially of or consists of guselkumab, a buffer, which is optionally a phosphate or citrate buffer, a polyol selected from mannitol, sorbitol, sucrose, trehalose, raffinose, maltose, and a combination thereof, and a non-ionic surfactant selected from polysorbate 20, polysorbate 40, polysorbate 60, and polysorbate 80. In one example, the formulation contains low levels of ionic excipients and has low conductivity. In another example, the concentration of the antibody in the formulation is at least about 10 mg/mL, about 50 mg/mL, about 100 mg/mL, about 150 mg/mL, about 200 mg/mL, or about 250 mg/mL.

In some embodiments, a formulation comprises, consists essentially of or consists of guselkumab, a buffer containing a phosphate selected from monobasic sodium phosphate and dibasic sodium phosphate, sucrose, and polysorbate 80.

In some embodiments, a formulation comprises, consists essentially of or consists of guselkumab, arginine, histidine, or a combination thereof, sucrose, and polysorbate 80. Optionally, the formulation further comprises a buffer. In one example, the formulation is a lyophilized powder.

In some embodiments, a formulation comprises, consists essentially of or consists of guselkumab, a free amino acid selected from histidine, alanine, arginine, glycine, and glutamic acid, a polyol selected from mannitol, sorbitol, sucrose, trehalose, and a combination thereof, and a surfactant. Optionally, the formulation further comprises a buffer. In one example, the formulation is liquid. In another example, the formulation is solid (e.g., lyophilized powder for reconstitution).

In some embodiments, a formulation comprises, consists essentially of or consists of guselkumab, an acetate salt, such as sodium acetate trihydrate, an amino acid which is histidine and/or a salt thereof, sorbitol, and a non-ionic surfactant such as polysorbate 80; optionally, the formulation further comprises arginine and/or a salt thereof. In one example, the formulation is liquid and comprises water for injection. In another example, the pH of the liquid formulation is from about 5.1 to about 5.3. In yet another example, the formulation contains a negligible or non-detectable amount of sodium chloride. In yet another example, the formulation does not contain phosphate or citrate.

In some embodiments, a formulation comprises, consists essentially of or consists of guselkumab, an amino acid selected from L-histidine, L-histidine monohydrochloride monohydrate, and a combination thereof, sorbitol and polysorbate 80. In one example, the formulation is liquid and comprises water for injection.

In some embodiments, a formulation comprises, consists essentially of or consists of guselkumab, an amino acid selected from L-histidine, L-histidine monohydrochloride monohydrate, L-methionine, and a combination thereof, sucrose, and polysorbate 80. In one example, the formulation also contains a metal chelating agent such as EDTA disodium salt dihydrate. In another example, the formulation is liquid and contains water for injection.

In some embodiments, a formulation comprises, consists essentially of or consists of guselkumab, an amino acid selected from L-histidine, L-histidine monohydrochloride monohydrate, L-arginine hydrochloride, and a combination thereof, sucrose, and polysorbate 80.

In some embodiments, a formulation comprises, consists essentially of or consists of guselkumab, an amino acid selected from L-histidine and L-arginine, and a combination thereof, polysorbate 20, and succinic acid.

In some embodiments, a formulation comprises, consists essentially of or consists of guselkumab at a concentration of at least about 100 mg/mL, mannitol, and polysorbate 80. In one example, the formulation is liquid and contains water for injection.

In some embodiments, a formulation comprises, consists essentially of or consists of guselkumab, a buffer containing a negligible or non-detectable amount of sodium chloride, phosphate and citrate, a polyol such as mannitol, and a surfactant selected from a polysorbate and a poloxamer. In one example, the formulation has an antibody concentration of at least about 50 mg/mL, about 75 mg/mL, or about 100 mg/mL or greater, and low conductivity.

In some embodiments, a formulation comprises, consists essentially of or consists of guselkumab, sodium chloride, and an acetate such as sodium acetate.

In some embodiments, a liquid formulation comprises about 100 mg guselkumab, about 0.6 mg of L-histidine, about 1.5 mg of L-histidine monohydrochloride monohydrate, about 0.5 mg of polysorbate 80, and about 79 mg of sucrose. In one example, the formulation is liquid and the pH of the formulation is about 5.8.

In some embodiments, a formulation comprises about 100 mg of guselkumab, histidine, histidine monohydrochloride monohydrate, polysorbate 80, and sucrose. In one example, the formulation is a liquid formulation or a solid formulation (e.g., lyophilized cake) as described herein.

Formulations Containing Mirikizumab

In some embodiments, a pharmaceutical formulation comprises mirikizumab. The formulation may be a liquid, semi-solid, or solid formulation. As used herein, the term "mirikizumab" includes antibody or monoclonal mirikizumab, any antigen-binding portion thereof, any glycosylation pattern variant thereof, and any biosimilar thereof.

Exemplary Dosages of Mirikizumab in Solid and Liquid Formulations

In some embodiments, an effective dose of mirikizumab is about 5 mg, about 20 mg, about 60 mg, about 120 mg, about 200 mg, about 350 mg, or about 600 mg.

In some embodiments, a liquid formulation of mirikizumab contains a high concentration of mirikizumab, including, for example, a concentration greater than about 45 mg/mL, greater than about 50 mg/mL, greater than about 100 mg/mL, greater than about 110 mg/mL, greater than about 125 mg/mL, greater than about 150 mg/mL, greater than about 175 mg/mL, or greater than about 200 mg/mL.

In some embodiments, the formulation of mirikizumab is a liquid, and the pH of the liquid formulation is from about 5 to about 8. In some embodiments, the liquid formulation includes a buffer. In some embodiments, the pH of the buffer, and/or the pH of the final liquid formulation containing the buffer, ranges from about 4 to about 8, from about 5 to about 8, from about 5 to about 7.5, from about 5 to about 7, from about 4.5 to about 6.0, from about 4.7 to about 5.7, from about 4.8 to about 5.5, or from about 5.0 to about 5.2.

Exemplary Formulations of Mirikizumab

In some embodiments, a formulation comprises, consists essentially of or consists of mirikizumab, sodium chloride, a buffer including sodium phosphate monobasic monohydrate, sodium phosphate dibasic heptahydrate, and polysorbate 80. In one example, the formulation is liquid and comprises water for injection.

In some embodiments, a formulation comprises, consists essentially of or consists of mirikizumab, a buffer which is optionally a phosphate or citrate buffer, and an excipient selected from a polyol (such as a sugar or sugar alcohol) and a non-ionic surfactant, such as a polysorbate. In one example, the formulation is liquid and contains water for injection. In another example, the formulation contains low levels of ionic excipients and has low conductivity.

In some embodiments, a formulation comprises, consists essentially of or consists of mirikizumab, sodium chloride, a buffer containing a phosphate such as sodium phosphate monobasic dihydrate, sodium phosphate dibasic dihydrate, or a combination thereof, L-arginine hydrochloride, and sucrose. In one example, the formulation is liquid and contains water for injection.

In some embodiments, a formulation comprises, consists essentially of or consists of mirikizumab, sodium chloride, a buffer containing a phosphate such as sodium phosphate monobasic dihydrate, sodium phosphate dibasic dihydrate, or a combination thereof, a citrate such as sodium citrate, citric acid monohydrate, or a combination thereof, mannitol, and polysorbate 80. In one example, the formulation is liquid and contains water for injection. In another example, the pH of the liquid formulation is adjusted with NaOH to about 5.2.

In some embodiments, a formulation comprises, consists essentially of or consists of mirikizumab, a buffer, which is optionally a phosphate or citrate buffer, a polyol selected from mannitol, sorbitol, sucrose, trehalose, raffinose, maltose, and a combination thereof, and a non-ionic surfactant selected from polysorbate 20, polysorbate 40, polysorbate 60, and polysorbate 80. In one example, the formulation contains low levels of ionic excipients and has low conductivity. In another example, the concentration of the antibody in the formulation is at least about 10 mg/mL, about 50 mg/mL, about 100 mg/mL, about 150 mg/mL, about 200 mg/mL, or about 250 mg/mL.

In some embodiments, a formulation comprises, consists essentially of or consists of mirikizumab, a buffer containing a phosphate selected from monobasic sodium phosphate and dibasic sodium phosphate, sucrose, and polysorbate 80.

In some embodiments, a formulation comprises, consists essentially of or consists of mirikizumab, arginine, histidine, or a combination thereof, sucrose, and polysorbate 80. Optionally, the formulation further comprises a buffer. In one example, the formulation is a lyophilized powder.

In some embodiments, a formulation comprises, consists essentially of or consists of mirikizumab, a free amino acid selected from histidine, alanine, arginine, glycine, and glutamic acid, a polyol selected from mannitol, sorbitol, sucrose, trehalose, and a combination thereof, and a surfactant. Optionally, the formulation further comprises a buffer. In one example, the formulation is liquid. In another example, the formulation is solid (e.g., lyophilized powder for reconstitution).

In some embodiments, a formulation comprises, consists essentially of or consists of mirikizumab, an acetate salt, such as sodium acetate trihydrate, an amino acid which is histidine and/or a salt thereof, sorbitol, and a non-ionic surfactant such as polysorbate 80; optionally, the formulation further comprises arginine and/or a salt thereof. In one example, the formulation is liquid and comprises water for injection. In another example, the pH of the liquid formulation is from about 5.1 to about 5.3. In yet another example, the formulation contains a negligible or non-detectable amount of sodium chloride. In yet another example, the formulation does not contain phosphate or citrate.

In some embodiments, a formulation comprises, consists essentially of or consists of mirikizumab, an amino acid selected from L-histidine, L-histidine monohydrochloride monohydrate, and a combination thereof, sorbitol and polysorbate 80. In one example, the formulation is liquid and comprises water for injection.

In some embodiments, a formulation comprises, consists essentially of or consists of mirikizumab, an amino acid selected from L-histidine, L-histidine monohydrochloride monohydrate, L-methionine, and a combination thereof, sucrose, and polysorbate 80. In one example, the formulation also contains a metal chelating agent such as EDTA disodium salt dihydrate. In another example, the formulation is liquid and contains water for injection.

In some embodiments, a formulation comprises, consists essentially of or consists of mirikizumab, an amino acid selected from L-histidine, L-histidine monohydrochloride monohydrate, L-arginine hydrochloride, and a combination thereof, sucrose, and polysorbate 80.

In some embodiments, a formulation comprises, consists essentially of or consists of mirikizumab, an amino acid selected from L-histidine and L-arginine, and a combination thereof, polysorbate 20, and succinic acid.

In some embodiments, a formulation comprises, consists essentially of or consists of mirikizumab at a concentration of at least about 100 mg/mL., mannitol, and polysorbate 80. In one example, the formulation is liquid and contains water for injection.

In some embodiments, a formulation comprises, consists essentially of or consists of mirikizumab, a buffer containing a negligible or non-detectable amount of sodium chloride, phosphate and citrate, a polyol such as mannitol, and a surfactant selected from a polysorbate and a poloxamer. In one example, the formulation has an antibody concentration of at least about 50 mg/mL, about 75 mg/mL, or about 100 mg/mL or greater, and low conductivity.

In some embodiments, a formulation comprises, consists essentially of or consists of mirikizumab, sodium chloride, and an acetate such as sodium acetate.

Definitions

By "ingestible," it is meant that the device can be swallowed whole.

As used herein, "topical delivery" refers to a route of administration of a medicament (i.e., a drug or a pharmaceutical formulation containing a drug) where the medicament is applied to a localized area of the body or to the surface of a body part, regardless of the location of the effect; more particularly, the topical administration of the medicament comprises applying the medicament to a mucous membrane or lining of the gastrointestinal tract of a subject, including, but not limited to, a mucous membrane or lining containing one or more disease sites, such as gastrointestinal mucosal lesions. The effect of the topical delivery or topical administration of the medicament may be local to, or away from, the site of the topical administration. "Topical delivery," "topical administration," "topical application" and "topical treatment" are used interchangeably herein.

"Inflammatory Bowel Disease" or "IBD" is a chronic inflammatory autoimmune condition of the gastrointestinal (GI) tract. The GI tract can be divided into four main different sections, the oesophagus, stomach, small intestine and large intestine or colon. The small intestine possesses three main subcompartments: the duodenum, jejunum and ileum. Similarly, the large intestine consists of six sections: the cecum, ascending colon, transverse colon, ascending colon, sigmoid colon, and the rectum. The small intestine is about 6 m long, its diameter is about 2.5 to about 3 cm and the transit time through it is typically about 3 hours. The duodenum has a C-shape, and is about 30 cm long. Due to its direct connection with the stomach, it is physically more stable than the jejunum and ileum, which are sections that can freely move. The jejunum is about 2.4 m in length and the ileum is about 3.6 m in length and their surface areas are about 180 $m^2$ and about 280 $m^2$, respectively. The large intestine is about 1.5 m long, its diameter is between about 6.3 and about 6.5 cm, the transit time though this section is about 20 hours and has a reduced surface area of about 150 $m^2$. The higher surface area of the small intestine enhances its capacity for systemic drug absorption.

The etiology of IBD is complex, and many aspects of the pathogenesis remain unclear. The treatment of moderate to severe IBD poses significant challenges to treating physicians, because conventional therapy with corticosteroids and immunomodulator therapy (e.g., azathioprine, 6-mercaptopurine, and methotrexate administered via traditional routes such as tablet form, oral suspension, or intravenously) is associated with side effects and intolerance and has not shown proven benefit in maintenance therapy (steroids). Monoclonal antibodies targeting tumor necrosis factor alpha (TNF-α), such as infliximab (a chimeric antibody) and adalimumab (a fully human antibody), are currently used in the management of CD. Infliximab has also shown efficacy and has been approved for use in UC. However, approximately 10%-20% of patients with CD are primary nonresponders to anti-TNF therapy, and another ~20%-30% of CD patients lose response over time (Schnitzler et al., Gut 58:492-500 (2009)). Other adverse events (AEs) associated with anti-TNFs include elevated rates of bacterial infection, including tuberculosis, and, more rarely, lymphoma and demyelination (Chang et al., Nat Clin Pract Gastroenterol Hepatology 3:220 (2006); Hoentjen et al., World J. Gastroenterol. 15 (17): 2067 (2009)). No currently available therapy achieves sustained remission in more than 20%-30% of IBD patients with chronic disease (Hanauer et al., Lancet 359:1541-49 (2002); Sandborn et al., N Engl J Med 353: 1912-25 (2005)). In addition, most patients do not achieve sustained steroid-free remission and mucosal healing, clinical outcomes that correlate with true disease modification.

Although the cause of IBD remains unknown, several factors such as genetic, infectious and immunologic susceptibility have been implicated. IBD is much more common in Caucasians, especially those of Jewish descent. The chronic inflammatory nature of the condition has prompted an intense search for a possible infectious cause. Although agents have been found which stimulate acute inflammation, none has been found to cause the chronic inflammation associated with IBD. The hypothesis that IBD is an autoimmune disease is supported by the previously mentioned extraintestinal manifestation of IBD as joint arthritis, and the known positive response to IBD by treatment with therapeutic agents such as adrenal glucocorticoids, cyclosporin A and azathioprine, which are known to suppress immune response. In addition, the GI tract, more than any other organ of the body, is continuously exposed to potential antigenic substances such as proteins from food, bacterial byproducts (LPS), etc.

A chronic inflammatory autoimmune condition of the gastrointestinal (GI) tract presents clinically as either ulcerative colitis (UC) or Crohn's disease (CD). Both IBD conditions are associated with an increased risk for malignancy of the GI tract.

"Crohn's disease" ("CD") is a chronic transmural inflammatory disease with the potential to affect any part of the entire GI tract, and UC is a mucosal inflammation of the colon. Both conditions are characterized clinically by frequent bowel motions, malnutrition, and dehydration, with disruption in the activities of daily living.

CD is frequently complicated by the development of malabsorption, strictures, and fistulae and may require repeated surgery. UC, less frequently, may be complicated by severe bloody diarrhea and toxic megacolon, also requiring surgery. The most prominent feature Crohn's disease is the granular, reddish-purple edematous thickening of the bowel wall. With the development of inflammation, these granulomas often lose their circumscribed borders and integrate with the surrounding tissue. Diarrhea and obstruction of the bowel are the predominant clinical features. As with ulcerative colitis, the course of Crohn's disease may be continuous or relapsing, mild or severe, but unlike ulcerative colitis, Crohn's disease is not curable by resection of the involved segment of bowel. Most patients with Crohn's disease require surgery at some point, but subsequent relapse is common and continuous medical treatment is usual. Crohn's disease may involve any part of the alimentary tract from the mouth to the anus, although typically it appears in the ileocolic, small-intestinal or colonic-anorectal regions. Histopathologically, the disease manifests by discontinuous granulomatomas, crypt abscesses, fissures and aphthous ulcers. The inflammatory infiltrate is mixed, consisting of lymphocytes (both T and B cells), plasma cells, macrophages, and neutrophils. There is a disproportionate increase in IgM- and IgG-secreting plasma cells, macrophages and neutrophils.

To date, the primary outcome measure in Crohn's Disease clinical trials is the Crohn's Disease Activity Index (CDAI), which has served as the basis for approval of multiple drug treatments, including for example, vedolizumab and natalizumab. The CDAI was developed by regressing clinician global assessment of disease activity on eighteen potential items representing patient reported outcomes (PROs) (i.e., abdominal pain, pain awakening patient from sleep, appetite), physical signs (i.e., average daily temperature, abdominal mass), medication use (i.e., loperamide or opiate use for diarrhea) and a laboratory test (i.e., hematocrit). Backward stepwise regression analysis identified eight independent predictors which are the number of liquid or soft stools, severity of abdominal pain, general well-being, occurrence of extra-intestinal symptoms, need for anti-diarrheal drugs, presence of an abdominal mass, hematocrit, and body weight. The final score is a composite of these eight items, adjusted using regression coefficients and standardization to construct an overall CDAI score, ranging from 0 to 600 with higher score indicating greater disease activity. Widely used benchmarks are: CDAI<150 is defined as clinical remission, 150 to 219 is defined as mildly active disease, 220 to 450 is defined as moderately active disease, and above 450 is defined as very severe disease (Best W R, et al., Gastroenterology 77:843-6, 1979). Vedolizumab and natalizumab have been approved on the basis of demonstrated clinical remission, i.e., CDAI<150.

Although the CDAI has been in use for over 40 years, and has served as the basis for drug approval, it has several limitations as an outcome measure for clinical trials. For example, most of the overall score comes from the patient diary card items (pain, number of liquid bowel movements, and general well-being), which are vaguely defined and not standardized terms (Sandler et al., J. Clin. Epidemiol 41:451-8, 1988; Thia et al., Inflamm Bowel Dis 17:105-11, 2011). In addition, measurement of pain is based on a four-point scale rather than an updated seven-point scale. The remaining 5 index items contribute very little to identifying an efficacy signal and may be a source of measurement noise. Furthermore, concerns have been raised about poor criterion validity for the CDAI, a reported lack of correlation between the CDAI and endoscopic measures of inflammation (which may render the CDAI as a poor discriminator of active CD and irritable bowel syndrome) and high reported placebo rates (Korzenik et al., N Engl J Med. 352:2193-201, 2005; Sandborn W J, et al., N Engl J Med 353:1912-25, 2005; Sandborn W J, et al., Ann Intern 19; 146:829-38, 2007, Epub 2007 Apr. 30; Kim et al., Gastroenterology 146: (5 supplement 1) S-368, 2014).

It is, thus, generally recognized that additional or alternative measures of CD symptoms are needed, such as new PRO tools or adaptations of the CDAI to derive a new PRO. The PRO2 and PRO3 tools are such adaptations of the CDAI and have been recently described in Khanna et al., Aliment Pharmacol. Ther. 41:77-86, 2015. The PRO2 evaluates the frequency of loose/liquid stools and abdominal pain (Id). These items are derived and weighted accordingly from the CDAI and are the CDAI diary card items, along with general well-being, that contribute most to the observed clinical benefit measured by CDAI (Sandler et al., J. Clin. Epidemiol 41:451-8, 1988; Thia et al., Inflamm Bowel Dis 17:105-11, 2011; Kim et al., Gastroenterology 146:(5 supplement 1) S-368, 2014). The remission score of <11 is the CDAI-weighted sum of the average stool frequency and pain scores in a 7-day period, which yielded optimum sensitivity and specificity for identification of CDAI remission (score of <150) in a retrospective data analysis of ustekinumab induction treatment for moderate to severe CD in a Phase II clinical study (Gasink C, et al., abstract, ACG Annual Meeting 2014). The PRO2 was shown to be sensitive and responsive when used as a continuous outcome measure in a retrospective data analysis of MTX treatment in active CD (Khanna R, et al., Inflamm Bowel Dis 20:1850-61, 2014) measured by CDAI. Additional outcome measures include the Mayo Clinic Score, the Crohn disease endoscopic index of severity (CDEIS), and the Ulcerative colitis endoscopic index of severity (UCEIS). Additional outcome measures include Clinical remission, Mucosal healing, Histological healing (transmural), MRI or ultrasound for measurement or evaluation of bowel wall thickness, abscesses, fistula and histology.

An additional means of assessing the extent and severity of Crohn's Disease is endoscopy. Endoscopic lesions typical of Crohn's disease have been described in numerous studies and include, e.g., aphthoid ulcerations, "punched-out ulcers," cobblestoning and stenosis. Endoscopic evaluation of such lesions was used to develop the first validated endoscopic score, the Crohn's Disease Endoscopic Index of Severity (CDEIS) (Mary et al., Gut 39:983-9, 1989). More recently, because the CDEIS is time-consuming, complicated and impractical for routine use, a Simplified Endoscopic Activity Score for Crohn's Disease (SES-CD) was developed and validated (Daperno et al., Gastrointest. Endosc. 60 (4): 505-12, 2004). The SES-CD consists of four endoscopic variables (size of ulcers, proportion of surface covered by ulcers, proportion of surface with any other lesions (e.g., inflammation), and presence of narrowings [stenosis]) that are scored in five ilcocolonic segments, with each variable, or assessment, rated from 0 to 3.

To date, there is no cure for CD. Accordingly, the current treatment goals for CD are to induce and maintain symptom improvement, induce mucosal healing, avoid surgery, and improve quality of life (Lichtenstein G R, et al., Am J Gastroenterol 104:465-83, 2009; Van Assche G, et al., J Crohns Colitis. 4:63-101, 2010). The current therapy of IBD usually involves the administration of antiinflammatory or immunosuppressive agents, such as sulfasalazine, corticosteroids, 6-mercaptopurine/azathioprine, or cyclosporin A, all of which are not typically delivered by localized release of a drug at the site or location of disease. More recently, biologics like TNF-alpha inhibitors and IL-12/IL-23 blockers, are used to treat IBD. If anti-inflammatory/immunosuppressive/biologic therapies fail, colectomies are the last line of defense. The typical operation for CD not involving the rectum is resection (removal of a diseased segment of bowel) and anastomosis (reconnection) without an ostomy.

Sections of the small or large intestine may be removed. About 30% of CD patients will need surgery within the first year after diagnosis. In the subsequent years, the rate is about 5% per year. Unfortunately, CD is characterized by a high rate of recurrence; about 5% of patients need a second surgery each year after initial surgery.

Refining a diagnosis of inflammatory bowel disease involves evaluating the progression status of the diseases using standard classification criteria. The classification systems used in IBD include the Truelove and Witts Index (Truelove S. C. and Witts, L. J. Br Med J. 1955; 2:1041-1048), which classifies colitis as mild, moderate, or severe, as well as Lennard-Jones. (Lennard-Jones J E. Scand J Gastroenterol Suppl 1989; 170:2-6) and the simple clinical colitis activity index (SCCAI). (Walmsley et. al. Gut. 1998; 43:29-32) These systems track such variables as daily bowel movements, rectal bleeding, temperature, heart rate, hemoglobin levels, erythrocyte sedimentation rate, weight, hematocrit score, and the level of serum albumin.

There is sufficient overlap in the diagnostic criteria for UC and CD that it is sometimes impossible to say which a given patient has; however, the type of lesion typically seen is different, as is the localization. UC mostly appears in the colon, proximal to the rectum, and the characteristic lesion is a superficial ulcer of the mucosa; CD can appear anywhere in the bowel, with occasional involvement of stomach, esophagus and duodenum, and the lesions are usually described as extensive linear fissures.

In approximately 10-15% of cases, a definitive diagnosis of ulcerative colitis or Crohn's disease cannot be made and such cases are often referred to as "indeterminate colitis." Two antibody detection tests are available that can help the diagnosis, each of which assays for antibodies in the blood. The antibodies are "perinuclear anti-neutrophil antibody" (pANCA) and "anti-*Saccharomyces cerevisiae* antibody" (ASCA). Most patients with ulcerative colitis have the pANCA antibody but not the ASCA antibody, while most patients with Crohn's disease have the ASCA antibody but not the pANCA antibody. However, these two tests have shortcomings as some patients have neither antibody and some Crohn's disease patients may have only the pANCA antibody. A third test, which measures the presence and accumulation of circulating anti-microbial antibodies-particularly flagellin antibodies, has proven to be useful for detecting susceptibility to Crohn's Disease before disease development. See Choung, R. S., et al., "Serologic microbial associated markers can predict Crohn's disease behaviour years before disease diagnosis," Alimentary Pharmacology and Therapeutics 43.12 (2016): 1300-1310.

"Ulcerative colitis (UC)" afflicts the large intestine. The course of the disease may be continuous or relapsing, mild or severe. The earliest lesion is an inflammatory infiltration with abscess formation at the base of the crypts of Lieberkuhn. Coalescence of these distended and ruptured crypts tends to separate the overlying mucosa from its blood supply, leading to ulceration. Symptoms of the disease include cramping, lower abdominal pain, rectal bleeding, and frequent, loose discharges consisting mainly of blood, pus and mucus with scanty fecal particles. A total colectomy may be required for acute, severe or chronic, unremitting ulcerative colitis.

The clinical features of UC are highly variable, and the onset may be insidious or abrupt, and may include diarrhea, tenesmus and relapsing rectal bleeding. With fulminant involvement of the entire colon, toxic megacolon, a life-threatening emergency, may occur. Extraintestinal manifestations include arthritis, pyoderma gangrenoum, uveitis, and erythema nodosum.

An "antibody" is an immunoglobulin molecule capable of specific binding to a target, such as a carbohydrate, polynucleotide, lipid, polypeptide, etc., through at least one antigen recognition site, located in the variable region of the immunoglobulin molecule. The terms "antibody" and "immunoglobulin" are used interchangeably in the broadest sense. As used herein, the terms encompass monoclonal antibodies (for example, full length or intact monoclonal antibodies), polyclonal antibodies (for example, full length or intact polyclonal antibodies), and fragments thereof (such as Fab, Fab', F(ab')2, Fv), single chain (ScFv) and domain antibodies), fusion proteins including an antibody portion, multivalent antibodies, multispecific antibodies (e.g., bispecific, trispecific, etc. antibodies so long as they exhibit the desired biological activity), and any other modified configuration of the immunoglobulin molecule that includes an antigen recognition site. An antibody can be human, humanized and/or affinity matured.

The term antibody includes antibody fragments (e.g., antigen-binding fragments) such as an Fv fragment, a Fab fragment, a F(ab')2 fragment, and a Fab' fragment. "Antibody fragments" comprise only a portion of an intact antibody, where in certain embodiments, the portion retains at least one, and typically most or all, of the functions normally associated with that portion when present in an intact antibody. In one embodiment, an antibody fragment comprises an antigen binding site of the intact antibody and thus retains the ability to bind antigen. In another embodiment, an antibody fragment, for example one that comprises the Fc region, retains at least one of the biological functions normally associated with the Fc region when present in an intact antibody, such as FcRn binding, antibody half-life modulation, ADCC function and complement binding. In one embodiment, an antibody fragment is a monovalent antibody that has an in vivo half-life substantially similar to an intact antibody. For example, such an antibody fragment may comprise on antigen binding arm linked to an Fc sequence capable of conferring in vivo stability to the fragment. Additional examples of antigen-binding fragments include an antigen-binding fragment of an IgG (e.g., an antigen-binding fragment of IgG1, IgG2, IgG3, or IgG4) (e.g., an antigen-binding fragment of a human or humanized IgG, e.g., human or humanized IgG1, IgG2, IgG3, or IgG4); an antigen-binding fragment of an IgA (e.g., an antigen-binding fragment of IgA1 or IgA2) (e.g., an antigen-binding fragment of a human or humanized IgA, e.g., a human or humanized IgA1 or IgA2); an antigen-binding fragment of an IgD (e.g., an antigen-binding fragment of a human or humanized IgD); an antigen-binding fragment of an IgE (e.g., an antigen-binding fragment of a human or humanized IgE); or an antigen-binding fragment of an IgM (e.g., an antigen-binding fragment of a human or humanized IgM). An antibody includes an antibody of any class, such as IgG, IgA, or IgM (or sub-class thereof), and the antibody need not be of any particular class. Depending on the antibody amino acid sequence of the constant domain of its heavy chains, immunoglobulins can be assigned to different classes. There are five major classes of immunoglobulins: IgA, IgD, IgE, IgG, and IgM, and several of these may be further divided into subclasses (isotypes), e.g., IgG1, IgG2, IgG3, IgG4, IgA1 and IgA2. The heavy-chain constant domains that correspond to the different classes of immunoglobulins are called alpha, delta, epsilon, gamma, and mu, respectively.

The subunit structures and three-dimensional configurations of different classes of immunoglobulins are well known.

The term "monoclonal antibody" as used herein refers to an antibody obtained from a population of substantially homogeneous antibodies, i.e., the individual antibodies comprising the population are identical except for possible naturally occurring mutations that may be present in minor amounts. Monoclonal antibodies are highly specific, being directed against a single antigen or antigenic site. Furthermore, in contrast to polyclonal antibody preparations that typically include different antibodies directed against different determinants (epitopes), each monoclonal antibody is directed against a single determinant on the antigen. The modifier "monoclonal" indicates the character of the antibody as being obtained from a substantially homogeneous population of antibodies, and is not to be construed as requiring production of the antibody by any particular method. For example, the monoclonal antibodies to be used in accordance with the present disclosure may be made by the hybridoma method first described by Kohler and Milstein, 1975, Nature 256:495, or may be made by recombinant DNA methods such as described in U.S. Pat. No. 4,816,567. The monoclonal antibodies may also be isolated from phage libraries generated using the techniques described in McCafferty et al., 1990, Nature 348:552-554, for example.

The monoclonal antibodies herein specifically include "chimeric" antibodies in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, so long as they exhibit the desired biological activity (U.S. Pat. No. 4,816,567; and Morrison et al., Proc. Natl. Acad. Sci. USA 81:6851-6855 (1984)).

A "variable region" of an antibody refers to the variable region of the antibody light chain or the variable region of the antibody heavy chain, either alone or in combination. As known in the art, the variable regions of the heavy and light chain each consist of four framework regions (FR) connected by three complementarity determining regions (CDRs) that contain hypervariable regions. The CDRs in each chain are held together in close proximity by the FRs and, with the CDRs from the other chain, contribute to the formation of the antigen-binding site of antibodies. There are at least two techniques for determining CDRs: (1) an approach based on cross-species sequence variability (i.e., Kabat et al., Sequences of Proteins of Immunological Interest, (5th ed., 1991, National Institutes of Health, Bethesda MD)); and (2) an approach based on crystallographic studies of antigen-antibody complexes (Al-Lazikani et al., 1997, J. Molec. Biol. 273:927-948). As used herein, a CDR may refer to CDRs defined by either approach or by a combination of both approaches.

As known in the art, a "constant region" of an antibody refers to the constant region of the antibody light chain or the constant region of the antibody heavy chain, either alone or in combination.

"Treatment regimen" refers to a combination of dosage, frequency of administration, or duration of treatment, with or without addition of a second medication.

"Effective treatment regimen" refers to a treatment regimen that will offer beneficial response to a patient receiving the treatment.

"Effective amount" refers to an amount of drug that offers beneficial response to a patient receiving the treatment. For example, an effective amount may be a Human Equivalent Dose (HED).

"Dispensable," with reference to any substance, refers to any substance that may be released from an ingestible device as disclosed herein, or from a component of the device such as a reservoir. For example, a dispensable substance may be an immune modulator, and/or a formulation comprising an immune modulator.

"Patient response" or "patient responsiveness" can be assessed using any endpoint indicating a benefit to the patient, including, without limitation, (1) inhibition, to some extent, of disease progression, including slowing down and complete arrest; (2) reduction in the number of disease episodes and/or symptoms; (3) reduction in lesional size; (4) inhibition (i.e., reduction, slowing down or complete stopping) of disease cell infiltration into adjacent peripheral organs and/or tissues; (5) inhibition (i.e., reduction, slowing down or complete stopping) of disease spread; (6) decrease of auto-immune response, which may, but does not have to, result in the regression or ablation of the disease lesion; (7) relief, to some extent, of one or more symptoms associated with the disorder; (8) increase in the length of disease-free presentation following treatment; and/or (9) decreased mortality at a given point of time following treatment. The term "responsiveness" refers to a measurable response, including complete response (CR) and partial response (PR).

As used herein, "complete response" or "CR" means the disappearance of all signs of inflammation or remission in response to treatment. This does not necessarily mean the disease has been cured.

"Partial response" or "PR" refers to a decrease of at least 50% in the severity of inflammation, in response to treatment.

A "beneficial response" of a patient to treatment with a therapeutic agent and similar wording refers to the clinical or therapeutic benefit imparted to a patient at risk for or suffering from a gastrointestinal inflammatory disorder from or as a result of the treatment with the agent. Such benefit includes cellular or biological responses, a complete response, a partial response, a stable disease (without progression or relapse), or a response with a later relapse of the patient from or as a result of the treatment with the agent.

As used herein, "non-response" or "lack of response" or similar wording means an absence of a complete response, a partial response, or a beneficial response to treatment with a therapeutic agent.

"A patient maintains responsiveness to a treatment" when the patient's responsiveness does not decrease with time during the course of a treatment.

A "symptom" of a disease or disorder (e.g., inflammatory bowel disease, e.g., ulcerative colitis or Crohn's disease) is any morbid phenomenon or departure from the normal in structure, function, or sensation, experienced by a subject and indicative of disease.

"Mucosa-associated lymphoid tissue" or "MALT" refers to a diffuse system of small concentrations of lymphoid tissue found in various submucosal membrane sites of the body, such as the gastrointestinal tract, oral passage, nasopharyngeal tract, thyroid, breast, lung, salivary glands, eye, and skin.

"Gut-associated lymphoid tissue" or "GALT" refers to a part of the broader MALT and includes, e.g., Peyer's patches, mesenertic lymph nocdes, and isolated lymphoid follicles/intestinal lymphoid aggregates.

"Peyer's patches" refers to aggregated lymphoid modules organized into follicles and are important part of GALT. Peyer's patches are mainly present in the distal jejunum and the ileum.

"Mesenteric lymph nodes" refers to part of the paraaortic lymph node system that is a group of lymph nodes that lie between the layers of the mesentery and drain the gut tissues and deliver lymph to the thoracic duct. Mesenteric lymph nodes include the "superior mesenteric lymph nodes" which receive afferents from the jejunum, ileum, cecum, and the ascending and parts of the transverse colon. Mesenteric lymph nodes also include "inferior mesenteric lymph nodes" which are lymph nodes present throughout the hindgut. The hindgut, e.g., includes the distal third of the transverse colon and the splenic flexure, the descending colon, sigmoid colon, and the rectum. The lymph nodes drain into the superior mesenteric lymph nodes and ultimately to the preaortic lymph nodes.

"Paraaortic lymph nodes" refers to a group of mesenteric lymph nodes that lie in front of the lumbar vertebrae near the aorta. The paraaortic lymph nodes receive drainage from the gastrointestinal tract and the abdominal organs. Paraaortic lymph nodes include, e.g., retroaortic lymph nodes, lateral aortic lymph nodes, preaortic lymph nodes (e.g., Celiac, gastic, hepatic, and splenic lymph nodes), superior mesenteric lymph nodes (e.g., mesenteric, ilcocolic, and mesocolic lymph nodes), and inferior mesenteric lymph nodes (e.g., pararectal lymph nodes).

As used herein, "accuracy," when disclosed in connection with a specified location of a device within the GI tract of a subject, refers to the degree to which the location determined by the device conforms to the correct location, wherein the correct location is based on a generally accepted standard. The location within the GI tract of the subject determined by the device can be based on data, for example, light reflectance data, collected by the ingestible device. In some embodiments, the correct location can be based on external imaging devices, such as computer-aided tomography (CT), interpreted, for example, by a qualified clinician or physician. Therefore, percent accuracy ("% accuracy") can refer to the percentage agreement between the location of the device in the GI tract as determined by the device, and the correct location, for example, as determined by CT, e.g., expressed as [(number of devices in which location determined by the device agrees with location as determined by CT/total devices administered to the subject or subjects)× 100%], or, where only one device is administered per subject, [(number of subjects in which location determined by the device agrees with location as determined by CT/total number of subjects)×100%]. The latter formula for determining % accuracy was used in Example 14. In some embodiments, the accuracy with which the device determines a location refers to the accuracy with which the device determines that it is at a location pre-selected for drug release.

As used herein, an "autonomous device" refers to a device comprising one or more processors configured to independently control certain mechanisms or operations of the device while in the GI tract of a subject. Preferably, an autonomous device of the disclosure has no external electrical or wireless connections that control device mechanisms or operations, although connections such as wireless connections may be present to enable alternative device functions, such as transmitting data collected by the device to an external (ex vivo) system or receiver. The independently controlled mechanisms or operations of the autonomous device include, for example, triggering the release of a drug (or the formulation comprising the drug), triggering collection of one or more samples, and/or triggering the analysis of one or more samples; and/or determining the location of the device within the GI tract of the subject. Such mechanisms are referred to herein as "autonomous mechanisms," or, for example, an "autonomous triggering mechanism" or an "autonomous localization mechanism," respectively. Actively implementing such an autonomous triggering or autonomous localization mechanism is referred to as "autonomous triggering" or "autonomous localizing," respectively. An "autonomous localization mechanism" is synonymous with a "self-localization mechanism."

As used herein, a "housing" is a portion of an ingestible device that defines the boundary between the interior of the device and the environment exterior to the device.

As used herein, a "self-localizing device" refers to a device comprising a mechanism or system that can be implemented autonomously to determine the location of the ingestible device in vivo, e.g., within the GI tract of a subject. Such a mechanism is referred to as a "self-localization mechanism." A "self-localization mechanism" is synonymous with an "autonomous localization mechanism." A self-localizing device does not require ex vivo visualization devices or systems, for example, using scintigraphy or computer-aided tomography (CT), to localize in the GI tract.

As used herein, "localizing the device" refers to determining a location of the device.

As used herein, "sensor" refers to a mechanism or portion of a mechanism configured to collect information regarding the surroundings of the ingestible device. Examples of "sensors" include environmental sensors and light sensors. Examples of environmental sensors include pH sensors and sensors capable to identifying muscle contractions and/or peristalsis.

As used herein, "time following transition" refers to elapsed time after passage of the device from one portion, section or subsection of the GI tract into an adjacent portion, section or subsection of the GI tract.

As used herein, "proximate" as disclosed in connection with release of a drug from a device to one or more intended sites, refers to a location that is sufficiently spatially close to the one or more intended sites such that releasing the drug at the location treats an inflammatory condition in one or more tissues originating from the endoderm. For example, when the drug is released proximate to the one or more intended sites, the drug may be released 150 cm or less, such as 125 cm or less, such as 100 cm or less, such as 50 cm or less, such as 40 cm or less, such as 30 cm or less, such as 20 cm or less, such as 10 cm or less, such as 5 cm or less, such as 2 cm or less, from the one or more intended sites. The proximate location for drug release may be in the same section or subsection of the gastrointestinal tract as the one or more intended sites. In the alternative, the proximate location for drug release may be in a different section or subsection of the GI tract than the one or more disease sites; for example, the drug release may be proximal or distal to the one or more intended sites. In a non-limiting example, the drug may be released in the cecum to treat a site of disease tissue in the ascending colon (i.e., distal to the cecum). In another non-limiting example, the drug may be released in the cecum to treat a site of disease tissue in one or more of the ascending colon, transverse colon, descending colon, or rectum. In another non-limiting example, the drug may be released in the cecum to treat a site of disease tissue in one or more of the ileum, jejunum, or duodenum. In another non-limiting example, the drug may be released in the cecum to treat a site of disease tissue in one or more of the liver or pancrease. Thus, where the present application refers to release of a drug proximate to an intended site, this may in some embodiments refer to release in a section or subsection of the GI tract. The intended site may be selected from esophagus, stomach, duodenum, jejenum, ileum, cecum, ascending colon, transverse colon, descending colon, and rectum. The section or subsection may be selected from proximal duodenum, proximal jejenum, proximal ileum, cecum, proximal ascending colon, proximal transverse colon, proximal descending colon, distal duodenum, distal jejenum, distal ileum, distal ascending colon, distal transverse colon, or distal descending colon.

As used herein, "proximal", when used in connection with an anatomical structure, refers to a portion, section, or subsection that precedes, or is upstream of, an adjacent portion, section, or subsection of the anatomical structure. In some embodiments, proximal refers to a portion, section, or subsection that immediately precedes, or is immediately upstream of, an immediately adjacent portion, section, or subsection of the anatomical structure.

As used herein, "distal," when used in connection with an anatomical structure, refers to a portion, section, or subsection that follows, or is downstream of, an adjacent portion, section, or subsection of the anatomical structure. In some embodiments, distal refers to a portion, section, or subsection that immediately follows, or is immediately downstream of, an immediately adjacent portion, section, or subsection of the anatomical structure.

As used herein, the "total induction dose" is the sum of induction doses over a given time period.

As used herein, the term "adhesion" refers to the ability of the formulations of the disclosure to bind to the site of topical administration, e.g., mucoses (e.g., a mucosal lining of the gastrointestinal tract of a subject), upon contact, whereby when they are brought into contact work must be done in order to separate them. The adhesion can be measured by a texture analyzer, e.g., TA.XT Plus (Texture Technologies). For example, a 40-mm diameter disk can be compressed into the gel and redrawn. The method settings, including speed rate at 1 mm/second and distance (depth of the insertion) of 9-mm can be assessed at the desired temperature, e.g., at 22° C., 25° C. or at 37° C. The adhesion is measured in mN/s units. The more negative the value in mN/s, the more adhesive the composition will be. Thus, for example a composition showing a measurement value of −100 mN/s is more adhesive than a composition showing a lower measurement value of e.g., −50 mN/s.

As used herein, the term "thermoreversible" or equivalent expressions thereof such as "thermally reversible" applied to the composition means that it exhibits reverse thermogellation, i.e., it undergoes a change in viscosity when the temperature varies. In some embodiments, the composition is liquid at room temperature and forms a gel at body temperature. The liquid state at room temperature facilitates the administration of the composition when it is to be administered, e.g., to the gastrointestinal mucosa, by using an appropriate delivery device, such as for example an ingestible device as disclosed herein. When the composition is released from the device and comes into contact with the mucosa at body temperature, its viscosity increases to a higher viscosity state, hence acquiring the consistency of a gel. This has the advantage that the composition remains on the surface of the affected area.

The terms "pharmaceutically acceptable carrier," "pharmaceutically acceptable diluent" and "pharmaceutically acceptable excipient" include any and all solvents, co-solvents, complexing agents, dispersion media, coatings, isotonic and absorption delaying agents and the like which are not biologically or otherwise undesirable. The use of such media and agents for pharmaceutically active substances is well known in the art. Except insofar as any conventional media or agent is incompatible with the active ingredient, its use in the therapeutic formulations is contemplated. Supplementary active ingredients can also be incorporated into the formulations. In addition, various adjuvants such as are commonly used in the art may be included. These and other such therapeutic agents are described in the literature, e.g., in the Merck Index, Merck & Company, Rahway, N.J. Considerations for the inclusion of various components in pharmaceutical formulations are described, e.g., in Gilman et al. (Eds.) (2010); Goodman and Gilman's: The Pharmacological Basis of Therapeutics, 12th Ed., The McGraw-Hill Companies.

As used herein, the term "pharmaceutically acceptable salt" refers to those salts of compounds disclosed herein that are safe and effective for use in mammals, including humans, and that possess the desired biological activity. Pharmaceutically acceptable salts are known to the person of ordinary skill in the art. In a non-limiting example, when the compound has an acidic group such as carboxyl group in the formula, the salts can be salts thereof with alkali metals, e.g. sodium, potassium and ammonium, salts thereof with alkaline earth metals, e.g. calcium and magnesium, salts thereof with aluminum and zinc, salts thereof with organic amines, e.g. triethylamine, ethanolamine, morpholine, piperidine and dicyclohexylamine, and salts thereof with basic amino acids, e.g. arginine and lysine. In a non-limiting example, when the compound has a basic group in the formula, the salts can be those with inorganic acids, e.g., hydrochloric acid, sulfuric acid and phosphoric acid; those with organic carboxylic acids, e.g. acetic acid, citric acid, benzoic acid, maleic acid, fumaric acid, tartaric acid and succinic acid; and those with organosulfonic acids, e.g., methanesulfonic acid and p-toluenesulfonic acid. The salts can be formed by mixing a compound with a necessitated acid or base in a proper ratio in a solvent or dispersing agent or by the cation exchange or anion exchange reaction with another salt.

As used herein, a reference to a drug's international nonproprietary name (INN) is to be interpreted as including generic, bioequivalent and biosimilar versions of that drug, including but not limited to any drug that has received abbreviated regulatory approval by reference to an earlier regulatory approval of that drug. Additionally, all drugs disclosed herein optionally include the pharmaceutically acceptable salts and solvates of the drugs thereof, unless expressly indicated otherwise.

As used herein, each listed small molecule, peptide or nucleic acid agent optionally includes a pharmaceutically acceptable salt thereof, whether or not such a form is expressly indicated. Each listed antibody agent optionally includes a biosimilar thereof, whether or not such a biosimilar is expressly indicated.

Inflammatory Conditions or Diseases that Arise from a Tissue Originating from the Endoderm The present claimed methods are based, in part, on the unexpected discovery that the administration of an immune modulator to a section or subsection of a subject's gastrointestinal tract (e.g., at an intended site) results in the observation of pharmacodynamic effects in tissues that are beyond the site of release (e.g., proximal to the site of immune modulator administration or in a different tissue or organ). For example, an immune modulator administered to a section or subsection of a subject's gastrointestinal tract can result in one or more of the following: changes in anatomical features, including suppressed or reduced development, aggregation, or accumulation of one or more of intestinal lymphoid tissues, isolated lymphoid follicles (ILFs), or intestinal lymphoid aggregates; suppressed immune response, including fewer T cells measured in lymph nodes or lymph tissues (which results in greater T cells forced into circulation, i.e., blood); decreased differentiation of immune cells (e.g., as measured using histology or through the use of a sampling device, or using a sampling device); a decreased level of inflammatory cytokine levels (e.g., as measured using biopsy or through the use of a sampling device); decreased endoscopic scoring; improved efficacy of treatment for IBD (e.g., using any of the clinical assessments of a treatment for IBD described herein), and decreased inflammation (e.g., a decrease in liver inflammation associated with NAFLD or NASH).

The presently claimed devices can, e.g., provide for a higher concentration of α4β7 expressing cells in the periphery (e.g., blood) when an immune modulator is delivered topically to one or more parts of the GI tract distal to the stomach (e.g., the small or large intestine) as compared to when the same dose of the immune modulator is systemically administered. The presently claimed devices can, e.g., result in trafficked cells being forced out of the local gastrointestinal tissue (including the mucosa) and lymph system, and back into systemic circulation of a subject.

Accordingly, also provided herein are methods of treating a disease or condition that arises in a tissue originating from the endoderm. The endoderm forms the gastrointestinal tract, respiratory tract, endocrine glands, and organs, the auditory system and urinary system. Thus, the present disclosure includes compositions and devices for treating diseases and conditions found in the following tissues that originate from the endoderm (e.g., the stomach, the colon, the liver, the pancreas, the urinary bladder, the epithelial parts of the trachea, the lungs, the pharynx, the thyroid, the parathyroid, the intestines, and the gallbladder). Also provided herein are methods of treating a disease or a condition that arises in a tissue originating from the endoderm (e.g., any of the exemplary diseases or conditions that arise in a tissue originating from the endoderm described herein) that include intrathecally releasing one or more immune modulators in the small or large intestine using any of the devices or compositions described herein.

Non-limiting examples of a disease or condition that arises in a tissue originating from the endoderm includes gastritis, Celiac disease, hepatitis, alcoholic lever disease, fatty liver disease (hepatic steatosis), non-alcoholic fatty liver disease (NAFLD), non-alcoholic steatohepatitis (NASH), cirrhosis, primary schlerosing cholangitis, pancreatitis, insterstitial cystitits, asthma, chronic obstructive pulmonary disease, pulmonary fibrosis, pharyngitis, thyroiditis, hyperthyroidism, parathyroiditis, nephritis, Hashimoto's disease, Addison's disease, Graves' disease, Sjögren syndrome, type 1 diabetes, pelvic inflammatory disease, auditory canal inflammation, tinnitus, vestibular neuritis, otitis media, auditory canal inflammation, tracheitis, cholestatic liver disease, primary biliary sclerosis, liver parenchyma, an inherited metabolic disorder of the liver, Byler syndrome, cerebrotendinous, xanthomatosis, Zellweger's syndrome, neonatal hepatitis, cystic fibrosis, ALGS (Alagilles syndrome), PFIC (progressive familial intrahepatic cholestasis), autoimmune hepatitis, primary biliary cirrhosis (PBC), liver fibrosis, portal hypertension, general cholestasis, such as in jaundice due to drugs or during pregnancy, intra- and extrahepatic cholestasis, such as hereditary forms of cholestasis, such as PFIC1, gall stones and choledocholithiasis, malignancy causing obstruction of the biliary tree, symptoms (scratching, pruritus) due to cholestasis/jaundice, chronic autoimmune liver disease leading to progressive cholestasis, and pruritus of cholestatic liver disease, duodenal ulcers, enteritis (radiation-, chemotherapy-, or infection-induced enteritis), diverticulitis, pouchitis, cholecystitis, and cholangitis. Additional examples of diseases and conditions that arise in a tissue originating from the endoderm are known in the art.

In some embodiments of any of the methods described herein, the methods result in the release of the immune modulator to one or more of the following, or the PD effects of the immune modulator (e.g., any of the PD effects of immune modulators described herein) are detectable in one or more of the following: throughout or in part of the paraaortic lymph nodes, throughout or in part of the MALT, throughout or in part of the GALT, throughout or in part of the inferior and superior mesenteric lymph nodes, and in one or more sections or subsections of the subject's gastrointestinal tract that is different than the section or subsection of the subject's gastrointestinal tract where the immune modulator is released.

In some embodiments of any of the methods described herein, the methods do not result in (or do not result in a significant effect in) pharmacodynamic effects (e.g., any of the clinical effects or measurements of an immune modulator described herein) outside of the paraaortic lymph nodes.

In some embodiments of any of the methods described herein, the methods do not result in (or do not result in a significant effect in) pharmacodynamic effects (e.g., any of the clinical effects or measurements of an immune modulator described herein) outside of the MALT.

In some embodiments of any of the methods described herein, the methods do not result in (or do not result in a significant effect in) pharmacodynamic effects (e.g., any of the clinical effects or measurements of an immune modulator described herein) outside of the GALT.

In any of the methods described herein, the subject can be any mammal (e.g., an animal model of any of the diseases described herein).

In some embodiments of any of the methods described herein, the method results in the suppression of the subject's immune response in one or more of the paraaortic lymph nodes.

In some embodiments of any of the methods described herein, the method results in the suppression of the subject's immune response in mucosa-associated lymphoid tissue (MALT).

In some embodiments of any of the methods described herein, the method results in the suppression of the subject's immune response throughout or in part of the gut-associated lymphoid tissue (GALT). For example, in some embodiments of any of the methods described herein, the method results in a reduction of T cells (e.g., any of the T cells described herein, e.g., memory T cells) in Peyer's patches and/or mesenteric lymph nodes found in the GALT. In some embodiments of any of the methods described herein, the method results in a decreased level of T cells (e.g., any of the types of T cells described herein or known in the art) in a section or subsection of the subject's gastrointestinal tract that is different than the section or subsection of the subject's gastrointestinal tract where the immune modulator is released.

In some embodiments of any of the methods described herein, the method results in the suppression or reduction in the development, the aggregation, or accumulation of one or more of intestinal lymphoid tissues, isolated lymphoid follicles (ILFs), or intestinal lymphoid aggregates in mucosa-associated lymphoid tissue (MALT). In some embodiments of any of the methods described herein, the method results in the suppression of the development of one or more of intestinal lymphoid tissues, isolated lymphoid follicles, or intestinal lymphoid aggregates in gut-associated lymphoid tissue (GALT). In some embodiments of any of the methods described herein, the method results in the suppression of the immune response in one or more sections or subsections of the subject's gastrointestinal tract that is different than the section or subsection of the subject's gastrointestinal tract where the drug is released.

In some embodiments of any of the methods described herein, the methods result in pharmacodynamic effects proximal ("upstream") to the site of disease in the subject. For example, in some embodiments of any of the methods described herein, the immune modulator is released in the cecum, but pharmacodynamic effects of the immune modulator are observed in the ileum and/or jejunum. In some embodiments of any of the methods described herein, the immune modulator is released in the cecum and immune suppression is observed throughout the mesenteric lymph system and other systems of the paraaortic lymph nodes, including the hepatic lymph nodes of the celiac group of the preaortic lymph nodes (preaortic lymph nodes are part of the paraaortic lymph nodes). In some embodiments of any of the methods described herein, the immune modulator is released in the small intestine (e.g., duodenum, jejunum, or ileum) or colon (e.g., ascending colon, transverse colon, descending colon, rectum, or cecum), but pharmacodynamic effects of the immune modulator are throughout or in part of the MALT, GALT, Peyer's patches, mesenteric lymph nodes, paraaortic lymph nodes, or any of the other tissues originating from the endoderm described herein or known in the art, in the mammal.

In some embodiments of any of the methods described herein, the method results in a decreased level or a decreased level of activation of one or more of the following immune cells that participate in mucosal immune response in a mammal: microfold cells (M cells), antigen-presenting cells (e.g., B-lymphocytes, dendritic cells, and macrophages), and effector cells (e.g., T-lymphocytes).

Microfold cells (M cells) are found in the gut-associated lymphoid tissue (GALT) of the Peyer's patches in the small intestine. M cells allow for the transport of microbes and particles across the epithelial cell layer from the gut lumen to the lamina propria where interactions with immune cells can take place. M cells provide for the initiation of mucosal immunity responses on the apical membrane by delivering antigens to antigen-presenting cells.

Antigen-presenting cells (APCs) include B-lymphocytes, dendritic cells, and macrophages. B-lymphocytes, also called B-cells, can internalize antigen that binds to their B-cell receptor. Dendritic cells have the broadest range of antigen presentation and are necessary for activation of naïve T cells. Dendritic cells present antigen to both helper and cytotoxic T cells. Macrophages can be stimulated by T-cell secretion of interferon gamma. After this activation, macrophages are able to express major histocompatibility complex (MHC) class II and co-stimulatory molecules, and can present phagocytosed peptide fragments to helper T cells. The activation of macrophages can assist pathogen-infected macrophages in clearing the infection.

MHCs bind antigens derived from pathogens and display them on the cell surface for recognition by appropriate T-cells. MHC class I presents antigens from intracellular pathogens, such as viruses and bacteria. MHC class II presents antigens from phagocytosed/pinocytosed pathogens.

Effector cells, as used herein, include T-lymphocytes, including $CD4^+$ (also called helper T cells), $CD8^+$ (also called cytotoxic T cells), $CD45Rb^-$ (more IL-10 and less $TNF\alpha$ in IBD) as compared with $CD4^+CD45Rb^+$, and $CD44^+$ T cells. CD44 participates in lymphocytes activation, recirculation, and homing, and is an indicative marker for effector memory T cells.

Activity and/or Expression of Immune Modulators

As used herein, the term "immune modulator" refers to an agent that results/causes/affects one or more of: (a) a decrease in the activation of an immune cell, e.g., as compared to the level of activation in the absence of the agent; (2) a decrease in the secretion or expression of a pro-inflammatory cytokine, e.g., as compared to the level of recruitment or migration in the absence of the agent; (3) a decrease in the recruitment or migration of T-lymphocytes, e.g., as compared to the level of recruitment or migration in the absence of the agent; and (4) an increase in the secretion or expression of an anti-inflammatory cytokine, e.g., as compared to the level of secretion or expression in the absence of the agent. In some embodiments, the immune cell is a T cell, such as a memory T cell. In some embodiments, the T-lymphocyte is a memory T-lymphocyte.

Non-limiting examples of immune modulators are anti-inflammatory agents. Non-limiting examples of anti-inflammatory agents include IL-12/IL-23 inhibitors, $TNF\alpha$ inhibitors, IL-6 receptor inhibitors, CD40/CD40L inhibitors, CD3 inhibitors, CD14 inhibitors, CD20 inhibitors, CD25 inhibitors, CD28 inhibitors, CD49 inhibitors, CD89 inhibitors, IL-1 inhibitors, IL-13 inhibitors, IL-10 receptor agonists, chemokine/chemokine receptor inhibitors, integrin inhibitors, S1P modulators and PDF4 inhibitors. Non-limiting examples of integrin inhibitors include $\beta7$ integrin inhibitors, such as $\alpha4\beta7$ integrin inhibitors.

In some embodiments, the immune modulator is useful for the treatment of a liver disease or disorder.

An immune modulator can be an antibody or antigen-binding fragment, a nucleic acid (e.g., inhibitory nucleic acid), a small molecule, and a live biotherapeutic, such as a probiotic. In some embodiments, the immune modulator can be a drug or therapeutic used for the treatment of inflammatory bowel disease (IBD), for example, Crohn's Disease or Ulcerative Colitic (UC). Non-limiting immune modulators that useful for treating or preventing inflammatory bowel disease include substances that suppress cytokine production, down-regulate or suppress self-antigen expression, or mask MHC antigens. Non-limiting examples of immune modulators include, without limitation: CHST15 inhibitors (e.g., STNM01); IL-6 receptor inhibitora (e.g., tocilizumab); IL-12/IL-23 inhibitors (e.g., ustekinumab and brazikumab); integrin inhibitors (e.g., vedolizumab and natalizumab); JAK inhibitors (e.g., tofacitinib); SMAD7 inhibitors (e.g., Mongersen); IL-13 inhibitors; IL-1 receptor inhibitors; TLR agonists (e.g., Kappaproct); stem cells (e.g., Cx601); 2-amino-6-aryl-5-substituted pyrimidines (see U.S. Pat. No. 4,665,077); nonsteroidal anti-inflammatory drugs (NSAIDs); ganciclovir; tacrolimus; glucocorticoids such as Cortisol or aldosterone; anti-inflammatory agents such as a cyclooxygenase inhibitor; a 5-lipoxygenase inhibitor; or a leukotriene receptor antagonist; purine antagonists such as azathioprine or mycophenolate mofetil (MMF); alkylating agents such as cyclophosphamide; bromocryptine; danazol; dapsone; glutaraldehyde (which masks the MHC antigens, as described in U.S. Pat. No. 4,120,649); anti-idiotypic antibodies for MHC antigens and MHC fragments; cyclosporine; 6-mercaptopurine; steroids such as corticosteroids or glucocorticosteroids or glucocorticoid analogs, e.g., prednisone, methylprednisolone, including SOLU-MEDROL®, methylprednisolone sodium succinate, and dexamethasone; dihydrofolate reductase inhibitors such as methotrexate (oral or subcutaneous); anti-malarial agents such as chloroquine and hydroxychloroquine; sulfasalazine; leflunomide; cytokine or cytokine receptor antibodies or antagonists including anti-interferon-alpha,-beta, or -gamma antibodies, anti-tumor necrosis factor (TNF)-alpha antibodies (infliximab (REMICADE®) or adalimumab), anti-TNF-alpha immunoadhesin (etanercept), anti-TNF-beta antibodies, antiinterleukin-2 (IL-2) antibodies and anti-IL-2 receptor antibodies, and anti-interleukin-6 (IL-6) receptor antibodies and antagonists; anti-LFA-1 antibodies, including anti-CD 11a and anti-CD 18 antibodies; anti-L3T4 antibodies; heterologous anti-lymphocyte globulin; pan-T antibodies, anti-CD3 or anti-CD4/CD4a antibodies; soluble peptide containing a LFA-3 binding domain (WO 90/08187 published Jul. 26, 1990); streptokinase; transforming growth factor-beta (TGF-beta); streptodomase; RNA or DNA from the host; FK506; RS-61443; chlorambucil; deoxysperguain; rapamycin; T-cell receptor (Cohen et al, U.S. Pat. No. 5,114,721); T-cell receptor fragments (Offner et al, Science, 251:430-432 (1991); WO 90/11294; laneway, Nature, 341: 482 (1989); and WO 91/01133); BAFF antagonists such as BAFF or BR3 antibodies or immunoadhesins and zTNF4 antagonists (for review, see Mackay and Mackay, Trends Immunol, 23:113-5 (2002) and see also definition below); 10 biologic agents that interfere with T cell helper signals, such as anti-CD40 receptor or anti-CD40 ligand (CD 154), including blocking antibodies to CD40-CD40 ligand. (e.g., Durie et al, Science, 261:1328-30 (1993); Mohan et al, J. Immunol, 154:1470-80 (1995)) and CTLA4-Ig (Finck et al, Science, 265:1225-7 (1994)); and T-cell receptor antibodies (EP 340,109) such as T10B9. Non-limiting examples of agents also include the following: budenoside; epidermal growth factor; aminosalicylates; metronidazole; mesalamine; olsalazine; balsalazide; antioxidants; thromboxane inhibitors; IL-1 receptor antagonists; anti-IL-1 monoclonal antibodies; growth factors; elastase inhibitors; pyridinylimidazole compounds; TNF antagonists; IL-4, IL-10, IL-13 and/or TGFβ cytokines or agonists thereof (e.g., agonist antibodies); IL-11; glucuronide- or dextran-conjugated prodrugs of prednisolone, dexamethasone or budesonide; ICAM-I antisense phosphorothioate oligodeoxynucleotides (ISIS 2302; Isis Pharmaceuticals, Inc.); soluble complement receptor 1 (TPIO; T Cell Sciences, Inc.); slow-release mesalazine; antagonists of platelet activating factor (PAF); ciprofloxacin; and lignocaine.

Non-limiting examples of immune modulators that are useful for treating ulcerative colitis include sulfasalazine and related salicylate-containing drugs for mild cases and corticosteroid drugs for severe cases. Non-limiting examples of immune modulators that are useful for treating a liver disease or disorder (e.g., liver fibrosis or NASH) include: elafibranor (GFT 505; Genfit Corp.), obeticholic acid (OCA; Intercept Pharmaceuticals, Inc.), cenicriviroc (CVC; Allergan plc), selonsertib (formerly GS-4997; Gilead Sciences, Inc.), an anti-LOXL2 antibody (simtuzumab (formerly GS 6624; Gilead Sciences, Inc.)), GS-9450 (Gilead Sciences, Inc.), GS-9674 (Gilead Sciences, Inc.), GS-0976 (formerly NDI-010976; Gilead Sciences, Inc.), Emricasan (Conatus Pharmaceuticals, Inc.), Arachidyl-amido cholanoic acid (Aramchol™; Galmed Pharmaceuticals Ltd.), AKN-083 (Allergan plc (Akarna Therapeutics Ltd.)), TGFTX4 (Genfit Corp.), TGFTX5 (Genfit Corp.), TGFTX1 (Genfit Corp.), a RoRK agonist (e.g., LYC-55716; Lycera Corp.), an ileal bile acid transporter (iBAT) inhibitor (e.g., elobixibat, Albireo Pharma, Inc.; GSK2330672, GlaxoSmithKline plc; and A4250; Albireo Pharma, Inc.), stem cells, a CCR2 inhibitor, bardoxolone methyl (Reata Pharmaceuticals, Inc.), a bone morphogenetic protein-7 (BMP-7) mimetic (e.g., THR-123 (see, e.g., Sugimoto et al. (2012) Nature Medicine 18:396-404)), an anti-TGF-β antibody (e.g., fresolimumab; see also U.S. Pat. Nos. 7,527,791 and 8,383,780, incorporated herein by reference), pirfenidone (Esbriet®, Genentech USA Inc.), an anti-integrin αvβ6 antibody, an anti-connective tissue growth factor (CTGF) antibody (e.g., pamrevlumab; FibroGen Inc.), pentoxifylline, vascular endothelial growth factor (VEGF), a renin angiotensin aldosterone system (RAAS) inhibitor (e.g., a rennin inhibitor (e.g. pepstatin, CGP2928, aliskiren), or an ACE inhibitor (e.g., captopril, zofenopril, enalapril, ramipril, quinapril, perindopril, lisinopril, benazepril, imidapril, fosinopril, and trandolapril)), thrombospondin, a statin, bardoxolone, a PDE5 inhibitor (e.g., sidenafil, vardenafil, and tadalafil), a NADPH oxidase-1 (NOX1) inhibitor (see, e.g., U.S. Publication No. 2011/0178082, incorporated herein by reference), a NADPH oxidase-4 (NOX4) inhibitor (see, e.g., U.S. Publication No. 2014/0323500, incorporated herein by reference), an ETA antagonist (e.g., sitaxentan, ambrisentan, atrasentan, BQ-123, and zibotentan), nintedanib (Boehringer Ingelheim), INT-767 (Intercept Pharmaceuticals, Inc.), VBY-376 (Virobay Inc.), PF-04634817 (Pfizer), EXC 001 (Pfizer), GM-CT-01 (Galectin Therapeutics), GCS-100 (La Jolla Pharmaceuticals), hepatocyte growth factor mimetic (Refanalin®; Angion Biomedica), SAR156597 (Sanofi), tralokinumab (AstraZeneca), pomalidomide (Celgene), STX-100 (Biogen IDEC), CC-930 (Celgene), anti-miR-21 (Regulus Therapeutics), PRM-151 (Promedior), BOT191 (BiOrion), Palomid 529 (Paloma Pharmaceuticals), IMD1041 (IMMD, Japan), serelaxin (Novartis), PEG-relaxin (Ambrx and Bristol-Myers Squibb), ANG-4011 (Angion Biomedica), FT011 (Fibrotech Therapeutics), pirfenidone (InterMune), F351 (pirfenidone derivative (GNI Pharma), vitamin E (e.g., tocotrienol (alpha, beta, gamma, and delta) and tocopherol (alpha, beta, gamma, and delta)), pentoxifylline, an glp sensitizer (e.g., rosiglitazone and pioglitazone), cathepsin B inhibitor R-3020, etanercept and biosimilars thereof, peptides that block the activation of Fas (see, e.g., International Publication No. WO 2005/117940, incorporated herein by reference), caspase inhibitor VX-166, caspase inhibitor Z-VAD-fmk, fasudil, belnacasan (VX-765), and pralnacasan (VX-740).

Therapeutic agents that may be used for the treatment of the indications herein also include: TNF inhibitors: tulinercept, DLX-105 (gel formulation); IL-12/11-23 inhibitors: AK-101; IL-6R inhibitors: YSIL6, olokizumab (CDP-6038); JAK inhibitors: PF-06700841, PF-06651600; live biotherapeutics: Neuregulin 4; NN8555; immune modulators: KHK-4083, GSK2618960, Toralizumab: chemokines: GSK3050002 (previously known as KANAb071), E-6011, HGS-1025; IL-1 inhibitors: K(D)PT; IL-10 inhibitors: RG-7880; CHST15 inhibitors: SB-012; and TLR agonists: BL-7040; EN-101; Monarsen.

Non-limiting exemplary examples of immune modulators are described in this disclosure. Additional examples of immune modulators are known in the art.

Activity and/or Expression of Immune Modulators

In some embodiments, an immunomodulator can decrease drug target activity and the level of the target protein in a mammalian cell. In some embodiments, an immune modulator can decrease (e.g., by about 1% to about 99%, by about 1% to about 95%, by about 1% to about 90%, by about 1% to about 85%, by about 1% to about 80%, by about 1% to about 75%, by about 1% to about 70%, by about 1% to about 65%, by about 1% to about 60%, by about 1% to about 55%, by about 1% to about 50%, by about 1% to about 45%, by about 1% to about 40%, by about 1% to about 35%, by about 1% to about 30%, by about 1% to about 25%, by about 1% to about 20%, by about 1% to about 20%, by about 1% to about 15%, by about 1% to about 10%, by about 1% to about 5%, by about 5% to about 99%, by about 5% to about 90%, by about 5% to about 85%, by about 5% to about 80%, by about 5% to about 75%, by about 5% to about 70%, by about 5% to about 65%, by about 5% to about 60%, by about 5% to about 55%, by about 5% to about 50%, by about 5% to about 45%, by about 5% to about 40%, by about 5% to about 35%, by about 5% to about 30%, by about 5% to about 25%, by about 5% to about 20%, by about 5% to about 15%, by about 5% to about 10%, by about 10% to about 99%, about 10% to about 95%, about 10% to about 90%, about 10% to about 85%, by about 10% to about 80%, by about 10% to about 75%, by about 10% to about 70%, by about 10% to about 65%, by about 10% to about 60%, by about 10% to about 55%, by about 10% to about 50%, by about 10% to about 45%, by about 10% to about 40%, by about 10% to about 35%, by about 10% to about 30%, by about 10% to about 25%, by about 10% to about 20%, by about 10% to about 15%, by about 15% to about 99%, by about 15% to about 95%, by about 15% to about 90%, by about 15% to about 85%, by about 15% to about 80%, by about 15% to about 75%, by about 15% to about 70%, by about 15% to about 65%, by about 15% to about 60%, by about 15% to about 55%, by about 15% to about 50%, by about 15% to about 45%, by about 15% to about 40%, by about 15% to about 35%, by about 15% to about 30%, by about 15% to about 25%, by about 15% to about 20%, by about 20% to about 99%, by about 20% to about 95%, by about 20% to about 90%, by about 20% to about 85%, by about 20% to about 80%, by about 20% to about 75%, by about 20% to about 70%, by about 20% to about 65%, by about 20% to about 60%, by about 20% to about 55%, by about 20% to about 50%, by about 20% to about 45%, by about 20% to about 40%, by about 20% to about 35%, by about 20% to about 30%, by about 20% to about 25%, by about 25% to about 99%, about 25% to about 95%, by about 25% to about 90%, by about 25% to about 85%, by about 25% to about 80%, by about 25% to about 75%, by about 25% to about 70%, by about 25% to about 65%, by about 25% to about 60%, by about 25% to about 55%, by about 25% to about 50%, by about 25% to about 45%, by about 25% to about 40%, by about 25% to about 35%, by about 25% to about 30%, by about 30% to about 99%, by about 30% to about 95%, by about 30% to about 90%, by about 30% to about 85%, by about 30% to about 80%, by about 30% to about 75%, by about 30% to about 70%, by about 30% to about 65%, by about 30% to about 60%, by about 30% to about 55%, by about 30% to about 50%, by about 30% to about 45%, by about 30% to about 40%, by about 30% to about 35%, by about 35% to about 99%, by about 35% to about 95%, by about 35% to about 90%, by about 35% to about 85%, by about 35% to about 80%, by about 35% to about 75%, by about 35% to about 70%, by about 35% to about 65%, by about 35% to about 60%, by about 35% to about 55%, by about 35% to about 50%, by about 35% to about 45%, by about 35% to about 40%, by about 40% to about 99%, by about 40% to about 95%, by about 40% to about 90%, by about 40% to about 85%, by about 40% to about 80%, by about 40% to about 75%, by about 40% to about 70%, by about 40% to about 65%, by about 40% to about 60%, by about 40% to about 55%, by about 40% to about 50%, by about 40% to about 45%, by about 45% to about 99%, by about 45% to about 95%, by about 45% to about 90%, by about 45% to about 85%, by about 45% to about 80%, by about 45% to about 75%, by about 45% to about 70%, by about 45% to about 65%, by about 45% to about 60%, by about 45% to about 55%, by about 45% to about 50%, by about 50% to about 99%, by about 50% to about 95%, by about 50% to about 90%, by about 50% to about 85%, by about 50% to about 80%, by about 50% to about 75%, by about 50% to about 70%, by about 50% to about 65%, by about 50% to about 60%, by about 50% to about 55%, by about 55% to about 99%, by about 55% to about 95%, by about 55% to about 90%, by about 55% to about 85%, by about 55% to about 80%, by about 55% to about 75%, by about 55% to about 70%, by about 55% to about 65%, by about 55% to about 60%, by about 60% to about 99%, by about 60% to about 95%, by about 60% to about 90%, by about 60% to about 85%, by about 60% to about 80%, by about 60% to about 75%, by about 60% to about 70%, by about 60% to about 65%, by about 65% to about 99%, by about 65% to about 95%, by about 65% to about 90%, by about 65% to about 85%, by about 65% to about 80%, by about 65% to about 75%, by about 65% to about 70%, by about 70% to about 99%, by about 70% to about 95%, by about 70% to about 90%, by about 70% to about 85%, by about 70% to about 80%, by about 70% to about 75%, by about 75% to about 99%, by about 75% to about 95%, by about 75% to about 90%, by about 75% to about 85%, by about 75% to about 80%, by about 80% to about 99%, by about 80% to about 95%, by about 80% to about 90%, by about 80% to about 85%, by about 85% to about 99%, by about 85% to about 95%, by about 85% to about 90%, by about 90% to about 99%, by about 90% to about 95%, or by about 95% to about 99%) in the level of target protein in a mammalian cell contacted with the agent, e.g., as compared to the level of target protein in the same mammalian cell not contacted with the agent.

In some embodiments, an immune modulator can inibibit drug target activity with an $IC_{50}$ of about 1 pM to about 100 TM, about 1 pM to about 95 TM, about 1 pM to about 90 TM, about 1 pM to about 85 TM, about 1 pM to about 80 TM, about 1 pM to about 75 TM, about 1 pM to about 70 TM, about 1 pM to about 65 TM, about 1 pM to about 60 TM, about 1 pM to about 55 TM, about 1 pM to about 50 TM, about 1 pM to about 45 TM, about 1 pM to about 40 TM, about 1 pM to about 35 TM, about 1 pM to about 30 TM, about 1 pM to about 25 TM, about 1 pM to about 20 TM, about 1 pM to about 15 TM, about 1 pM to about 10 TM, about 1 pM to about 5 TM, about 1 pM to about 1 TM, about 1 pM to about 900 nM, about 1 pM to about 800 nM, about 1 pM to about 700 nM, about 1 pM to about 600 nM, about 1 pM to about 500 nM, about 1 pM to about 400 nM, about 1 pM to about 300 nM, about 1 pM to about 200 nM, about 1 pM to about 100 nM, about 1 pM to about 50 nM, about 1 pM to about 1 nM, about 1 pM to about 800 pM, about 1 pM to about 600 pM, about 1 pM to about 400 pM, about 1 pM to about 200 pM, about 200 pM to about 100 TM, about 200 pM to about 95 TM, about 200 pM to about 90 TM, about 200 pM to about 85 TM, about 200 pM to about 80 TM, about 200 pM to about 75 TM, about 200 pM to about 70 TM, about 200 pM to about 65 TM, about 200 pM to about 60 TM, about 200 pM to about 55 TM, about 200 pM to about 50 TM, about 200 pM to about 45 TM, about 200 pM to about 40 TM, about 200 pM to about 35 TM, about 200 pM to about 30 TM, about 200 pM to about 25 TM, about 200 pM to about 20 TM, about 200 pM to about 15 TM, about 200 pM to about 10 TM, about 200 pM to about 5 TM, about 200 pM to about 1 TM, about 200 pM to about 900 nM, about 200 pM to about 800 nM, about 200 pM to about 700 nM, about 200 pM to about 600 nM, about 200 pM to about 500 nM, about 200 pM to about 400 nM, about 200 pM to about 300 nM, about 200 pM to about 200 nM, about 200 pM to about 100 nM, about 200 pM to about 50 nM, about 200 pM to about 1 nM, about 200 pM to about 800 pM, about 200 pM to about 600 pM, about 200 pM to about 400 pM, about 400 pM to about 100 TM, about 400 PM to about 95 TM, about 400 pM to about 90 TM, about 400 pM to about 85 TM, about 400 pM to about 80 TM, about 400 pM to about 75 TM, about 400 pM to about 70 TM, about 400 PM to about 65 TM, about 400 pM to about 60 TM, about 400 pM to about 55 TM, about 400 pM to about 50 TM, about 400 pM to about 45 TM, about 400 pM to about 40 TM, about 400 pM to about 35 TM, about 400 pM to about 30 TM, about 400 pM to about 25 TM, about 400 PM to about 20 TM, about 400 pM to about 15 TM, about 400 pM to about 10 TM, about 400 PM to about 5 TM, about 400 PM to about 1 TM, about 400 PM to about 900 nM, about 400 PM to about 800 nM, about 400 pM to about 700 nM, about 400 pM to about 600 nM, about 400 pM to about 500 nM, about 400 pM to about 400 nM, about 400 pM to about 300 nM, about 400 pM to about 200 nM, about 400 pM to about 100 nM, about 400 pM to about 50 nM, about 400 pM to about 1 nM, about 400 pM to about 800 pM, 400 pM to about 600 pM, about 600 pM to about 100 TM, about 600 pM to about 95 TM, about 600 pM to about 90 TM, about 600 pM to about 85 TM, about 600 pM to about 80 TM, about 600 PM to about 75 TM, about 600 pM to about 70 TM, about 600 pM to about 65 TM, about 600 pM to about 60 TM, about 600 pM to about 55 TM, about 600 pM to about 50 TM, about 600 pM to about 45 TM, about 600 pM to about 40 TM, about 600 pM to about 35 TM, about 600 pM to about 30 TM, about 600 pM to about 25 TM, about 600 pM to about 20 TM, about 600 pM to about 15 TM, about 600 pM to about 10 TM, about 600 pM to about 5 TM, about 600 pM to about 1 TM, about 600 pM to about 900 nM, about 600 pM to about 800 nM, about 600 pM to about 700 nM, about 600 pM to about 600 nM, about 600 pM to about 500 nM, about 600 pM to about 400 nM, about 600 pM to about 300 nM, about 600 pM to about 200 nM, about 600 pM to about 100 nM, about 600 pM to about 50 nM, about 600 pM to about 1 nM, about 600 pM to about 800 pM, about 800 pM to about 100 TM, about 800 PM to about 95 TM, about 800 pM to about 90 TM, about 800 pM to about 85 TM, about 800 pM to about 80 TM, about 800 pM to about 75 TM, about 800 pM to about 70 TM, about 800 pM to about 65 TM, about 800 pM to about 60 TM, about 800 pM to about 55 TM, about 800 pM to about 50 TM, about 800 pM to about 45 TM, about 800 pM to about 40 TM, about 800 pM to about 35 TM, about 800 pM to about 30 TM, about 800 pM to about 25 TM, about 800 pM to about 20 TM, about 800 pM to about 15 TM, about 800 pM to about 10 TM, about 800 pM to about 5 TM, about 800 pM to about 1 TM, about 800 pM to about 900 nM, about 800 pM to about 800 nM, about 800 pM to about 700 nM, about 800 pM to about 600 nM, about 800 pM to about 500 nM, about 800 pM to about 400 nM, about 800 pM to about 300 nM, about 800 pM to about 200 nM, about 800 pM to about 100 nM, about 800 pM to about 50 nM, about 800 pM to about 1 nM, about 1 nM to about 100 TM, about 1 nM to about 95 TM, about 1 nM to about 90 TM, about 1 nM to about 85 TM, about 1 nM to about 80 TM, about 1 nM to about 75 TM, about 1 nM to about 70 TM, about 1 nM to about 65 TM, about 1 nM to about 60 TM, about 1 nM to about 55 TM, about 1 nM to about 50 TM, about 1 nM to about 45 TM, about 1 nM to about 40 TM, about 1 nM to about 35 TM, about 1 nM to about 30 TM, about 1 nM to about 25 TM, about 1 nM to about 20 TM, about 1 nM to about 15 TM, about 1 nM to about 10 TM, about 1 nM to about 5 TM, about 1 nM to about 1 TM, about 1 nM to about 900 nM, about 1 nM to about 800 nM, about 1 nM to about 700 nM, about 1 nM to about 600 nM, about 1 nM to about 500 nM, about 1 nM to about 400 nM, about 1 nM to about 300 nM, about 1 nM to about 200 nM, about 1 nM to about 100 nM, about 1 nM to about 50 nM, about 50 nM to about 100 TM, about 50 nM to about 95 TM, about 50 nM to about 90 TM, about 50 nM to about 85 TM, about 50 nM to about 80 TM, about 50 nM to about 75 TM, about 50 nM to about 70 TM, about 50 nM to about 65 TM, about 50 nM to about 60 TM, about 50 nM to about 55 TM, about 50 nM to about 50 TM, about 50 nM to about 45 TM, about 50 nM to about 40 TM, about 50 nM to about 35 TM, about 50 nM to about 30 TM, about 50 nM to about 25 TM, about 50 nM to about 20 TM, about 50 nM to about 15 TM, about 50 nM to about 10 TM, about 50 nM to about 5 TM, about 50 nM to about 1 TM, about 50 nM to about 900 nM, about 50 nM to about 800 nM, about 50 nM to about 700 nM, about 50 nM to about 600 nM, about 50 nM to about 500 nM, about 50 nM to about 400 nM, about 50 nM to about 300 nM, about 50 nM to about 200 nM, about 50 nM to about 100 nM, about 100 nM to about 100 TM, about 100 nM to about 95 TM, about 100 nM to about 90 TM, about 100 nM to about 85 TM, about 100 nM to about 80 TM, about 100 nM to about 75 TM, about 100 nM to about 70 TM, about 100 nM to about 65 TM, about 100 nM to about 60 TM, about 100 nM to about 55 TM, about 100 nM to about 50 TM, about 100 nM to about 45 TM, about 100 nM to about 40 TM, about 100 nM to about 35 TM, about 100 nM to about 30 TM, about 100 nM to about 25 TM, about 100 nM to about 20 TM, about 100 nM to about 15 TM, about 100 nM to about 10 TM, about 100 nM to about 5 TM, about 100 nM to about 1 TM, about 100 nM to about 900 nM, about 100 nM to about 800 nM, about 100 nM to about 700 nM, about 100 nM to about 600 nM, about 100 nM to about 500 nM, about 100 nM to about 400 nM, about 100 nM to about 300 nM, about 100 nM to about 200 nM, about 200 nM to about 100 TM, about 200 nM to about 95 TM, about 200 nM to about 90 TM, about 200 nM to about 85 TM, about 200 nM to about 80 TM, about 200 nM to about 75 TM, about 200 nM to about 70 TM, about 200 nM to about 65 TM, about 200 nM to about 60 TM, about 200 nM to about 55 TM, about 200 nM to about 50 TM, about 200 nM to about 45 TM, about 200 nM to about 40 TM, about 200 nM to about 35 TM, about 200 nM to about 30 TM, about 200 nM to about 25 TM, about 200 nM to about 20 TM, about 200 nM to about 15 TM, about 200 nM to about 10 TM, about 200 nM to about 5 TM, about 200 nM to about 1 TM, about 200 nM to about 900 nM, about 200 nM to about 800 nM, about 200 nM to about 700 nM, about 200 nM to about 600 nM, about 200 nM to about 500 nM, about 200 nM to about 400 nM, about 200 nM to about 300 nM, about 300 nM to about 100 TM, about 300 nM to about 95 TM, about 300 nM to about 90 TM, about 300 nM to about 85 TM, about 300 nM to about 80 TM, about 300 M to about 75 TM, about 300 nM to about 70 TM, about 300 nM to about 65 TM, about 300 nM to about 60 TM, about 300 nM to about 55 TM, about 300 nM to about 50 TM, about 300 nM to about 45 TM, about 300 nM to about 40 TM, about 300 nM to about 35

TM, about 300 nM to about 30 TM, about 300 nM to about 25 TM, about 300 nM to about 20 TM, about 300 nM to about 15 TM, about 300 nM to about 10 TM, about 300 nM to about 5 TM, about 300 nM to about 1 TM, about 300 nM to about 900 nM, about 300 nM to about 800 nM, about 300 nM to about 700 nM, about 300 nM to about 600 nM, about 300 nM to about 500 nM, about 300 nM to about 400 nM, about 400 nM to about 100 TM, about 400 nM to about 95 TM, about 400 nM to about 90 TM, about 400 nM to about 85 TM, about 400 nM to about 80 TM, about 400 nM to about 75 TM, about 400 nM to about 70 TM, about 400 nM to about 65 TM, about 400 nM to about 60 TM, about 400 nM to about 55 TM, about 400 nM to about 50 TM, about 400 nM to about 45 TM, about 400 nM to about 40 TM, about 400 nM to about 35 TM, about 400 nM to about 30 TM, about 400 nM to about 25 TM, about 400 nM to about 20 TM, about 400 nM to about 15 TM, about 400 nM to about 10 TM, about 400 nM to about 5 TM, about 400 nM to about 1 TM, about 400 nM to about 900 nM, about 400 nM to about 800 nM, about 400 nM to about 700 nM, about 400 nM to about 600 nM, about 400 nM to about 500 nM, about 500 nM to about 100 TM, about 500 nM to about 95 TM, about 500 nM to about 90 TM, about 500 nM to about 85 TM, about 500 nM to about 80 TM, about 500 nM to about 75 TM, about 500 nM to about 70 TM, about 500 nM to about 65 TM, about 500 nM to about 60 TM, about 500 nM to about 55 TM, about 500 nM to about 50 TM, about 500 nM to about 45 TM, about 500 nM to about 40 TM, about 500 nM to about 35 TM, about 500 nM to about 30 TM, about 500 nM to about 25 TM, about 500 nM to about 20 TM, about 500 nM to about 15 TM, about 500 nM to about 10 TM, about 500 nM to about 5 TM, about 500 nM to about 1 TM, about 500 nM to about 900 nM, about 500 nM to about 800 nM, about 500 nM to about 700 nM, about 500 nM to about 600 nM, about 600 nM to about 100 TM, about 600 nM to about 95 TM, about 600 nM to about 90 TM, about 600 nM to about 85 TM, about 600 nM to about 80 TM, about 600 nM to about 75 TM, about 600 nM to about 70 TM, about 600 nM to about 65 TM, about 600 nM to about 60 TM, about 600 nM to about 55 TM, about 600 nM to about 50 TM, about 600 nM to about 45 TM, about 600 nM to about 40 TM, about 600 nM to about 35 TM, about 600 nM to about 30 TM, about 600 nM to about 25 TM, about 600 nM to about 20 TM, about 600 nM to about 15 TM, about 600 nM to about 10 TM, about 600 nM to about 5 TM, about 600 nM to about 1 TM, about 600 nM to about 900 nM, about 600 nM to about 800 nM, about 600 nM to about 700 nM, about 700 nM to about 100 TM, about 700 nM to about 95 TM, about 700 nM to about 90 TM, about 700 nM to about 85 TM, about 700 nM to about 80 TM, about 700 nM to about 75 TM, about 700 nM to about 70 TM, about 700 nM to about 65 TM, about 700 nM to about 60 TM, about 700 nM to about 55 TM, about 700 nM to about 50 TM, about 700 nM to about 45 TM, about 700 nM to about 40 TM, about 700 nM to about 35 TM, about 700 nM to about 30 TM, about 700 nM to about 25 TM, about 700 nM to about 20 TM, about 700 nM to about 15 TM, about 700 nM to about 10 TM, about 700 nM to about 5 TM, about 700 nM to about 1 TM, about 700 nM to about 900 nM, about 700 nM to about 800 nM, about 800 nM to about 100 TM, about 800 nM to about 95 TM, about 800 nM to about 90 TM, about 800 nM to about 85 TM, about 800 nM to about 80 TM, about 800 nM to about 75 TM, about 800 nM to about 70 TM, about 800 nM to about 65 TM, about 800 nM to about 60 TM, about 800 nM to about 55 TM, about 800 nM to about 50 TM, about 800 nM to about 45 TM, about 800 nM to about 40 TM, about 800 nM to about 35 TM, about 800 nM to about 30 TM, about 800 nM to about 25 TM, about 800 nM to about 20 TM, about 800 nM to about 15 TM, about 800 nM to about 10 TM, about 800 nM to about 5 TM, about 800 nM to about 1 TM, about 800 nM to about 900 nM, about 900 nM to about 100 TM, about 900 nM to about 95 TM, about 900 nM to about 90 TM, about 900 nM to about 85 TM, about 900 nM to about 80 TM, about 900 nM to about 75 TM, about 900 nM to about 70 TM, about 900 nM to about 65 TM, about 900 nM to about 60 TM, about 900 nM to about 55 TM, about 900 nM to about 50 TM, about 900 nM to about 45 TM, about 900 nM to about 40 TM, about 900 nM to about 35 TM, about 900 nM to about 30 TM, about 900 nM to about 25 TM, about 900 nM to about 20 TM, about 900 nM to about 15 TM, about 900 nM to about 10 TM, about 900 nM to about 5 TM, about 900 nM to about 1 TM, about 1 TM to about 100 TM, about 1 TM to about 95 TM, about 1 TM to about 90 TM, about 1 TM to about 85 TM, about 1 TM to about 80 TM, about 1 TM to about 75 TM, about 1 TM to about 70 TM, about 1 TM to about 65 TM, about 1 TM to about 60 TM, about 1 TM to about 55 TM, about 1 TM to about 50 TM, about 1 TM to about 45 TM, about 1 TM to about 40 TM, about 1 TM to about 35 TM, about 1 TM to about 30 TM, about 1 TM to about 25 TM, about 1 TM to about 20 TM, about 1 TM to about 15 TM, about 1 TM to about 10 TM, about 1 TM to about 5 TM, about 5 TM to about 100 TM, about 5 TM to about 95 TM, about 5 TM to about 90 TM, about 5 TM to about 85 TM, about 5 TM to about 80 TM, about 5 TM to about 75 TM, about 5 TM to about 70 TM, about 5 TM to about 65 TM, about 5 TM to about 60 TM, about 5 TM to about 55 TM, about 5 TM to about 50 TM, about 5 TM to about 45 TM, about 5 TM to about 40 TM, about 5 TM to about 35 TM, about 5 TM to about 30 TM, about 5 TM to about 25 TM, about 5 TM to about 20 TM, about 5 TM to about 15 TM, about 5 TM to about 10 TM, about 10 TM to about 100 TM, about 10 TM to about 95 TM, about 10 TM to about 90 TM, about 10 TM to about 85 TM, about 10 TM to about 80 TM, about 10 TM to about 75 TM, about 10 TM to about 70 TM, about 10 TM to about 65 TM, about 10 TM to about 60 TM, about 10 TM to about 55 TM, about 10 TM to about 50 TM, about 10 TM to about 45 TM, about 10 TM to about 40 TM, about 10 TM to about 35 TM, about 10 TM to about 30 TM, about 10 TM to about 25 TM, about 10 TM to about 20 TM, about 10 TM to about 15 TM, about 15 TM to about 100 TM, about 15 TM to about 95 TM, about 15 TM to about 90 TM, about 15 TM to about 85 TM, about 15 TM to about 80 TM, about 15 TM to about 75 TM, about 15 TM to about 70 TM, about 15 TM to about 65 TM, about 15 TM to about 60 TM, about 15 TM to about 55 TM, about 15 TM to about 50 TM, about 15 TM to about 45 TM, about 15 TM to about 40 TM, about 15 TM to about 35 TM, about 15 TM to about 30 TM, about 15 TM to about 25 TM, about 15 TM to about 20 TM, about 15 TM to about 100 TM, about 20 TM to about 95 TM, about 20 TM to about 90 TM, about 20 TM to about 85 TM, about 20 TM to about 80 TM, about 20 TM to about 75 TM, about 20 TM to about 70 TM, about 20 TM to about 65 TM, about 20 TM to about 60 TM, about 20 TM to about 55 TM, about 20 TM to about 50 TM, about 20 TM to about 45 TM, about 20 TM to about 40 TM, about 20 TM to about 35 TM, about 20 TM to about 30 TM, about 20 TM to about 25 TM, about 25 TM to about 100 TM, about 25 TM to about 95 TM, about 20 TM to about 90 TM, about 25 TM to about 85 TM, about 25 TM to about 80 TM, about 25 TM to about 75 TM, about 25 TM to about 70 TM, about 25 TM to about 65 TM, about 25 TM to about 60 TM, about 25 TM to about 55 TM, about 25 TM to about 50 TM, about 25 TM to about 45 TM, about 25 TM to about 40 TM, about 25 TM to about 35 TM, about 25 TM to about 30 TM, about 30 TM to about 100 TM, about 30 TM to about 95 TM, about 25 TM to about 90 TM, about 30 TM to about 85 TM, about 30 TM to about 80 TM, about 30 TM to about 75 TM, about 30 TM to about 70 TM, about 30 TM to about 65 TM, about 30 TM to about 60 TM, about 30 TM to about 55 TM, about 30 TM to about 50 TM, about 30 TM to about 45 TM, about 30 TM to about 40 TM, about 30 TM to about 35 TM, about 30 TM to about 100 TM, about 35 TM to about 95 TM, about 35 TM to about 90 TM, about 35 TM to about 85 TM, about 35 TM to about 80 TM, about 35 TM to about 75 TM, about 35 TM to about 70 TM, about 35 TM to about 65 TM, about 35 TM to about 60 TM, about 35 TM to about 55 TM, about 35 TM to about 50 TM, about 35 TM to about 45 TM, about 35 TM to about 40 TM, about 40 TM to about 100 TM, about 40 TM to about 95 TM, about 35 TM to about 90 TM, about 40 TM to about 85 TM, about 40 TM to about 80 TM, about 40 TM to about 75 TM, about 40 TM to about 70 TM, about 40 TM to about 65 TM, about 40 TM to about 60 TM, about 40 TM to about 55 TM, about 40 TM to about 50 TM, about 40 TM to about 45 TM, about 45 TM to about 100 TM, about 45 TM to about 95 TM, about 45 TM to about 90 TM, about 45 TM to about 85 TM, about 45 TM to about 80 TM, about 45 TM to about 75 TM, about 45 TM to about 70 TM, about 45 TM to about 65 TM, about 45 TM to about 60 TM, about 45 TM to about 55 TM, about 45 TM to about 50 TM, about 50 TM to about 100 TM, about 50 TM to about 95 TM, about 50 TM to about 90 TM, about 50 TM to about 85 TM, about 50 TM to about 80 TM, about 50 TM to about 75 TM, about 50 TM to about 70 TM, about 50 TM to about 65 TM, about 50 TM to about 60 TM, about 50 TM to about 55 TM, about 55 TM to about 100 TM, about 55 TM to about 95 TM, about 55 TM to about 90 TM, about 55 TM to about 85 TM, about 55 TM to about 80 TM, about 55 TM to about 75 TM, about 55 TM to about 70 TM, about 55 TM to about 65 TM, about 55 TM to about 60 TM, about 60 TM to about 100 TM, about 60 TM to about 95 TM, about 60 TM to about 90 TM, about 60 TM to about 85 TM, about 60 TM to about 80 TM, about 60 TM to about 75 TM, about 60 TM to about 70 TM, about 60 TM to about 65 TM, about 65 TM to about 100 TM, about 65 TM to about 95 TM, about 65 TM to about 90 TM, about 65 TM to about 85 TM, about 65 TM to about 80 TM, about 65 TM to about 75 TM, about 65 TM to about 70 TM, about 70 TM to about 100 TM, about 70 TM to about 95 TM, about 70 TM to about 90 TM, about 70 TM to about 85 TM, about 70 TM to about 80 TM, about 70 TM to about 75 TM, about 75 TM to about 100 TM, about 75 TM to about 95 TM, about 75 TM to about 90 TM, about 75 TM to about 85 TM, about 75 TM to about 80 TM, about 80 TM to about 100 TM, about 80 TM to about 95 TM, about 80 TM to about 90 TM, about 80 TM to about 85 TM, about 85 TM to about 100 TM, about 85 TM to about 95 TM, about 85 TM to about 90 TM, about 90 TM to about 100 TM, about 90 TM to about 95 TM, or about 95 TM to about 100 TM.

In some embodiments, the immune modulator can decrease the binding between an immune modulator receptor and immune modulator ligand by blocking the ability of the receptor to interact with corresponding ligand. In some embodiments, the immune modulator can decrease the binding between an immune modulator receptor and immune modulator ligand by blocking the ability of the ligand to interact with corresponding receptor. In some embodiments, the immune modulator decreases the expression of the receptor or ligand. In some embodiments, the immune modulator decreases the expression of an immune modulator receptor. In some embodiments, the immune modulator decreases the expression of an immune modulator ligand.

In some embodiments, the immune modulator is an inhibitory nucleic acid, an antibody or an antigen-binding fragment thereof, a fusion protein, or a small molecule. In some embodiments, the inhibitory nucleic acid is a small interfering RNA, an antisense nucleic acid, an aptamer, or a microRNA. Exemplary immune modulators are described herein. Additional examples of immune modulators are known in the art.

Exemplary aspects of different inhibitory nucleic acids are described below. Any of the examples of inhibitory nucleic acids that can decrease expression of immune modulator receptor or immune modulator ligand mRNA in a mammalian cell can be synthesized in vitro. Inhibitory nucleic acids that can decrease the expression of immune modulator receptor or ligand mRNA in a mammalian cell include antisense nucleic acid molecules, i.e., nucleic acid molecules whose nucleotide sequence is complementary to all or part of an immune modulator mRNA.

Immune modulator Inhibitory Nucleic Acids

An antisense nucleic acid molecule can be complementary to all or part of a non-coding region of the coding strand of a nucleotide sequence encoding an immune modulator protein. Non-coding regions (5' and 3' untranslated regions) are the 5' and 3' sequences that flank the coding region in a gene and are not translated into amino acids.

Based upon the sequences disclosed herein, one of skill in the art can easily choose and synthesize any of a number of appropriate antisense nucleic acids to target a nucleic acid encoding an immune modulator protein described herein. Antisense nucleic acids targeting a nucleic acid encoding an immune modulator protein can be designed using the software available at the Integrated DNA Technologies website.

An antisense nucleic acid can be, for example, about 5, 10, 15, 20, 25, 30, 35, 40, 45, or 50 nucleotides or more in length. An antisense oligonucleotide can be constructed using chemical synthesis and enzymatic ligation reactions using procedures known in the art. For example, an antisense nucleic acid can be chemically synthesized using naturally-occurring nucleotides or variously modified nucleotides designed to increase the biological stability of the molecules or to increase the physical stability of the duplex formed between the antisense and sense nucleic acids, e.g., phosphorothioate derivatives and acridine-substituted nucleotides can be used.

Examples of modified nucleotides which can be used to generate an antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest).

The antisense nucleic acid molecules described herein can be prepared in vitro and administered to a mammal, e.g., a human, using any of the devices described herein. Alternatively, they can be generated in situ such that they hybridize with or bind to cellular mRNA and/or genomic DNA encoding an immune modulator protein to thereby inhibit expression, e.g., by inhibiting transcription and/or translation. The hybridization can be by conventional nucleotide complementarities to form a stable duplex, or, for example, in the case of an antisense nucleic acid molecule that binds to DNA duplexes, through specific interactions in the major groove of the double helix. The antisense nucleic acid molecules can be delivered to a mammalian cell using a vector (e.g., a lentivirus, a retrovirus, or an adenovirus vector).

An antisense nucleic acid can be an α-anomeric nucleic acid molecule. An α-anomeric nucleic acid molecule forms specific double-stranded hybrids with complementary RNA in which, contrary to the usual, β-units, the strands run parallel to each other (Gaultier et al., *Nucleic Acids Res.* 15:6625-6641, 1987). The antisense nucleic acid can also comprise a 2'-O-methylribonucleotide (Inoue et al., *Nucleic Acids Res.* 15:6131-6148, 1987) or a chimeric RNA-DNA analog (Inoue et al., *FEBS Lett.* 215:327-330, 1987).

An inhibitory nucleic acid can also be a nucleic acid molecule that forms triple helical structures. For example, expression of an immune modulator polypeptide can be inhibited by targeting nucleotide sequences complementary to the regulatory region of the gene encoding the immune modulator polypeptide (e.g., the promoter and/or enhancer, e.g., a sequence that is at least 1 kb, 2 kb, 3 kb, 4 kb, or 5 kb upstream of the transcription initiation start state) to form triple helical structures that prevent transcription of the gene in target cells. See generally Helene, *Anticancer Drug Des.* 6 (6): 569-84, 1991; Helene, *Ann. N.Y. Acad. Sci.* 660:27-36, 1992; and Maher, *Bioassays* 14 (12): 807-15, 1992.

In various embodiments, inhibitory nucleic acids can be modified at the base moiety, sugar moiety, or phosphate backbone to improve, e.g., the stability, hybridization, or solubility of the molecule. For example, the deoxyribose phosphate backbone of the nucleic acids can be modified to generate peptide nucleic acids (see, e.g., Hyrup et al., *Bioorg. Med. Chem.* 4(1): 5-23, 1996). Peptide nucleic acids (PNAs) are nucleic acid mimics, e.g., DNA mimics, in which the deoxyribose phosphate backbone is replaced by a pseudopeptide backbone and only the four natural nucleobases are retained. The neutral backbone of PNAs allows for specific hybridization to DNA and RNA under conditions of low ionic strength. The synthesis of PNA oligomers can be performed using standard solid phase peptide synthesis protocols (see, e.g., Perry-O'Keefe et al., *Proc. Natl. Acad. Sci. U.S.A.* 93:14670-675, 1996). PNAs can be used as antisense or antigene agents for sequence-specific modulation of gene expression by, e.g., inducing transcription or translation arrest or inhibiting replication.

PNAs can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras can be generated which may combine the advantageous properties of PNA and DNA. Such chimeras allow DNA recognition enzymes, e.g., RNAse H and DNA polymerases, to interact with the DNA portion while the PNA portion would provide high binding affinity and specificity. PNA-DNA chimeras can be linked using linkers of appropriate lengths selected in terms of base stacking, number of bonds between the nucleobases, and orientation.

The synthesis of PNA-DNA chimeras can be performed as described in Finn et al., *Nucleic Acids Res.* 24:3357-63, 1996. For example, a DNA chain can be synthesized on a solid support using standard phosphoramidite coupling chemistry and modified nucleoside analogs. Compounds such as 5'-(4-methoxytrityl)amino-5'-deoxy-thymidine phosphoramidite can be used as a link between the PNA and the 5' end of DNA (Mag et al., Nucleic Acids Res. 17:5973-88, 1989). PNA monomers are then coupled in a stepwise manner to produce a chimeric molecule with a 5' PNA segment and a 3' DNA segment (Finn et al., *Nucleic Acids Res.* 24:3357-63, 1996). Alternatively, chimeric molecules can be synthesized with a 5' DNA segment and a 3' PNA segment (Peterser et al., *Bioorg. Med. Chem. Lett.* 5:1119-11124, 1975).

In some embodiments, the inhibitory nucleic acids can include other appended groups such as peptides, or agents facilitating transport across the cell membrane (see, Letsinger et al., *Proc. Natl. Acad. Sci. U.S.A.* 86:6553-6556, 1989; Lemaitre et al., *Proc. Natl. Acad. Sci. U.S.A.* 84:648-652, 1989; and WO 88/09810). In addition, the inhibitory nucleic acids can be modified with hybridization-triggered cleavage agents (see, e.g., Krol et al., *Bio/Techniques* 6:958-976, 1988) or intercalating agents (see, e.g., Zon, *Pharm. Res.* 5:539-549, 1988). To this end, the oligonucleotide may be conjugated to another molecule, e.g., a peptide, hybridization triggered cross-linking agent, transport agent, hybridization-triggered cleavage agent, etc.

Another means by which expression of an immune modulator mRNA can be decreased in a mammalian cell is by RNA interference (RNAi). RNAi is a process in which mRNA is degraded in host cells. To inhibit an mRNA, double-stranded RNA (dsRNA) corresponding to a portion of the gene to be silenced (e.g., a gene encoding an immune modulator polypeptide) is introduced into a mammalian cell. The dsRNA is digested into 21-23 nucleotide-long duplexes called short interfering RNAs (or siRNAs), which bind to a nuclease complex to form what is known as the RNA-induced silencing complex (or RISC). The RISC targets the homologous transcript by base pairing interactions between one of the siRNA strands and the endogenous mRNA. It then cleaves the mRNA about 12 nucleotides from the 3' terminus of the siRNA (see Sharp et al., *Genes Dev.* 15:485-490, 2001, and Hammond et al., *Nature Rev. Gen.* 2:110-119, 2001).

RNA-mediated gene silencing can be induced in a mammalian cell in many ways, e.g., by enforcing endogenous expression of RNA hairpins (see, Paddison et al., *Proc. Natl. Acad. Sci. U.S.A.* 99:1443-1448, 2002) or, as noted above, by transfection of small (21-23 nt) dsRNA (reviewed in Caplen, *Trends Biotech.* 20:49-51, 2002). Methods for modulating gene expression with RNAi are described, e.g., in U.S. Pat. No. 6,506,559 and US 2003/0056235, which are hereby incorporated by reference.

Standard molecular biology techniques can be used to generate siRNAs. Short interfering RNAs can be chemically synthesized, recombinantly produced, e.g., by expressing RNA from a template DNA, such as a plasmid, or obtained from commercial vendors, such as Dharmacon. The RNA used to mediate RNAi can include synthetic or modified nucleotides, such as phosphorothioate nucleotides. Methods of transfecting cells with siRNA or with plasmids engineered to make siRNA are routine in the art.

The siRNA molecules used to decrease expression of an immune modulator mRNA can vary in a number of ways. For example, they can include a 3' hydroxyl group and strands of 21, 22, or 23 consecutive nucleotides. They can be blunt ended or include an overhanging end at either the 3' end, the 5' end, or both ends. For example, at least one strand of the RNA molecule can have a 3' overhang from about 1 to about 6 nucleotides (e.g., 1-5, 1-3, 2-4, or 3-5 nucleotides (whether pyrimidine or purine nucleotides) in length. Where both strands include an overhang, the length of the overhangs may be the same or different for each strand.

To further enhance the stability of the RNA duplexes, the 3' overhangs can be stabilized against degradation (by, e.g., including purine nucleotides, such as adenosine or guanosine nucleotides or replacing pyrimidine nucleotides by modified analogues (e.g., substitution of uridine 2-nucleotide 3' overhangs by 2'-deoxythymidine is tolerated and does not affect the efficiency of RNAi). Any siRNA can be used in the methods of decreasing an immune modulator mRNA, provided it has sufficient homology to the target of interest. There is no upper limit on the length of the siRNA that can be used (e.g., the siRNA can range from about 21 base pairs of the gene to the full length of the gene or more (e.g., about 20 to about 30 base pairs, about 30 to about 60 base pairs, about 60 to about 70 base pairs, about 70 to about 80 base pairs, about 80 to about 90 base pairs, or about 90 to about 100 base pairs).

In certain embodiments, a therapeutically effective amount of an inhibitory nucleic acid targeting a nucleic acid encoding an immune modulator protein can be delivered locally to a subject (e.g., a human subject) in need thereof using any of the devices described herein.

In some embodiments, the inhibitory nucleic acid can be about 10 nucleotides to about 40 nucleotides (e.g., about 10 to about 30 nucleotides, about 10 to about 25 nucleotides, about 10 to about 20 nucleotides, about 10 to about 15 nucleotides, 10 nucleotides, 11 nucleotides, 12 nucleotides, 13 nucleotides, 14 nucleotides, 15 nucleotides, 16 nucleotides, 17 nucleotides, 18 nucleotides, 19 nucleotides, 20 nucleotides, 21 nucleotides, 22 nucleotides, 23 nucleotides, 24 nucleotides, 25 nucleotides, 26 nucleotides, 27 nucleotides, 28 nucleotides, 29 nucleotides, 30 nucleotides, 31 nucleotides, 32 nucleotides, 33 nucleotides, 34 nucleotides, 35 nucleotides, 36 nucleotides, 37 nucleotides, 38 nucleotides, 39 nucleotides, or 40 nucleotides) in length. One skilled in the art will appreciate that inhibitory nucleic acids may comprise at least one modified nucleic acid at either the 5' or 3'end of DNA or RNA.

Any of the inhibitor nucleic acids described herein can be formulated for administration to the gastrointestinal tract. See, e.g., the formulation methods described in US 2016/0090598 and Schoellhammer et al., *Gastroenterology*, doi: 10.1053/j.gastro.2017.01.002, 2017.

As is known in the art, the term "thermal melting point (Tm)" refers to the temperature, under defined ionic strength, pH, and inhibitory nucleic acid concentration, at which 50% of the inhibitory nucleic acids complementary to the target sequence hybridize to the target sequence at equilibrium. In some embodiments, an inhibitory nucleic acid can bind specifically to a target nucleic acid under stringent conditions, e.g., those in which the salt concentration is at least about 0.01 to 1.0 M Na ion concentration (or other salts) at pH 7.0 to 8.3 and the temperature is at least about 30° C. for short oligonucleotides (e.g., 10 to 50 nucleotide). Stringent conditions can also be achieved with the addition of destabilizing agents such as formamide.

In some embodiments of any of the inhibitory nucleic acids described herein, the inhibitory nucleic acid binds to a target nucleic acid (e.g., a nucleic acid encoding an immune modulator) with a Tm of greater than 20° C., greater than 22° C., greater than 24° C., greater than 26° C., greater than 28° C., greater than 30° C., greater than 32° C., greater than 34° C., greater than 36° C., greater than 38° C., greater than 40° C., greater than 42° C., greater than 44° C., greater than 46° C., greater than 48° C., greater than 50° C., greater than 52° C., greater than 54° C., greater than 56° C., greater than 58° C., greater than 60° C., greater than 62° C., greater than 64° C., greater than 66° C., greater than 68° C., greater than 70° C., greater than 72° C., greater than 74° C., greater than 76° C., greater than 78° C., or greater than 80° C., e.g., as measured in phosphate buffered saline using a UV spectrophotometer.

In some embodiments of any of the inhibitor nucleic acids described herein, the inhibitory nucleic acid binds to a target nucleic acid (e.g., a nucleic acid encoding CD40 or CD40L) with a Tm of about 20° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., about 30° C., about 28° C., about 26° C., about 24° C., or about 22° C. (inclusive); about 22° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., about 30° C., about 28° C., about 26° C., or about 24° C. (inclusive); about 24° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., about 30° C., about 28° C., or about 26° C. (inclusive); about 26° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., about 30° C., or about 28° C. (inclusive); about 28° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., or about 30° C. (inclusive); about 30° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., or about 32° C. (inclusive); about 32° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., or about 34° C. (inclusive); about 34° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., or about 36° C. (inclusive); about 36° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., or about 38° C. (inclusive); about 38° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., or about 40° C. (inclusive); about 40° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., or about 42° C. (inclusive); about 42° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., or about 44° C. (inclusive); about 44° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., or about 46° C. (inclusive); about 46° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., or about 48° C. (inclusive); about 48° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., or about 50° C. (inclusive); about 50° C. to about 80° C., about 78° C., about 76° C., about 74° C., about 72° C., about 70° C., about 68° C., about 66° C., about 64° C., about 62° C., about 60° C., about 58° C., about 56° C., about 54° C., or about 52° C. (inclusive); about 52° C. to about 80° C., about 78° C., about 76° C., about 74° C., about 72° C., about 70° C., about 68° C., about 66° C., about 64° C., about 62° C., about 60° C., about 58° C., about 56° C., or about 54° C. (inclusive); about 54° C. to about 80° C., about 78° C., about 76° C., about 74° C., about 72° C., about 70° C., about 68° C., about 66° C., about 64° C., about 62° C., about 60° C., about 58° C., or about 56° C. (inclusive); about 56° C. to about 80° C., about 78° C., about 76° C., about 74° C., about 72° C., about 70° C., about 68° C., about 66° C., about 64° C., about 62° C., about 60° C., or about 58° C. (inclusive); about 58° C. to about 80° C., about 78° C., about 76° C., about 74° C., about 72° C., about 70° C., about 68° C., about 66° C., about 64° C., about 62° C., or about 60° C. (inclusive); about 60° C. to about 80° C., about 78° C., about 76° C., about 74° C., about 72° C., about 70° C., about 68° C., about 66° C., about 64° C., or about 62° C. (inclusive); about 62° C. to about 80° C., about 78° C., about 76° C., about 74° C., about 72° C., about 70° C., about 68° C., about 66° C., or about 64° C. (inclusive); about 64° C. to about 80° C., about 78° C., about 76° C., about 74° C., about 72° C., about 70° C., about 68° C., or about 66° C. (inclusive); about 66° C. to about 80° C., about 78° C., about 76° C., about 74° C., about 72° C., about 70° C., or about 68° C. (inclusive); about 68° C. to about 80° C., about 78° C., about 76° C., about 74° C., about 72° C., or about 70° C. (inclusive); about 70° C. to about 80° C., about 78° C., about 76° C., about 74° C., or about 72° C. (inclusive); about 72° C. to about 80° C., about 78° C., about 76° C., or about 74° C. (inclusive); about 74° C. to about 80° C., about 78° C., or about 76° C. (inclusive); about 76° C. to about 80° C. or about 78° C. (inclusive); or about 78° C. to about 80° C. (inclusive).

In some embodiments, the inhibitory nucleic acid can be formulated in a nanoparticle (e.g., a nanoparticle including one or more synthetic polymers, e.g., Patil et al., *Pharmaceutical Nanotechnol.* 367:195-203, 2009; Yang et al., *ACS Appl. Mater. Interfaces, doi:* 10.1021/acsami.6b16556, 2017; Perepelyuk et al., *Mol. Ther. Nucleic Acids* 6:259-268, 2017). In some embodiments, the nanoparticle can be a mucoadhesive particle (e.g., nanoparticles having a positively-charged exterior surface) (Andersen et al., *Methods Mol. Biol.* 555:77-86, 2009). In some embodiments, the nanoparticle can have a neutrally-charged exterior surface.

In some embodiments, the inhibitory nucleic acid can be formulated, e.g., as a liposome (Buyens et al., *J. Control Release* 158 (3): 362-370, 2012; Scarabel et al., *Expert Opin. Drug Deliv.* 17:1-14, 2017), a micelle (e.g., a mixed micelle) (Tangsangasaksri et al., *BioMacromolecules* 17:246-255, 2016; Wu et al., *Nanotechnology, doi:* 10.1088/1361-6528/aa6519, 2017), a microemulsion (WO 11/004395), a nanoemulsion, or a solid lipid nanoparticle (Sahay et al., *Nature Biotechnol.* 31:653-658, 2013; and Lin et al., *Nanomedicine* 9 (1): 105-120, 2014). Additional exemplary structural features of inhibitory nucleic acids and formulations of inhibitory nucleic acids are described in US 2016/0090598.

In some embodiments, a pharmaceutical composition can include a sterile saline solution and one or more inhibitory nucleic acid (e.g., any of the inhibitory nucleic acids described herein). In some examples, a pharmaceutical composition consists of a sterile saline solution and one or more inhibitory nucleic acid (e.g., any of the inhibitory nucleic acids described herein). In certain embodiments, the sterile saline is a pharmaceutical grade saline. In certain embodiments, a pharmaceutical composition can include one or more inhibitory nucleic acid (e.g., any of the inhibitory nucleic acids described herein) and sterile water. In certain embodiments, a pharmaceutical composition consists of one or more inhibitory nucleic acid (e.g., any of the inhibitory nucleic acids described herein) and sterile water. In certain embodiments, a pharmaceutical composition includes one or more inhibitory nucleic acid (e.g., any of the inhibitory nucleic acids described herein) and phosphate-buffered saline (PBS). In certain embodiments, a pharmaceutical composition consists of one or more inhibitory nucleic acids (e.g., any of the inhibitory nucleic acids described herein) and sterile phosphate-buffered saline (PBS). In some examples, the sterile saline is a pharmaceutical grade PBS.

In certain embodiments, one or more inhibitory nucleic acids (e.g., any of the inhibitory nucleic acids described herein) may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

Pharmaceutical compositions including one or more inhibitory nucleic acids encompass any pharmaceutically acceptable salts, esters, or salts of such esters. Non-limiting examples of pharmaceutical compositions include pharmaceutically acceptable salts of inhibitory nucleic acids. Suitable pharmaceutically acceptable salts include, but are not limited to, sodium and potassium salts.

Also provided herein are prodrugs that can include additional nucleosides at one or both ends of an inhibitory nucleic acid which are cleaved by endogenous nucleases within the body, to form the active inhibitory nucleic acid.

Lipid moieties can be used to formulate an inhibitory nucleic acid. In certain such methods, the inhibitory nucleic acid is introduced into preformed liposomes or lipoplexes made of mixtures of cationic lipids and neutral lipids. In certain methods, inhibitory nucleic acid complexes with mono- or poly-cationic lipids are formed without the presence of a neutral lipid. In certain embodiments, a lipid moiety is selected to increase distribution of an inhibitory nucleic acid to a particular cell or tissue in a mammal. In some examples, a lipid moiety is selected to increase distribution of an inhibitory nucleic acid to fat tissue in a mammal. In certain embodiments, a lipid moiety is selected to increase distribution of an inhibitory nucleic acid to muscle tissue.

In certain embodiments, pharmaceutical compositions provided herein can include one or more inhibitory nucleic acid and one or more excipients. In certain such embodiments, excipients are selected from water, salt solutions, alcohol, polyethylene glycols, gelatin, lactose, amylase, magnesium stearate, talc, silicic acid, viscous paraffin, hydroxymethylcellulose, and polyvinylpyrrolidone.

In some examples, a pharmaceutical composition provided herein includes liposomes and emulsions. Liposomes and emulsions can be used to formulate hydrophobic compounds. In some examples, certain organic solvents, such as dimethylsulfoxide, are used.

In some examples, a pharmaceutical composition provided herein includes one or more tissue-specific delivery molecules designed to deliver one or more inhibitory nucleic acids to specific tissues or cell types in a mammal. For example, a pharmaceutical composition can include liposomes coated with a tissue-specific antibody.

In some embodiments, a pharmaceutical composition provided herein can include a co-solvent system. Examples of such co-solvent systems include benzyl alcohol, a non-polar surfactant, a water-miscible organic polymer, and an aqueous phase. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. As can be appreciated, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose. Any of the pharmaceutical compositions described herein can be delivered locally to a subject using any of the devices described herein.

In some examples, an inhibitory nucleic acid can be formulated to include a carrier and is formulated in aqueous solution, such as water or physiologically compatible buffers such as Hanks's solution, Ringer's solution, or physiological saline buffer. In some examples, other ingredients are included (e.g., ingredients that aid in solubility or serve as preservatives). In some examples, an inhibitory nucleic acid can be formulated as a suspension and can be prepared using appropriate liquid carriers, suspending agents, and the like. An inhibitory nucleic acid can be formulated as a suspension, solution, or emulsion in oily or aqueous vehicles prior to intrathecal administration using any of the devices described herein, and may contain formulatory agents such as suspending, stabilizing, and/or dispersing agents. Solvents suitable for formulating an inhibitory nucleic acid include, but are not limited to, lipophilic solvents and fatty oils, such as sesame oil, synthetic fatty acid esters, such as ethyl oleate or triglycerides, and liposomes.

Antibodies

In some embodiments, the immune modulator is described in the below table:

| Common Name | Brand name | Company | Drug Class | Drug subclass | Citations |
|---|---|---|---|---|---|
| Visilizumab | Nuvion | PDL BioPharma > Facet Biotech | anti-CD3 | Humanised anti-CD3 IgG2 antibody HuM291 gamma-2M3 | Malviya et al. "Radiolabeled humanized anti-CD3 monoclonal antibody visilizumab for imaging human T-lymphocytes." J Nucl Med. 2009 October; 50(10): 1683-91 |
| Muromonab-CD3 (OKT3, TRX-318) | Orthoclone OKT3 | Janssen-Cilag | anti-CD3 | mAb (146 kDa) fully mouse | Gramatzki M, Burger R, Strobel G, et al. (March 1995). "Therapy with OKT3 monoclonal antibody in refractory T cell acute lymphoblastic leukemia induces interleukin-2 responsiveness". Leukemia. 9 (3): 382-90 |
| Otelixizumab (GSK2136525, TRX4) | | Tolerx in collaboration with GSK and manufactured by Abbott | anti-CD3 [targets the epsilon chain of CD3] | mAb - chimeric and humanized | Wiczling, Pawel, et al. "Pharmacokinetics and pharmacodynamics of a chimeric/humanized anti-CD3 monoclonal antibody, otelixizumab (TRX4), in subjects with psoriasis and with type 1 |

-continued

| Common Name | Brand name | Company | Drug Class | Drug subclass | Citations |
|---|---|---|---|---|---|
| | | | | | diabetes mellitus." The Journal of Clinical Pharmacology 50.5 (2010): 494-506. |
| Foralumab (NI-0401) | | NovImmune | anti-CD3 | human anti-CD3 mAb | van der Woude, C. J., et al. (2010), Phase I, double-blind, randomized, placebo-controlled, dose-escalation study of NI-0401 (a fully human anti-CD3 monoclonal antibody) in patients with moderate to severe active Crohn's disease. Inflamm Bowel Dis, 16: 1708-1716. |
| Teplizumab (MGA031 and hOKT3γ1 (Ala-Ala)) | | Provention Bio | anti-CD3 | Humanized (from mouse) | Ilan, Yaron et al. "Immunotherapy with oral administration of humanized anti-CD3 monoclonal antibody: a novel gut-immune system-based therapy for metaflammation and NASH." Clinical & Experimental Immunology 193.3 (2018): 275-283. |
| ABBV-323 (BI-655064) | | AbbVie | anti-CD40 | humanized antagonistic anti-CD40 mAb | Albach, Fredrik N., et al. "Safety, pharmacokinetics and pharmacodynamics of single rising doses of BI 655064, an antagonistic anti-CD40 antibody in healthy subjects: a potential novel treatment for autoimmune diseases." European journal of clinical pharmacology 74.2 (2018): 161-169. |
| dapirolizumab pegol (CDP-7657) | | UCB SA | anti-CD40 | humanized anti-CD40L mAb | Chamberlain, Chris, et al. "Repeated administration of dapirolizumab pegol in a randomised phase I study is well tolerated and accompanied by improvements in several composite measures of systemic lupus erythematosus disease activity and changes in whole blood transcriptomic profiles." Annals of the rheumatic diseases 76.11 (2017): 1837-1844. |
| BMS-986090 | | Bristol-Myers Squibb | anti-CD40 | IgG4 Fc fusion anti-CD40 mAh | Liang, Shuang, et al. "A population-based target-mediated drug disposition model to predict clinical pharmacokinetics of BMS-986090, an anti-CD40 antagonistic domain antibody." JOURNAL OF PHARMACOKINETICS AND PHARMACODYNAMICS. Vol. 44. 233 SPRING ST, NEW YORK, NY 10013 USA: SPRINGER/PLENUM PUBLISHERS, 2017. |

-continued

| Common Name | Brand name | Company | Drug Class | Drug subclass | Citations |
|---|---|---|---|---|---|
| PG 102 (FFP104) | | Pangenetics > FF Pharmaceuticals BV | anti-CD40 | humanized anti-hCD40 mAb | Bankert, Katherine C., et al. "Induction of an altered CD40 signaling complex by an antagonistic human monoclonal antibody to CD40." The Journal of Immunology 194.9 (2015): 4319-4327. |
| Dacetuzumab (SGN-40) | | Seattle Genetics | anti-CD40 | humanized mAb targeting the CD40 antigen | Khubchandani et al. "Dacetuzumab, a humanized mAb against CD40 for the treatment of hematological malignancies" Curr Opin Investig Drugs. 2009 June; 10(6): 579-87. |
| Lucatumumab (HCD122) | | Chiron > Novartis | anti-CD40 | fully human anti-CD40 mAb | Byrd, John C., et al. "Phase I study of the anti-CD40 humanized monoclonal antibody lucatumumab (HCD122) in relapsed chronic lymphocytic leukemia." Leukemia & lymphoma 53.11 (2012): 2136-2142. |
| Chi Lob 7/4 | | BioNTech SE | anti-CD40L | mAb | Johnson, P. W., et al. "A Cancer Research UK phase I study evaluating safety, tolerability, and biological effects of chimeric anti-CD40 monoclonal antibody (MAb), Chi Lob 7/4." Journal of Clinical Oncology 28.15_suppl (2010): 2507-2507 |
| Bleselumab (ASKP1240) | | Kirin > Kyowa Hakko Kirin Co Ltd | anti-CD40 | fully human anti-CD40 mAb | Okimura et al., Am. J. Transplant. 14(6): 1290-1299, 2014; Ma et al., Transplantation 97(4): 397-404, 2014; Watanabe et al., Am. J. Transplant 13(8): 1976-1988, 2013 |
| abatacept | Orencia | Bristol-Myers Squibb | anti-CD28 | soluble fusion protein | Herrero-Beaumont et al., Rheumatol. Clin. 8: 78-83, 2012; and Korhonen and Moilanen Basic Clin. Pharmacol. Toxicol. 104(4): 276-284, 2009 |
| vatelizumab (ELND-0 + B12:P1204 or SAR-656933) | | Glenmark Pharmeceuticals | anti-CD49 (IL-8 inhibitor) Blocks alpha-2 receptors | mAb | Breuer, Johanna, et al. "VLA-2 blockade in vivo by vatelizumab induces CD4+ FoxP3+ regulatory T cells." International immunology (2019). |
| rituximab | Rituxan | Biogen | anti-CD20 | human-mouse mAb | Colombat, Philippe, et al. "Rituximab (anti-CD20 monoclonal antibody) as single first-line therapy for patients with follicular lymphoma with a low tumor burden: clinical and molecular evaluation." Blood 97.1 (2001): 101-106; and Calderon-Gomez and Panes Gastroenterology 142(1): 1741-76, 2012 |

-continued

| Common Name | Brand name | Company | Drug Class | Drug subclass | Citations |
|---|---|---|---|---|---|
| ocrelizumab | Ocrevus | Biogen | anti-CD20 | humanized mAb | Sharp N. Engl. J. Med. 376(17): 1692,2017 |
| basiliximab | Simulect | Novartis | anti-CD25 | murine/human chimeric mAb | Wang et al., Clin. Exp. Immunol. 155(3): 496-503, 2009; and Kircher et al., Clin. Exp. Immunol. 134(3): 426-430, 2003 |
| HF-1020 | | Trident Pharmaceuticals Inc | anti-CD89 | recombinantly produced non-toxic B-subunit of E. coli enterotoxin | |
| IC14 | | Implicit Bioscience Ltd | anti-CD14 | mAb | Spek et al. "Treatment with an Anti-CD14 Monoclonal Antibody Delays and Inhibits Lipopolysaccharide-Induced Gene Expression in Humans in Vivo" Journal of Clinical Immunology, March 2003, Volume 23, Issue 2, pp 132-140 |

In some embodiments, the immune modulator is an antibody or an antigen-binding fragment thereof (e.g., a Fab or a scFv). In some embodiments, an antibody or antigen-binding fragment described herein binds specifically to an immune modulator receptor or ligand, or fragment thereof.

In some embodiments, the antibody can be a humanized antibody, a chimeric antibody, a multivalent antibody, or a fragment thereof. In some embodiments, an antibody can be a scFv-Fc (Sokolowska-Wedzina et al., Mol. Cancer Res. 15 (8): 1040-1050, 2017), a VHH domain (Li et al., Immunol. Lett. 188:89-95, 2017), a VNAR domain (Hasler et al., Mol. Immunol. 75:28-37, 2016), a (scFv)$_2$, a minibody (Kim et al., PLOS One 10 (1): e113442, 2014), or a BiTE. In some embodiments, an antibody can be a DVD-Ig (Wu et al., Nat. Biotechnol. 25 (11): 1290-1297, 2007; WO 08/024188; WO 07/024715), and a dual-affinity re-targeting antibody (DART) (Tsai et al., Mol. Ther. Oncolytics 3:15024, 2016), a triomab (Chelius et al., MAbs 2 (3): 309-319, 2010), kih IgG with a common LC (Kontermann et al., Drug Discovery Today 20 (7): 838-847, 2015), a crossmab (Regula et al., EMBO Mol. Med. 9 (7): 985, 2017), an ortho-Fab IgG (Kontermann et al., Drug Discovery Today 20 (7): 838-847, 2015), a 2-in-1-IgG (Kontermann et al., Drug Discovery Today 20 (7): 838-847, 2015), IgG-scFv (Cheal et al., Mol. Cancer Ther. 13 (7): 1803-1812, 2014), scFv2-Fc (Natsume et al., J. Biochem. 140 (3): 359-368, 2006), a bi-nanobody (Kontermann et al., Drug Discovery Today 20(7): 838-847, 2015), tanden antibody (Kontermann et al., Drug Discovery Today 20 (7): 838-847, 2015), a DART-Fc (Kontermann et al., Drug Discovery Today 20 (7): 838-847, 2015), a scFv-HSA-scFv (Kontermann et al., Drug Discovery Today 20 (7): 838-847, 2015), DNL-Fab3 (Kontermann et al., Drug Discovery Today 20 (7): 838-847, 2015), DAF (two-in-one or four-in-one), DutaMab, DT-IgG, knobs-in-holes common LC, knobs-in-holes assembly, charge pair antibody, Fab-arm exchange antibody, SEEDbody, Triomab, LUZ-Y, Fcab, kA-body, orthogonal Fab, DVD-IgG, IgG (H)-scFv, scFv-(H) IgG, IgG (L)-scFv, scFv-(L)-IgG, IgG (L,H)-Fc, IgG (H)-V, V (H)-IgG, IgG (L)-V, V (L)-IgG, KIH IgG-scFab, 2scFv-IgG, IgG-2scFv, scFv4-Ig, Zybody, DVI-IgG, nanobody (e.g., antibodies derived from Camelus bactriamus, Calelus dromaderius, or Lama paccos) (U.S. Pat. No. 5,759, 808; Stijlemans et al., J. Biol. Chem. 279:1256-1261, 2004; Dumoulin et al., Nature 424:783-788, 2003; and Pleschberger et al., Bioconjugate Chem. 14:440-448, 2003), nanobody-HSA, a diabody (e.g., Poljak, Structure 2 (12): 1121-1123, 1994; Hudson et al., J. Immunol. Methods 23 (1-2): 177-189, 1999), a TandAb (Reusch et al., mAbs 6 (3): 727-738, 2014), scDiabody (Cuesta et al., Trends in Biotechnol. 28 (7): 355-362, 2010), scDiabody-CH3 (Sanz et al., Trends in Immunol. 25 (2): 85-91, 2004), Diabody-CH3 (Guo et al., Triple Body, miniantibody, minibody, TriBi minibody, scFv-CH3 KIH, Fab-scFv, scFv-CH-CL-scFv, F(ab')2-scFV2, scFv-KIH, Fab-scFv-Fc, tetravalent HCAb, scDiabody-Fc, diabody-Fc, tandem scFv-Fc, intrabody (Huston et al., Human Antibodies 10 (3-4): 127-142, 2001; Wheeler et al., Mol. Ther. 8 (3): 355-366, 2003; Stocks, Drug Discov. Today 9 (22): 960-966, 2004), dock and lock bispecific antibody, ImmTAC, HSAbody, scDiabody-HSA, tandem scFv, IgG-IgG, Cov-X-Body, and scFv1-PEG-scFv2.

Non-limiting examples of an antigen-binding fragment of an antibody include an Fv fragment, a Fab fragment, a F(ab')2 fragment, and a Fab' fragment. Additional examples of an antigen-binding fragment of an antibody is an antigen-binding fragment of an IgG (e.g., an antigen-binding fragment of IgG1, IgG2, IgG3, or IgG4) (e.g., an antigen-binding fragment of a human or humanized IgG, e.g., human or humanized IgG1, IgG2, IgG3, or IgG4); an antigen-binding fragment of an IgA (e.g., an antigen-binding fragment of IgA1 or IgA2) (e.g., an antigen-binding fragment of a human or humanized IgA, e.g., a human or humanized IgA1 or IgA2); an antigen-binding fragment of an IgD (e.g., an antigen-binding fragment of a human or humanized IgD); an antigen-binding fragment of an IgE (e.g., an antigen-binding fragment of a human or humanized IgE); or an antigen-binding fragment of an IgM (e.g., an antigen-binding fragment of a human or humanized IgM).

In some embodiments, an antibody can be an IgNAR, a bispecific antibody (Milstein and Cuello, Nature 305:537-539, 1983; Suresh et al., Methods in Enzymology 121:210, 1986; WO 96/27011; Brennan et al., Science 229:81, 1985;

Shalaby et al., *J. Exp. Med.* 175:217-225, 1992; Kolstelny et al., *J. Immunol.* 148 (5): 1547-1553, 1992; Hollinger et al., *Proc. Natl. Acad. Sci. U.S.A.* 90:6444-6448, 1993; Gruber et al., *J. Immunol.* 152:5368, 1994; Tutt et al., *J. Immunol.* 147:60, 1991), a bispecific diabody, a triabody (Schoonooghe et al., *BMC Biotechnol.* 9:70, 2009), a tetrabody, scFv-Fc knobs-into-holes, a scFv-Fc-scFv, a (Fab'scFv)$_2$, a V-IgG, a IvG-V, a dual V domain IgG, a heavy chain immunoglobulin or a camelid (Holt et al., *Trends Biotechnol.* 21 (11): 484-490, 2003), an intrabody, a monoclonal antibody (e.g., a human or humanized monoclonal antibody), a heteroconjugate antibody (e.g., U.S. Pat. No. 4,676,980), a linear antibody (Zapata et al., *Protein Eng.* 8 (10:1057-1062, 1995), a trispecific antibody (Tutt et al., *J. Immunol.* 147:60, 1991), a Fabs-in-Tandem immunoglobulin (WO 15/103072), or a humanized camelid antibody.

In some embodiments, the antibody is a humanized antibody, a chimeric antibody, a multivalent antibody, or a fragment thereof. In some embodiments, the antibody is a monoclonal antibody. In some embodiments, the antibody is a humanized monoclonal antibody. See e.g., Hunter & Jones, *Nat. Immunol.* 16:448-457, 2015; Heo et al., *Oncotarget* 7 (13): 15460-15473, 2016. Additional examples of antibodies and antigen-binding fragments thereof are described in U.S. Pat. Nos. 8,440,196; 7,842,144; 8,034,344; and 8,529,895; US 2013/0317203; US 2014/0322239; US 2015/0166666; US 2016/0152714; and US 2017/0002082, each of which is incorporated by reference in its entirety.

CD40/CD40L. Inhibitors

The term "CD40/CD40L inhibitors" refers to an agent which decreases CD40 or CD40L (CD154) expression and/or the ability of CD40 to bind to CD40L (CD154), e.g., in vitro or in a mammalian cell, e.g., as compared to the level of CD40 OR CD40L activity in the absence of the agent; and/or decreases the level of a CD40 OR CD40L protein in a mammalian cell contacted with the agent, e.g., as compared to the same mammalian cell not contacted with the agent. CD40 is a costimulatory receptor that binds to its ligand, CD40L (CD154).

In certain embodiments, the antibody comprises or consists of an antigen-binding fragment or portion of PG102 (Pangenetics) (Bankert et al., *J. Immunol.* 194 (9): 4319-4327, 2015); 2C10 (Lowe et al., *Am. J. Transplant* 12 (8): 2079-2087, 2012); ASKP1240 (Bleselumab) (Watanabe et al., *Am. J. Transplant* 13 (8): 1976-1988, 2013); 4D11 (Imai et al., *Transplantation* 84 (8): 1020-1028, 2007); BI 655064 (Boehringer Ingelheim) (Visvanathan et al., 2016 American College of Rheumatology Annual Meeting, Abstract 1588 Sep. 28, 2016); 5D12 (Kasran et al., *Aliment. Pharmacol. Ther.*, 22 (2): 111-122, 2005; Boon et al., *Toxicology* 174 (1): 53-65, 2002); ruplizumab (hu5c8) (Kirk et al., *Nat. Med.* 5 (6): 686-693, 1999); CHIR12.12 (HCD122) (Weng et al., *Blood* 104 (11): 3279, 2004; Tai et al., *Cancer Res.* 65 (13): 5898-5906, 2005); CDP7657 (Shock et al., *Arthritis Res. Ther.* 17 (1): 234, 2015); BMS-986004 domain antibody (dAb) (Kim et al., *Am. J. Transplant.* 17 (5): 1182-1192, 2017); 5c8 (Xie et al., *J. Immunol.* 192 (9): 4083-4092, 2014); dacetuzumab (SGN-40) (Lewis et al., *Leukemia* 25 (6): 1007-1016, 2011; and Khubchandani et al., *Curr. Opin. Investig. Drugs* 10 (6): 579-587, 2009); lucatumumab (HCD122) (Bensinger et al., *Br. J. Haematol.* 159:58-66, 2012; and Byrd et al., *Leuk. Lymphoma* 53 (11): 10.3109/10428194.2012.681655, 2012); PG102 (FFP104) (Bankert et al., *J. Immunol.* 194 (9): 4319-4327, 2015); Chi Lob 7/4 (Johnson et al., *J. Clin. Oncol.* 28:2507, 2019); and ASKP1240 (Okimura et al., *Am. J. Transplant.* 14 (6): 1290-1299, 2014; and Ma et al., *Transplantation* 97 (4): 397-404, 2014).

Further teachings of CD40/CD40L antibodies and antigen-binding fragments thereof are described in, for example, U.S. Pat. Nos. 5,874,082; 7,169,389; 7,271,152; 7,288,252; 7,445,780; 7,537,763; 8,277,810; 8,293,237, 8,551,485; 8,591,900; 8,647,625; 8,784,823; 8,852,597; 8,961,976; 9,023,360, 9,028,826; 9,090,696, 9,221,913; US2014/0093497; and US2015/0017155, each of which is incorporated by reference in its entirety.

In some embodiments, any of the antibodies or antigen-binding fragments described herein has a dissociation constant ($K_D$) of less than $1\times10^{-5}$ M (e.g., less than $0.5\times10^{-5}$ M, less than $1\times10^{-6}$ M, less than $0.5\times10^{-6}$ M, less than $1\times10^{-7}$ M, less than $0.5\times10^{-7}$ M, less than $1\times10^{-8}$ M, less than $0.5\times10^{-8}$ M, less than $1\times10^{-9}$ M, less than $0.5\times10^{-9}$ M, less than $1\times10^{-10}$ M, less than $0.5\times10^{-10}$ M, less than $1\times10^{-11}$ M, less than $0.5\times10^{-11}$ M, or less than $1\times10^{-12}$ M), e.g., as measured in phosphate buffered saline using surface plasmon resonance (SPR).

In some embodiments, any of the antibodies or antigen-binding fragments described herein has a $K_D$ of about $1\times10^{-12}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, about $0.5\times10^{-9}$ M, about $1\times10^{-10}$ M, about $0.5\times10^{-10}$ M, about $1\times10^{-11}$ M, or about $0.5\times10^{-11}$ M (inclusive); about $0.5\times10^{-11}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, about $0.5\times10^{-9}$ M, about $1\times10^{-10}$ M, about $0.5\times10^{-10}$ M, or about $1\times10^{-11}$ M (inclusive); about $1\times10^{-11}$ M to about $1\times10^{-5}$ M, about $0.5\times10^{5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, about $0.5\times10^{-9}$ M, about $1\times10^{-10}$ M, or about $0.5\times10^{-10}$ M (inclusive); about $0.5\times10^{-10}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, about $0.5\times10^{-9}$ M, or about $1\times10^{-10}$ M (inclusive); about $1\times10^{-10}$ M to about $1\times10^{-5}$ M, about $0.5\times10^{5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, or about $0.5\times10^{-9}$ M (inclusive); about $0.5\times10^{-9}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, or about $1\times10^{-9}$ M (inclusive); about $1\times10^{-9}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, or about $0.5\times10^{-8}$ M (inclusive); about $0.5\times10^{-8}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, or about $1\times10^{-8}$ M (inclusive); about $1\times10^{-8}$ M to about $1\times10^{-5}$ M, about $0.5\times10^{-5}$ M, about $1\times10^{-6}$ M, about $0.5\times10^{-6}$ M, about $1\times10^{-7}$ M, or about $0.5\times10^{-7}$ M (inclusive); about $0.5\times10^{-7}$ M to about $1\times10^{-5}$ M, about $0.5\times10^{-5}$ M, about $1\times10^{-6}$ M, about $0.5\times10^{-6}$ M, or about $1\times10^{-7}$ M (inclusive); about $1\times10^{-7}$ M to about $1\times10^{-5}$ M, about $0.5\times10^{-5}$ M, about $1\times10^{-6}$ M, or about $0.5\times10^{-6}$ M (inclusive); about $0.5\times10^{-6}$ M to about $1\times10^{-5}$ M, about $0.5\times10^{-5}$ M, or about $1\times10^{-6}$ M (inclusive); about $1\times10^{-6}$ M to about $1\times10^{-5}$ M or about $0.5\times10^{-5}$ M (inclusive); or about $0.5\times10^{-5}$ M to about $1\times10^{5}$ M (inclusive), e.g., as measured in phosphate buffered saline using surface plasmon resonance (SPR).

In some embodiments, any of the antibodies or antigen-binding fragments described herein has a $K_{off}$ of about $1\times10^{-6}$ s$^{-1}$ to about $1\times10^{-3}$ s$^{-1}$, about $0.5\times10^{-3}$ s$^{-1}$, about $1\times10^{-4}$ s$^{-1}$, about $0.5\times10^{-4}$ s$^{-1}$, about $1\times10^{-5}$ s$^{-1}$, or about $0.5\times10^{-5}$ s$^{-1}$ (inclusive); about $0.5\times10^{-5}$ s$^{-1}$ to about $1\times10^{-3}$ s$^{-1}$, about $0.5\times10^{-3}$ s$^{-1}$, about $1\times10^{-4}$ s$^{-1}$, about $0.5\times10^{-4}$ s$^{-1}$, or about $1\times10^{-5}$ s$^{-1}$ (inclusive); about $1\times10^{-5}$ s$^{-1}$ to about $1\times10^{-3}$ s$^{-1}$, about $0.5\times10^{-3}$ s$^{-1}$, about $1\times10^{-4}$ s$^{-1}$, or about $0.5\times10^{-4}$ s$^{-1}$ (inclusive); about $0.5\times10^{-4}$ s$^{-1}$ to about $1\times10^{-3}$ s$^{-1}$, about $0.5\times10^{-3}$ s$^{-1}$, or about $1\times10^{-4}$ s$^{-1}$ (inclusive); about $1\times10^{-4}$ s$^{-1}$ to about $1\times10^{-3}$ s$^{-1}$, or about $0.5\times10^{-3}$ s$^{-1}$ (inclusive); or about $0.5\times10^{-5}$ s$^{-1}$ to about $1\times10^{-3}$ s$^{-1}$ (inclusive), e.g., as measured in phosphate buffered saline using surface plasmon resonance (SPR).

In some embodiments, any of the antibodies or antigen-binding fragments described herein has a $K_{on}$ of about $1\times10^{2}$ M$^{-1}$s$^{-1}$ to about $1\times10^{6}$ M$^{-1}$s$^{-1}$, about $0.5\times10^{6}$ M$^{-1}$s$^{-1}$, about $1\times10^{5}$ M$^{-1}$s$^{-1}$, about $0.5\times10^{5}$ M$^{-1}$s$^{-1}$, about $1\times10^{4}$ M$^{-1}$s$^{-1}$, about $0.5\times10^{4}$ M$^{-1}$s$^{-1}$, about $1\times10^{3}$ M$^{-1}$s$^{-1}$, or about $0.5\times10^{3}$ M$^{-1}$s$^{-1}$ (inclusive); about $0.5\times10^{3}$ M$^{-1}$s$^{-1}$ to about $1\times10^{6}$ M$^{-1}$s$^{-1}$, about $0.5\times10^{6}$ M$^{-1}$s$^{-1}$, about $1\times10^{5}$ M$^{-1}$s$^{-1}$, about $0.5\times10^{5}$ M$^{-1}$s$^{-1}$, about $1\times10^{4}$ M$^{-1}$s$^{-1}$, about $0.5\times10^{4}$ M$^{-1}$s$^{-1}$ (inclusive); about $1\times10^{3}$ M$^{-1}$s$^{-1}$ to about $1\times10^{6}$ M$^{-1}$s$^{-1}$, about $0.5\times10^{6}$ M$^{-1}$s$^{-1}$, about $1\times10^{5}$ M$^{-1}$s$^{-1}$, about $0.5\times10^{5}$ M$^{-1}$s$^{-1}$, about $1\times10^{4}$ M$^{-1}$s$^{-1}$, or about $0.5\times10^{4}$ M$^{-1}$s$^{-1}$ (inclusive); about $0.5\times10^{4}$ M$^{-1}$s$^{-1}$ to about $1\times10^{6}$ M$^{-1}$s$^{-1}$, about $0.5\times10^{6}$ M$^{-1}$s$^{-1}$, about $1\times10^{5}$ M$^{-1}$s$^{-1}$, about $0.5\times10^{5}$ M$^{-1}$s$^{-1}$, or about $1\times10^{4}$ M$^{-1}$s$^{-1}$ (inclusive); about $1\times10^{4}$ M$^{-1}$s$^{-1}$ to about $1\times10^{6}$ M$^{-1}$s$^{-1}$, about $0.5\times10^{6}$ M$^{-1}$s$^{-1}$, about $1\times10^{5}$ M$^{-1}$s$^{-1}$, or about $0.5\times10^{5}$ M$^{-1}$s$^{-1}$ (inclusive); about $0.5\times10^{5}$ M$^{-1}$s$^{-1}$ to about $1\times10^{6}$ M$^{-1}$s$^{-1}$, about $0.5\times10^{6}$ M$^{-1}$s$^{-1}$, or about $1\times10^{5}$ M$^{-1}$s$^{-1}$ (inclusive); about $1\times10^{5}$ M$^{-1}$s$^{-1}$ to about $1\times10^{6}$ M$^{-1}$s$^{-1}$, or about $0.5\times10^{6}$ M$^{-1}$s$^{-1}$ (inclusive); or about $0.5\times10^{6}$ M$^{-1}$s$^{-1}$ to about $1\times10^{6}$ M$^{-1}$s$^{-1}$ (inclusive), e.g., as measured in phosphate buffered saline using surface plasmon resonance (SPR).

Fusion and Truncated Proteins and Peptides

In some embodiments, the CD40/CD40L inhibitor is a fusion protein, a truncated protein (e.g., a soluble receptor) or a peptide. In some embodiments, the CD40/CD40L inhibitor is a truncated protein as disclosed in, for example, WO 01/096397. In some embodiments, the CD40/CD40L inhibitor is a peptide, such as a cyclic peptide (see, e.g., U.S. Pat. No. 8,802,634; Bianco et al., *Org. Biomol. Chem.* 4:1461-1463, 2006; Deambrosis et al., *J. Mol. Med.* 87 (2): 181-197, 2009; Vaitaitis et al., *Diabetologia* 57 (11): 2366-2373, 2014). In some embodiments, the CD40/CD40L inhibitor is a CD40 ligand binder, for example, a Tumor Necrosis Factor Receptor-associated Factor (TRAF): TRAF2, TRAF3, TRAF6, TRAF5 and TTRAP, or E3 ubiquitin-protein ligase RNF128.

Small Molecules

In some embodiments, the CD40/CD40L inhibitor is a small molecule (see, e.g., U.S. Pat. No. 7,173,046, U.S. Patent Application No. 2011/0065675). In some embodiments, the small molecule is Bio8898 (Silvian et al., *ACS Chem. Biol.* 6 (6): 636-647, 2011); Suramin (Margolles-Clark et al., *Biochem. Pharmacol.* 77 (7): 1236-1245, 2009); a small-molecule organic dye (Margolles-Clark et al., *J. Mol. Med.* 87 (11): 1133-1143, 2009; Buchwald et al., *J. Mol. Recognit.* 23 (1): 65-73, 2010), a naphthalenesulphonic acid derivative (Margolles-Clark et al., *Chem. Biol. Drug Des.* 76 (4): 305-313, 2010), or a variant thereof.

CD3 Inhibitors

The term "CD3 inhibitor" refers to an agent which decreases the ability of one or more of CD3K, CD3δ, CD3ε, and CD3ζ to associate with one or more of TCR-α, TCR-ϑ, TCR-δ, and TCR-K. In some embodiments, the CD3 inhibitor can decrease the association between one or more of CD3K, CD3δ, CD3ε, and CD3ζ and one or more of TCR-α, TCR-ϑ, TCR-δ, and TCR-K by blocking the ability of one or more of CD3K, CD3δ, CD3ε, and CD3ζ to interact with one or more of TCR-α, TCR-9, TCR-δ, and TCR-K.

In some embodiments, the CD3 inhibitor is an antibody or an antigen-binding fragment thereof, a fusion protein, or a small molecule. Exemplary CD3 inhibitors are described herein. Additional examples of CD3 inhibitors are known in the art.

Exemplary sequences for human CD3K, human CD3δ, human CD3ε, and human CD3ζ are shown below.

```
Human CD3γ
                                            (SEQ ID NO: 7)
MEQGKGLAVL ILAIILLQGT LAQSIKGNHL VKVYDYQEDG

SVLLTCDAEA KNITWFKDGKMIGFLTEDKK KWNLGSNAKD

PRGMYQCKGS QNKSKPLQVY YRMCQNCIEL

NAATISGFLFAEIVSIFVLA VGVYFIAGQD GVRQSRASDK

QTLLPNDQLY QPLKDREDDQ YSHLQGNQLRRN

Human CD3δ Isoform A
                                            (SEQ ID NO: 8)
FKIPIEELE DRVFVNCNTS ITWVEGTVGT LLSDITRLDL

GKRILDPRGI YRCNGTDIYK DKESTVQVHY RMCQSCVELD

PATVAGIIVT DVIATLLLAL GVFCFAGHET GRLSGAADTQ

ALLRNDQVYQ PLRDRDDAQY SHLGGNWARN K

Human CD3δ Isoform B
                                            (SEQ ID NO: 9)
FKIPIEELE DRVFVNCNTS ITWVEGTVGT LLSDITRLDL

GKRILDPRGI YRCNGTDIYK DKESTVQVHY RTADTQALLR

NDQVYQPLRD RDDAQYSHLG GNWARNK

Human CD3ε
                                           (SEQ ID NO: 10)
DGNEEMGG ITQTPYKVSI SGTTVILTCP QYPGSEILWQ

HNDKNIGGDE DDKNIGSDED HLSLKEFSEL EQSGYYVCYP

RGSKPEDANF YLYLRARVCE NCMEMDVMSV ATIVIVDICI

TGGLLLLVYY WSKNRKAKAK PVTRGAGAGG RQRGQNKERP

PPVPNPDYEP IRKGQRDLYS GLNQRRI

Human CD3ζ Isoform 1
                                           (SEQ ID NO: 11)
QSFGLLDPK LCYLLDGILF IYGVILTALF LRVKFSRSAD

APAYQQGQNQ LYNELNLGRR EEYDVLDKRR GRDPEMGGKP

QRRKNPQEGL YNELQKDKMA EAYSEIGMKG ERRRGKGHDG

LYQGLSTATK DTYDALHMQA LPPR

Human CD3ζ Isoform 2
                                           (SEQ ID NO: 12)
QSFGLLDPK LCYLLDGILF IYGVILTALF LRVKFSRSAD

APAYQQGQNQ LYNELNLGRR EEYDVLDKRR GRDPEMGGKP

RRKNPQEGLY NELQKDKMAE AYSEIGMKGE RRRGKGHDGL

YQGLSTATKD TYDALHMQAL PPR
```

Antibodies

In some embodiments, the CD3 inhibitor is an antibody or an antigen-binding fragment thereof (e.g., a Fab or a scFv). In some embodiments, the CD3 inhibitor is an antibody or antigen-binding fragment that binds specifically to CD3κ. In some embodiments, the CD3 inhibitor is an antibody or antigen-binding fragment that binds specifically to CD3δ. In some embodiments, the CD3 inhibitor is an antibody or antigen-binding fragment that binds specifically to CD3ε. In some embodiments, the CD3 inhibitor is an antibody or antigen-binding fragment that binds specifically to CD3ζ. In some embodiments, the CD3 inhibitor is an antibody or an antigen-binding fragment that can bind to two or more (e.g., two, three, or four) of CD3κ, CD3δ, CD3ε, and CD3ζ.

In certain embodiments, the antibody comprises or consists of an antigen-binding fragment or portion of visiluzumab (Nuvion; HuM-291; M291; SMART anti-CD3 antibody) (Carpenter et al., *Biol. Blood Marrow Transplant* 11 (6): 465-471, 2005; Trajkovic *Curr. Opin. Investig. Drugs* 3 (3): 411-414, 2002; Malviya et al., *J. Nucl. Med.* 50 (10): 1683-1691, 2009); muromonab-CD3 (orthoclone OKT3) (Hori et al., *Surg. Today* 41 (4): 585-590, 2011; Norman *Ther. Drug Monit.* 17 (6): 615-620, 1995; and Gramatzki et al., *Leukemia* 9 (3): 382-390, 19); otelixizumab (TRX4) (Vossenkamper et al., *Gastroenterology* 147 (1): 172-183, 2014; and Wiczling et al., *J. Clin. Pharmacol.* 50 (5): 494-506, 2010); foralumab (NI-0401) (Ogura et al., *Clin. Immunol.* 183:240-246; and van der Woude et al., *Inflamm. Bowel Dis.* 16:1708-1716, 2010); ChAgly CD3; teplizumab (MGA031) (Waldron-Lynch et al., *Sci. Transl. Med.* 4 (118): 118ra12, 2012; and Skelley et al., *Ann. Pharmacother.* 46 (10): 1405-1412, 2012); or catumaxomab (Removab®) (Linke et al., Mabs 2 (2): 129-136, 2010; and Bokemeyer et al., *Gastric Cancer* 18 (4): 833-842, 2015).

Additional examples of CD3 inhibitors that are antibodies or antibody fragments are described in, e.g., U.S. Patent Application Publication Nos. 2017/0204194, 2017/0137519, 2016/0368988, 2016/0333095, 2016/0194399, 2016/0168247, 2015/0166661, 2015/0118252, 2014/0193399, 2014/0099318, 2014/0088295, 2014/0080147, 2013/0115213, 2013/0078238, 2012/0269826, 2011/0217790, 2010/0209437, 2010/0183554, 2008/0025975, 2007/0190045, 2007/0190052, 2007/0154477, 2007/0134241, 2007/0065437, 2006/0275292, 2006/0269547, 2006/0233787, 2006/0177896, 2006/0165693, 2006/0088526, 2004/0253237, 2004/0202657, 2004/0052783, 2003/0216551, and 2002/0142000, each of which is herein incorporated by reference in its entirety (e.g., the sections describing the CD3 inhibitors). Additional CD3 inhibitors that are antibodies or antigen-binding antibody fragments are described in, e.g., Smith et al., *J. Exp. Med.* 185 (8): 1413-1422, 1997; Chatenaud et al., *Nature* 7:622-632, 2007.

In some embodiments, the CD3 inhibitor comprises or consists of a bispecific antibody (e.g., JNJ-63709178) (Gaudet et al., *Blood* 128 (22): 2824, 2016); JNJ-64007957 (Girgis et al., *Blood* 128:5668, 2016); MGD009 (Tolcher et al., *J. Clin. Oncol.* 34:15, 2016); ERY974 (Ishiguro et al., *Sci. Transl. Med.* 9 (410): pii.eaal4291, 2017); AMV564 (Hoseini and Cheung Blood Cancer J. 7: e522, 2017); AFM11 (Reusch et al., MAbs 7 (3): 584-604, 2015); duvortuxizumab (JNJ 64052781); RO6958688; blinatumomab (Blincyto®; AMG103) (Ribera *Expert Rev. Hematol.* 1:1-11, 2017; and Mori et al., *N Engl. J. Med.* 376 (23): e49, 2017); XmAb13676; or REGN1979 (Bannerji et al., *Blood* 128: 621, 2016; and Smith et al., *Sci. Rep.* 5:17943, 2015)).

In some embodiments, the CD3 inhibitor comprises or consists of a trispecific antibody (e.g., ertumaxomab (Kicwe and Thiel, *Expert Opin. Investig. Drugs* 17 (10): 1553-1558, 2008; and Haense et al., *BMC Cancer* 16:420, 2016); or FBTA05 (Bi20; Lymphomun) (Buhmann et al., *J. Transl. Med.* 11:160, 2013; and Schuster et al., *Br. J. Haematol.* 169 (1): 90-102, 2015)).

CD3 Inhibitor Fusion and Truncated Proteins and Peptides

In some embodiments, the CD3 inhibitor is a fusion protein, a truncated protein (e.g., a soluble receptor), or a peptide. In some embodiments, the CD3 inhibitor can be a fusion protein (see, e.g., Lee et al., *Oncol. Rep.* 15 (5): 1211-1216, 2006).

CD3 Inhibitor Small Molecules

In some embodiments, the CD3 inhibitor comprises or consists of a bispecific small molecule-antibody conjugate (see, e.g., Kim et al., *PNAS* 110 (44): 17796-17801, 2013; Viola et al., *Eur. J. Immunol.* 27 (11): 3080-3083, 1997).

CD14 Inhibitors

The term "CD14 inhibitors" refers to an agent which decreases the ability of CD14 to bind to lipopolysaccharide (LPS). CD14 acts as a co-receptor with Toll-like receptor 4 (TLR4) that binds LPS in the presence of lipopolysaccharide-binding protein (LBP).

In some embodiments, the CD14 inhibitor can decrease the binding between CD14 and LPS by blocking the ability of CD14 to interact with LPS.

In some embodiments, the CD14 inhibitor is an antibody or an antigen-binding fragment thereof. In some embodiments, the CD14 inhibitor is a small molecule. Exemplary CD14 inhibitors are described herein. Additional examples of CD14 inhibitors are known in the art.

An exemplary sequence for human CD14 is shown below.

```
Human CD14
                                       (SEQ ID NO: 13)
MAAAAASRGV GAKLGLREIR IHLCQRSPGS QGVRDFIEKR

YVELKKANPD LPILIRECSD VQPKLWARYA FGQETNVPLN

NFSADQVTRA LENVLSGKA
```

CD14 Inhibitors-Antibodies

In some embodiments, the CD14 inhibitor is an antibody or an antigen-binding fragment thereof (e.g., a Fab or a scFv). In some embodiments, the CD14 inhibitor is an antibody or antigen-binding fragment that binds specifically to CD14.

In certain embodiments, the antibody comprises or consists of an antigen-binding fragment or portion of IC14 (Axtelle and Pribble, *J. Endotoxin Res.* 7 (4): 310-314, 2001; Reinhart et al., *Crit. Care Med.* 32 (5): 1100-1108, 2004; Spek et al., *J. Clin. Immunol.* 23 (2): 132-140, 2003). Additional examples of anti-CD14 antibodies and CD14 inhibitors can be found, e.g., in WO 2015/140591 and WO 2014/122660, incorporated in its entirety herein.

Additional examples of CD14 inhibitors that are antibodies or antibody fragments are described in, e.g., U.S. Patent Application Ser. No. 2017/0107294, 2014/0050727, 2012/0227412, 2009/0203052, 2009/0029396, 2008/0286290, 2007/0106067, 2006/0257411, 2006/0073145, 2006/0068445, 2004/0092712, 2004/0091478, and 2002/0150882, each of which is herein incorporated by reference (e.g., the sections that describe CD14 inhibitors).

Additional examples of CD14 inhibitors that are antibodies or antigen-binding fragments are known in the art.

CD14 Inhibitors-Small Molecules

In some embodiments, the CD14 inhibitor is a small molecule. Non-limiting examples of CD14 inhibitors that are small molecules are described in, e.g., methyl 6-deoxy-6-N-dimethyl-N-cyclopentylammonium-2,3-di-O-tetradecyl-α-D-glucopyranoside iodide (IAXO-101); methyl 6-Deoxy-6-amino-2,3-di-O-tetradecyl-α-D-glucopyranoside (IAXO-102); N-(3,4-bis-tetradecyloxy-benzyl)-N-cyclopentyl-N,N-dimethylammonium iodide (IAXO-103); and IMO-9200.

Additional examples of CD14 inhibitors that are small molecules are known in the art.

CD20 Inhibitors

The term "CD20 inhibitors" refers to an agent that binds specifically to CD20 expressed on the surface of a mammalian cell.

In some embodiments, the CD20 inhibitor is an antibody or an antigen-binding fragment thereof, or a fusion protein or peptide. Exemplary CD20 inhibitors are described herein. Additional examples of CD20 inhibitors are known in the art.

An exemplary sequence of human CD20 is shown below.

```
Human CD20
                                          (SEQ ID NO: 14)
MTTPRNSVNG  TFPAEPMKGP  IAMQSGPKPL  FRRMSSLVGP

TQSFFMRESK  TLGAVQIMNG  LFHIALGGLL  MIPAGIYAPI

CVTVWYPLWG  GIMYIISGSL  LAATEKNSRK  CLVKGKMIMN

SLSLFAAISG  MILSIMDILN  IKISHFLKME  SLNFIRAHTP

YINIYNCEPA  NPSEKNSPST  QYCYSIQSLF  LGILSVMLIF

AFFQELVIAG  IVENEWKRTC  SRPKSNIVLL  SAEEKKEQTI

EIKEEVVGLT  ETSSQPKNEE  DIEIIPIQEE  EEEETETNFP

EPPQDQESSP  IENDSSP
```

CD20 Inhibitors-Antibodies

In some embodiments, the CD20 inhibitor is an antibody or an antigen-binding fragment thereof (e.g., a Fab or a scFv).

In certain embodiments, the antibody comprises or consists of an antigen-binding fragment or portion of rituximab (Rituxan®, MabThera®, MK-8808) (Ji et al., *Indian J. Hematol. Blood Transfus.* 33 (4): 525-533, 2017; and Calderon-Gomez and Panes Gastroenterology 142 (1): 1741-76, 2012);-PF-05280586; ocrelizumab (Ocrevus™) (Sharp *N. Engl. J. Med.* 376 (17): 1692, 2017); ofatumumab (Arzerra®; HuMax-CD20) (AlDallal *Ther. Clin. Risk Manag.* 13:905-907, 2017; and Furman et al., *Lancet Haematol.* 4 (1): e24-e34, 2017); PF-05280586 (Williams et al., *Br. J. Clin. Pharmacol.* 82 (6): 1568-1579, 2016; and Cohen et al., *Br. J. Clin. Pharmacol.* 82 (1): 129-138, 2016); obinutuzumab (Gazyva®) (Reddy et al., *Rheumatology* 56 (7): 1227-1237, 2017; and Marcus et al., *N. Engl. J. Med.* 377 (14): 1331-1344, 2017); ocaratuzumab (AME-133v; LY2469298) (Cheney et al., Mabs 6 (3): 749-755, 2014; and Tobinai et al., *Cancer Sci.* 102 (2): 432-8, 2011); GP2013 (Jurczak et al., *Lancet Haenatol.* 4 (8): e350-e361, 2017); IBI301; HLX01; veltuzumab (hA20) (Kalaycio et al., *Leuk. Lymphoma* 57 (4): 803-811, 2016; and Ellebrecht et al., *JAMA Dermatol.* 150 (12): 1331-1335, 2014); SCT400 (Gui et al., *Chin. J. Cancer Res.* 28 (2): 197-208); ibritumomab tiuxetan (Zevalin®) (Philippe et al., *Bone Marrow Transplant* 51 (8): 1140-1142, 2016; and Lossos et al., *Leuk. Lymphoma* 56 (6): 1750-1755, 2015); ublituximab (TG1101) (Sharman et al., *Blood* 124:4679, 2014; and Sawas et al., *Br. J. Haematol.* 177 (2): 243-253, 2017); LFB-R603 (Esteves et al., *Blood* 118:1660, 2011; and Baritaki et al., *Int. J. Oncol.* 38 (6): 1683-1694, 2011); or tositumomab (Bexxar) (Buchegger et al., *J. Nucl. Med.* 52 (6): 896-900, 2011; and William and Bierman *Expert Opin. Biol. Ther.* 10 (8): 1271-1278, 2010). Additional examples of CD20 antibodies are known in the art (see, e.g., WO 2008/156713).

In certain embodiments, the antibody comprises or consists of an antigen-binding fragment or portion of a bispecific antibody (e.g., XmAb13676; REGN1979 (Bannerji et al., *Blood* 128:621, 2016; and Smith et al., *Sci. Rep.* 5:17943, 2015); PRO131921 (Casulo et al., *Clin. Immnol.* 154 (1): 37-46, 2014; and Robak and Robak *BioDrugs* 25 (1): 13-25, 2011); or Acellbia).

In some embodiments, the CD20 inhibitor comprises or consists of a trispecific antibody (e.g., FBTA05 (Bi20; Lymphomun) (Buhmann et al., *J. Transl. Med.* 11:160, 2013; and Schuster et al., *Br. J. Haematol.* 169 (1): 90-102, 2015)).

Additional examples of CD20 inhibitors that are antibodies or antigen-binding fragments are described in, e.g., U.S. Patent Application Publication Nos. 2017/0304441, 2017/0128587, 2017/0088625, 2017/0037139, 2017/0002084, 2016/0362472, 2016/0347852, 2016/0333106, 2016/0271249, 2016/0243226, 2016/0115238, 2016/0108126, 2016/0017050, 2016/0017047, 2016/0000912, 2016/0000911, 2015/0344585, 2015/0290317, 2015/0274834, 2015/0265703, 2015/0259428, 2015/0218280, 2015/0125446, 2015/0093376, 2015/0079073, 2015/0071911, 2015/0056186, 2015/0010540, 2014/0363424, 2014/0356352, 2014/0328843, 2014/0322200, 2014/0294807, 2014/0248262, 2014/0234298, 2014/0093454, 2014/0065134, 2014/0044705, 2014/0004104, 2014/0004037, 2013/0280243, 2013/0273041, 2013/0251706, 2013/0195846, 2013/0183290, 2013/0089540, 2013/0004480, 2012/0315268, 2012/0301459, 2012/0276085, 2012/0263713, 2012/0258102, 2012/0258101, 2012/0251534, 2012/0219549, 2012/0183545, 2012/0100133, 2012/0034185, 2011/0287006, 2011/0263825, 2011/0243931, 2011/0217298, 2011/0200598, 2011/0195022, 2011/0195021, 2011/0177067, 2011/0165159, 2011/0165152, 2011/0165151, 2011/0129412, 2011/0086025, 2011/0081681, 2011/0020322, 2010/0330089, 2010/0310581, 2010/0303808, 2010/0183601, 2010/0080769, 2009/0285795, 2009/0203886, 2009/0197330, 2009/0196879, 2009/0191195, 2009/0175854, 2009/0155253, 2009/0136516, 2009/0130089, 2009/0110688, 2009/0098118, 2009/0074760, 2009/0060913, 2009/0035322, 2008/0260641, 2008/0213273, 2008/0089885, 2008/0044421, 2008/0038261, 2007/0280882, 2007/0231324, 2007/0224189, 2007/0059306, 2007/0020259, 2007/0014785, 2007/0014720, 2006/0121032, 2005/0180972, 2005/0112060, 2005/0069545, 2005/0025764, 2004/0213784, 2004/0167319, 2004/0093621, 2003/0219433, 2003/0206903, 2003/0180292, 2003/0026804, 2002/0039557, 2002/0012665, and 2001/0018041, each herein incorporated by reference in their entirety (e.g., sections describing CD20 inhibitors).

Additional examples of CD20 inhibitors that are antibodies or antigen-binding fragments are known in the art.

CD20 Inhibitors-Peptides and Fusion Proteins

In some embodiments, the CD20 inhibitor is an immunotoxin (e.g., MT-3724 (Hamlin Blood 128:4200, 2016).

In some embodiments, the CD20 inhibitor is a fusion protein (e.g., TRU-015 (Rubbert-Roth *Curr. Opin. Mol. Ther.* 12 (1): 115-123, 2010). Additional examples of CD20 inhibitors that are fusion proteins are described in, e.g., U.S. Patent Application Publication Nos. 2012/0195895, 2012/

0034185, 2009/0155253, 2007/0020259, and 2003/0219433, each of which are herein incorporated by reference in their entirety (e.g., sections describing CD20 inhibitors).

CD25 Inhibitors

The term "CD25 inhibitors" refers to an agent which decreases the ability of CD25 (also called interleukin-2 receptor alpha chain) to bind to interleukin-2. CD25 forms a complex with interleukin-2 receptor beta chain and interleukin-2 common gamma chain.

In some embodiments, the CD25 inhibitor is an antibody or an antigen-binding fragment thereof, or a fusion protein. Exemplary CD25 inhibitors are described herein. Additional examples of CD25 inhibitors are known in the art.

An exemplary sequence of human CD25 is shown below.

```
Human CD25 Isoform 1
                                          (SEQ ID NO: 15)
ELCDDDPPE IPHATFKAMA YKEGTMLNCE CKRGFRRIKS

GSLYMLCTGN SSHSSWDNQC QCTSSATRNT TKQVTPQPEE

QKERKTTEMQ SPMQPVDQAS LPGHCREPPP WENEATERIY

HFVVGQMVYY QCVQGYRALH RGPAESVCKM THGKTRWTQP

QLICTGEMET SQFPGEEKPQ ASPEGRPESE TSCLVTTTDF

QIQTEMAATM ETSIFTTEYQ VAVAGCVFLL ISVLLLSGLT

WQRRQRKSRR TI

Human CD25 Isoform 2
                                          (SEQ ID NO: 16)
ELCDDDPPE IPHATFKAMA YKEGTMLNCE CKRGFRRIKS

GSLYMLCTGN SSHSSWDNQC QCTSSATRNT TKQVTPQPEE

QKERKTTEMQ SPMQPVDQAS LPGEEKPQAS PEGRPESETS

CLVTTTDFQI QTEMAATMET SIFTTEYQVA VAGCVFLLIS

VLLLSGLTWQ RRQRKSRRTI

Human CD25 Isoform 3
                                          (SEQ ID NO: 17)
elcdddppe iphatfkama ykegtmlnce ckrgfrriks gslymlctgn sshsswdnqc qctssatmt tkqvtpqpee qkerkttemq spmqpvdqas lpdfqiqtem aatmetsift teyqvavagc vfllisvlll sgltwqrrqr ksrrti
```

CD25 Inhibitors-Antibodies

In some embodiments, the CD25 inhibitor is an antibody or an antigen-binding fragment thereof (e.g., a Fab or a scFv). In some embodiments, a CD25 inhibitor is an antibody or an antigen-binding fragment thereof that specifically binds to CD25. In some embodiments, a CD25 inhibitor is an antibody that specifically binds to IL-2.

In certain embodiments, the antibody comprises or consists of an antigen-binding fragment or portion of basiliximab (Simulect™) (Wang et al., *Clin. Exp. Immunol.* 155 (3): 496-503, 2009; and Kircher et al., *Clin. Exp. Immunol.* 134 (3): 426-430, 2003); daclizumab (Zenapax; Zinbryta®) (Berkowitz et al., *Clin. Immunol.* 155 (2): 176-187, 2014; and Bielekova et al., *Arch Neurol.* 66 (4): 483-489, 2009); or IMTOX-25.

In some embodiments, the CD25 inhibitor is an antibody-drug-conjugate (e.g., ADCT-301 (Flynn et al., *Blood* 124: 4491, 2014)).

Additional examples of CD25 inhibitors that are antibodies are known in the art (see, e.g., WO 2004/045512).

Additional examples of CD25 inhibitors that are antibodies or antigen-binding fragments are described in, e.g., U.S. Patent Application Publication Nos. 2017/0240640, 2017/0233481, 2015/0259424, 2015/0010539, 2015/0010538, 2012/0244069, 2009/0081219, 2009/0041775, 2008/0286281, 2008/0171017, 2004/0170626, 2001/0041179, and 2010/0055098, each of which is incorporated herein by reference (e.g., sections that describe CD25 inhibitors).

Additional examples of CD25 inhibitors that are antibodies or antigen-binding fragments are known in the art.

CD25 Inhibitors-Fusion Proteins

In some embodiments, the CD25 inhibitor is a fusion protein. See, e.g., Zhang et al., *PNAS* 100 (4): 1891-1895, 2003.

CD28 Inhibitors

The term "CD28 inhibitors" refers to an agent which decreases the ability of CD28 to bind to one or both of CD80 and CD86. CD28 is a receptor that binds to its ligands, CD80 (also called B7.1) and CD86 (called B7.2).

In some embodiments, the CD28 inhibitor can decrease the binding between CD28 and CD80 by blocking the ability of CD28 to interact with CD80. In some embodiments, the CD28 inhibitor can decrease the binding between CD28 and CD86 by blocking the ability of CD28 to interact with CD86. In some embodiments, the CD28 inhibitor can decrease the binding of CD28 to each of CD80 and CD86.

In some embodiments, the CD28 inhibitor is an antibody or an antigen-binding fragment thereof, a fusion protein, or peptide. Exemplary CD28 inhibitors are described herein. Additional examples of CD28 inhibitors are known in the art.

Exemplary sequences for human CD28, human CD80, and human CD86 are shown below.

```
Human CD28 Isoform 1
                                          (SEQ ID NO: 18)
NKILVKQSPMLV AYDNAVNLSC KYSYNLFSRE FRASLHKGLD

SAVEVCVVYG NYSQQLQVYS KTGFNCDGKL GNESVTFYLQ

NLYVNQTDIY FCKIEVMYPP PYLDNEKSNG TIIHVKGKHL

CPSPLFPGPS KPFWVLVVVG GVLACYSLLV TVAFIIFWVR

SKRSRLLHSD YMNMTPRRPG PTRKHYQPYA PPRDFAAYRS

Human CD28 Isoform 2
                                          (SEQ ID NO: 19)
NKILVKQSPMLV AYDNAVNLSW KHLCPSPLFP GPSKPFWVLV

VVGGVLACYS LLVTVAFIIF WVRSKRSRLL HSDYMNMTPR

RPGPTRKHYQ PYAPPRDFAA YRS

Human CD28 Isoform 3
                                          (SEQ ID NO: 20)
KHLCPSPLFPGP SKPFWVLVVV GGVLACYSLL VTVAFIIFWV

RSKRSRLLHS DYMNMTPRRP GPTRKHYQPY APPRDFAAYR S

Human CD80
                                          (SEQ ID NO: 19)
VIHVTK EVKEVATLSC GHNVSVEELA QTRIYWQKEK KMVLTMMSGD

MNIWPEYKNR TIFDITNNLS IVILALRPSD EGTYECVVLK

YEKDAFKREH LAEVTLSVKA DFPTPSISDF EIPTSNIRRI

ICSTSGGFPE PHLSWLENGE ELNAINTTVS QDPETELYAV

SSKLDFNMTT NHSFMCLIKY GHLRVNQTFN WNTTKQEHFP
```

```
                                    -continued
DNLLPSWAIT LISVNGIFVI CCLTYCFAPR CRERRRNERL

RRESVRPV

Human CD86 Isoform 1
                                              (SEQ ID NO: 20)
YFNETADLPC QFANSQNQSL SELVVFWQDQ ENLVLNEVYL

GKEKFDSVHS KYMGRTSFDS DSWTLRLHNL QIKDKGLYQC

IIHHKKPTGM IRIHQMNSEL SVLANFSQPE IVPISNITEN

VYINLTCSSI HGYPEPKKMS VLLRTKNSTI EYDGIMQKSQ

DNVTELYDVS ISLSVSFPDV TSNMTIFCIL ETDKTRLLSS

PFSIELEDPQ PPPDHIPWIT AVLPTVIICV MVFCLILWKW

KKKKRPRNSY KCGTNTMERE ESEQTKKREK IHIPERSDEA

QRVFKSSKTS SCDKSDTCF

Human CD86 Isoform 2
                                              (SEQ ID NO: 21)
YFNETA DLPCQFANSQ NQSLSELVVF WQDQENLVLN EVYLGKEKFD

SVHSKYMGRT SFDSDSWTLR LHNLQIKDKG LYQCIIHHKK

PTGMIRIHQM NSELSVLANF SQPEIVPISN ITENVYINLT

CSSIHGYPEP KKMSVLLRTK NSTIEYDGIM QKSQDNVTEL

YDVSISLSVS FPDVTSNMTI FCILETDKTR LLSSPFSIEL

EDPQPPPDHI PWITAVLPTV IICVMVFCLI LWKWKKKKRP

RNSYKCGTNT MEREESEQTK KREKIHIPER SDEAQRVFKS

SKTSSCDKSD TCF

Human CD86 Isoform 3
                                              (SEQ ID NO: 22)
YFNETA DLPCQFANSQ NQSLSELVVF WQDQENLVLN EVYLGKEKFD

SVHSKYMGRT SFDSDSWTLR LHNLQIKDKG LYQCIIHHKK

PTGMIRIHQM NSELSVLANF SQPEIVPISN ITENVYINLT

CSSIHGYPEP KKMSVLLRTK NSTIEYDGIM QKSQDNVTEL

YDVSISLSVS FPDVTSNMTI FCILETDKTR LLSSPFSIGT

NTMEREESEQ TKKREKIHIP ERSDEAQRVF KSSKTSSCDK SDTCF

Human CD86 Isoform 4
                                              (SEQ ID NO: 23)
EIV PISNITENVY INLTCSSIHG YPEPKKMSVL LRTKNSTIEY

DGIMQKSQDN VTELYDVSIS LSVSFPDVTS NMTIFCILET

DKTRLLSSPF SIELEDPQPP PDHIPWITAV LPTVIICVMV

FCLILWKWKK KKRPRNSYKC GTNTMEREES EQTKKREKIH

IPERSDEAQR VFKSSKTSSC DKSDTCF

Human CD86 Isoform 5
                                              (SEQ ID NO: 24)
MGRTSFDSDS WTLRLHNLQI KDKGLYQCII HHKKPTGMIR

IHQMNSELSV LANFSQPEIV PISNITENVY INLTCSSIHG

YPEPKKMSVL LRTKNSTIEY DGIMQKSQDN VTELYDVSIS

LSVSFPDVTS NMTIFCILET DKTRLLSSPF SIELEDPQPP

PDHIPWITAV LPTVIICVMV FCLILWKWKK KKRPRNSYKC

GTNTMEREES EQTKKREKIH IPERSDEAQR VFKSSKTSSC

DKSDTCF
```

CD28 Inhibitors-Antibodies

In some embodiments, the CD28 inhibitor is an antibody or an antigen-binding fragment thereof (e.g., a Fab or a scFv).

In some embodiments, the CD28 inhibitor is a monovalent Fab' antibody (e.g., CFR104) (Poirier et al., *Am. J. Transplant* 15 (1): 88-100, 2015).

Additional examples of CD28 inhibitors that are antibodies or antigen-binding fragments are described in, e.g., U.S. Patent Application Publication Nos. 2017/0240636, 2017/0114136, 2016/0017039, 2015/0376278, 2015/0299321, 2015/0232558, 2015/0150968, 2015/0071916, 2013/0266577, 2013/0230540, 2013/0109846, 2013/0078257, 2013/0078236, 2013/0058933, 2012/0201814, 2011/0097339, 2011/0059071, 2011/0009602, 2010/0266605, 2010/0028354, 2009/0246204, 2009/0117135, 2009/0117108, 2008/0095774, 2008/0038273, 2007/0154468, 2007/0134240, 2007/0122410, 2006/0188493, 2006/0165690, 2006/0039909, 2006/0009382, 2006/0008457, 2004/0116675, 2004/0092718, 2003/0170232, 2003/0086932, 2002/0006403, 2013/0197202, 2007/0065436, 2003/0180290, 2017/0015747, 2012/0100139, and 2007/0148162, each of which is incorporated by reference in its entirety (e.g., sections that described CD28 inhibitors).

Additional examples of CD28 inhibitors that are antibodies or antigen-binding fragments are known in the art.

CD28 Inhibitors-Fusion Proteins and Peptides

In some embodiments, the CD28 inhibitor is a fusion protein (see, e.g., U.S. Pat. No. 5,521,288; and US 2002/0018783). In some embodiments, the CD28 inhibitor is abatacept (Orencia®) (Herrero-Beaumont et al., *Rheumatol. Clin.* 8:78-83, 2012; and Korhonen and Moilanen *Basic Clin. Pharmacol. Toxicol.* 104 (4): 276-284, 2009).

In some embodiments, the CD28 inhibitor is a peptide mimetic (e.g., AB103) (see, e.g., Bulger et al., *JAMA Surg.* 149 (6): 528-536, 2014), or a synthetical peptoid (see, e.g., Li et al., *Cell Mol. Immunol.* 7 (2): 133-142, 2010).

CD49 Inhibitors

The term "CD49 inhibitors" refers to an agent which decreases the ability of CD49 to bind to one of its ligands (e.g., MMP1). In some embodiments, the CD49 inhibitor is an antibody or an antigen-binding fragment thereof. Exemplary CD49 inhibitors are described herein. Additional examples of CD49 inhibitors are known in the art.

Exemplary sequences for human CD49 and human MMP1 are shown below.

```
Human CD49
                                              (SEQ ID NO: 25)
MGPERTGAAP LPLLLVLALS QGILNCCLAY NVGLPEAKIF

SGPSSEQFGY AVQQFINPKG NWLLVGSPWS GFPENRMGDV

YKCPVDLSTA TCEKLNLQTS TSIPNVTEMK TNMSLGLILT

RNMGTGGFLT CGPLWAQQCG NQYYTTGVCS DISPDFQLSA

SFSPATQPCP SLIDVVVVCD ESNSIYPWDA VKNFLEKFVQ

GLDIGPTKTQ VGLIQYANNP RVVFNLNTYK TKEEMIVATS

QTSQYGGDLT NTFGAIQYAR KYAYSAASGG RRSATKVMVV

VTDGESHDGS MLKAVIDQCN HDNILRFGIA VLGYLNRNAL

DTKNLIKEIK AIASIPTERY FFNVSDEAAL LEKAGTLGEQ

IFSIEGTVQG GDNFQMEMSQ VGFSADYSSQ NDILMLGAVG
```

```
                    -continued
AFGWSGTIVQ KTSHGHLIFP KQAFDQILQD RNHSSYLGYS

VAAISTGEST HFVAGAPRAN YTGQIVLYSV NENGNITVIQ

AHRGDQIGSY FGSVLCSVDV DKDTITDVLL VGAPMYMSDL

KKEEGRVYLF TIKKGILGQH QFLEGPEGIE NTRFGSAIAA

LSDINMDGFN DVIVGSPLEN QNSGAVYIYN GHQGTIRTKY

SQKILGSDGA FRSHLQYFGR SLDGYGDLNG DSITDVSIGA

FGQVVQLWSQ SIADVAIEAS FTPEKITLVN KNAQIILKLC

FSAKFRPTKQ NNQVAIVYNI TLDADGFSSR VTSRGLFKEN

NERCLQKNMV VNQAQSCPEH IIYIQEPSDV VNSLDLRVDI

SLENPGTSPA LEAYSETAKV FSIPFHKDCG EDGLCISDLV

LDVRQIPAAQ EQPFIVSNQN KRLTFSVTLK NKRESAYNTG

IVVDFSENLF FASFSLPVDG TEVTCQVAAS QKSVACDVGY

PALKREQQVT FTINFDFNLQ NLQNQASLSF QALSESQEEN

KADNLVNLKI PLLYDAEIHL TRSTNINFYE ISSDGNVPSI

VHSFEDVGPK FIFSLKVTTG SVPVSMATVI IHIPQYTKEK

NPLMYLTGVQ TDKAGDISCN ADINPLKIGQ TSSSVSFKSE

NFRHTKELNC RTASCSNVTC WLKDVHMKGE YFVNVTTRIW

NGTFASSTFQ TVQLTAAAEI NTYNPEIYVI EDNTVTIPLM

IMKPDEKAEV PTGVIIGSII AGILLLLALV AILWKLGFFK

RKYEKMTKNP DEIDETTELS S

Human MMP1
                                    (SEQ ID NO: 26)
MHSFPPLLLL LFWGVVSHSF PATLETQEQD VDLVQKYLEK

YYNLKNDGRQ VEKRRNSGPV VEKLKQMQEF FGLKVTGKPD

AETLKVMKQP RCGVPDVAQF VLTEGNPRWE QTHLTYRIEN

YTPDLPRADV DHAIEKAFQL WSNVTPLTFT KVSEGQADIM

ISFVRGDHRD NSPFDGPGGN LAHAFQPGPG IGGDAHFDED

ERWTNNFREY NLHRVAAHEL GHSLGLSHST DIGALMYPSY

TFSGDVQLAQ DDIDGIQAIY GRSQNPVQPI GPQTPKACDS

KLTFDAITTI RGEVMFFKDR FYMRTNPFYP EVELNFISVF

WPQLPNGLEA AYEFADRDEV RFFKGNKYWA VQGQNVLHGY

PKDIYSSFGF PRTVKHIDAA LSEENTGKTY FFVANKYWRY

DEYKRSMDPG YPKMIAHDFP GIGHKVDAVF MKDGFFYFFH

GTRQYKFDPK TKRILTLQKA NSWFNCRKN
```

CD49 Inhibitors-Antibodies

In some embodiments, the CD49 inhibitor is an antibody or an antigen-binding fragment thereof (e.g., a Fab or a scFv).

In certain embodiments, the antibody comprises or consists of an antigen-binding fragment or portion of natalizumab (Tysabri®; Antegren®) (see, e.g., Pagnini et al., *Expert* Opin. Biol. Ther. 17 (11): 1433-1438, 2017; and Chataway and Miller *Neurotherapeutics* 10 (1): 19-28, 2013; or vatelizumab (ELND-004)).

Additional examples of CD49 inhibitors that are antibodies or antigen-binding fragments are known in the art.

CD89 Inhibitors

The term "CD89 inhibitors" refers to an agent which decreases the ability of CD89 to bind to IgA. CD89 is a transmembrane glycoprotein that binds to the heavy-chain constant region of IgA. In some embodiments, the CD89 inhibitor can decrease the binding between CD89 and IgA by blocking the ability of CD89 to interact with IgA. In some embodiments, the CD89 inhibitor is an antibody or an antigen-binding fragment thereof. Exemplary CD89 inhibitors are described herein. Additional examples of CD89 inhibitors are known in the art.

An exemplary sequence for human CD89 is shown below.

```
                                    Human CD89 (SEQ ID NO: 27)
MDPKQTTLLC LVLCLGQRIQ AQEGDFPMPF ISAKSSPVIP

LDGSVKIQCQ AIREAYLTQL MIIKNSTYRE IGRRLKFWNE

TDPEFVIDHM DANKAGRYQC QYRIGHYRFR YSDTLELVVT

GLYGKPFLSA DRGLVLMPGE NISLTCSSAH IPFDRFSLAK

EGELSLPQHQ SGEHPANFSL GPVDLNVSGI YRCYGWYNRS

PYLWSFPSNA LELVVTDSIH QDYTTQNLIR MAVAGLVLVA

LLAILVENWH SHTALNKEAS ADVAEPSWSQ QMCQPGLTFA RTPSVCK
```

CD89 Inhibitors-Antibodies

In some embodiments, the CD89 inhibitor is an antibody or an antigen-binding fragment thereof (e.g., a Fab or a scFv).

In certain embodiments, the antibody comprises or consists of an antigen-binding fragment or portion of HF-1020. Additional examples of CD89 antibodies are known in the art (see, e.g., WO 2002/064634).

Additional examples of CD89 inhibitors that are antibodies or antigen-binding fragments are known in the art.

In some embodiments, the immune modulatory agent is Bio8898 from Biogen.

In some embodiments, the immune modulatory agent is PRV-300, described in PCT publication WO-2006060513 incorporated by reference herein in its entirety. PRV-300 is an anti-Toll-Like Receptor 3 (TLR3)/CD283 monoclonal antibody.

In some embodiments, an immune modulator can decrease the activity and/or the level in a mammalian cell of its target receptor, such as TNF, IL-12/IL-23, IL-6R, JAK, a chemokine, IL-1, IL-10, CHST15, or TLR. In some embodiments, a immune modulator can decrease (e.g., by about 1% to about 99%, by about 1% to about 95%, by about 1% to about 90%, by about 1% to about 85%, by about 1% to about 80%, by about 1% to about 75%, by about 1% to about 70%, by about 1% to about 65%, by about 1% to about 60%, by about 1% to about 55%, by about 1% to about 50%, by about 1% to about 45%, by about 1% to about 40%, by about 1% to about 35%, by about 1% to about 30%, by about 1% to about 25%, by about 1% to about 20%, by about 1% to about 20%, by about 1% to about 15%, by about 1% to about 10%, by about 1% to about 5%, by about 5% to about 99%, by about 5% to about 90%, by about 5% to about 85%, by about 5% to about 80%, by about 5% to about 75%, by about 5% to about 70%, by about 5% to about 65%, by about 5% to about 60%, by about 5% to about 55%, by about 5% to about 50%, by about 5% to about 45%, by about 5% to about 40%, by about 5% to about 35%, by about 5% to about 30%, by about 5% to about 25%, by about 5% to about 20%, by about 5% to about 15%, by about 5% to about 10%, by about 10% to about 99%, about 10% to about 95%, about 10% to about 90%, about 10% to about 85%, by about 10% to about 80%, by about 10% to about 75%, by about 10% to about 70%, by about 10% to about 65%, by about 10% to about 60%, by about 10% to about 55%, by about 10% to about 50%, by about 10% to about 45%, by about 10% to about 40%, by about 10% to about 35%, by about 10% to about 30%, by about 10% to about 25%, by about 10% to about 20%, by about 10% to about 15%, by about 15% to about 99%, by about 15% to about 95%, by about 15% to about 90%, by about 15% to about 85%, by about 15% to about 80%, by about 15% to about 75%, by about 15% to about 70%, by about 15% to about 65%, by about 15% to about 60%, by about 15% to about 55%, by about 15% to about 50%, by about 15% to about 45%, by about 15% to about 40%, by about 15% to about 35%, by about 15% to about 30%, by about 15% to about 25%, by about 15% to about 20%, by about 20% to about 99%, by about 20% to about 95%, by about 20% to about 90%, by about 20% to about 85%, by about 20% to about 80%, by about 20% to about 75%, by about 20% to about 70%, by about 20% to about 65%, by about 20% to about 60%, by about 20% to about 55%, by about 20% to about 50%, by about 20% to about 45%, by about 20% to about 40%, by about 20% to about 35%, by about 20% to about 30%, by about 20% to about 25%, by about 25% to about 99%, about 25% to about 95%, by about 25% to about 90%, by about 25% to about 85%, by about 25% to about 80%, by about 25% to about 75%, by about 25% to about 70%, by about 25% to about 65%, by about 25% to about 60%, by about 25% to about 55%, by about 25% to about 50%, by about 25% to about 45%, by about 25% to about 40%, by about 25% to about 35%, by about 25% to about 30%, by about 30% to about 99%, by about 30% to about 95%, by about 30% to about 90%, by about 30% to about 85%, by about 30% to about 80%, by about 30% to about 75%, by about 30% to about 70%, by about 30% to about 65%, by about 30% to about 60%, by about 30% to about 55%, by about 30% to about 50%, by about 30% to about 45%, by about 30% to about 40%, by about 30% to about 35%, by about 35% to about 99%, by about 35% to about 95%, by about 35% to about 90%, by about 35% to about 85%, by about 35% to about 80%, by about 35% to about 75%, by about 35% to about 70%, by about 35% to about 65%, by about 35% to about 60%, by about 35% to about 55%, by about 35% to about 50%, by about 35% to about 45%, by about 35% to about 40%, by about 40% to about 99%, by about 40% to about 95%, by about 40% to about 90%, by about 40% to about 85%, by about 40% to about 80%, by about 40% to about 75%, by about 40% to about 70%, by about 40% to about 65%, by about 40% to about 60%, by about 40% to about 55%, by about 40% to about 50%, by about 40% to about 45%, by about 45% to about 99%, by about 45% to about 95%, by about 45% to about 90%, by about 45% to about 85%, by about 45% to about 80%, by about 45% to about 75%, by about 45% to about 70%, by about 45% to about 65%, by about 45% to about 60%, by about 45% to about 55%, by about 45% to about 50%, by about 50% to about 99%, by about 50% to about 95%, by about 50% to about 90%, by about 50% to about 85%, by about 50% to about 80%, by about 50% to about 75%, by about 50% to about 70%, by about 50% to about 65%, by about 50% to about 60%, by about 50% to about 55%, by about 55% to about 99%, by about 55% to about 95%, by about 55% to about 90%, by about 55% to about 85%, by about 55% to about 80%, by about 55% to about 75%, by about 55% to about 70%, by about 55% to about 65%, by about 55% to about 60%, by about 60% to about 99%, by about 60% to about 95%, by about 60% to about 90%, by about 60% to about 85%, by about 60% to about 80%, by about 60% to about 75%, by about 60% to about 70%, by about 60% to about 65%, by about 65% to about 99%, by about 65% to about 95%, by about 65% to about 90%, by about 65% to about 85%, by about 65% to about 80%, by about 65% to about 75%, by about 65% to about 70%, by about 70% to about 99%, by about 70% to about 95%, by about 70% to about 90%, by about 70% to about 85%, by about 70% to about 80%, by about 70% to about 75%, by about 75% to about 99%, by about 75% to about 95%, by about 75% to about 90%, by about 75% to about 85%, by about 75% to about 80%, by about 80% to about 99%, by about 80% to about 95%, by about 80% to about 90%, by about 80% to about 85%, by about 85% to about 99%, by about 85% to about 95%, by about 85% to about 90%, by about 90% to about 99%, by about 90% to about 95%, or by about 95% to about 99%) in the level of PDE4 protein in a mammalian cell contacted with the agent, e.g., as compared to the level of PDE4 protein in the same mammalian cell not contacted with the agent.

In some embodiments, a immune modulator can inhibit PDE4 activity with an $IC_{50}$ of about 1 pM to about 100 TM, about 1 pM to about 95 TM, about 1 pM to about 90 TM, about 1 pM to about 85 TM, about 1 pM to about 80 TM, about 1 pM to about 75 TM, about 1 pM to about 70 TM, about 1 pM to about 65 TM, about 1 pM to about 60 TM, about 1 pM to about 55 TM, about 1 pM to about 50 TM, about 1 pM to about 45 TM, about 1 pM to about 40 TM, about 1 pM to about 35 TM, about 1 pM to about 30 TM, about 1 pM to about 25 TM, about 1 pM to about 20 TM, about 1 pM to about 15 TM, about 1 pM to about 10 TM, about 1 pM to about 5 TM, about 1 pM to about 1 TM, about 1 pM to about 900 nM, about 1 pM to about 800 nM, about 1 pM to about 700 nM, about 1 pM to about 600 nM, about 1 pM to about 500 nM, about 1 pM to about 400 nM, about 1 pM to about 300 nM, about 1 pM to about 200 nM, about 1 pM to about 100 nM, about 1 pM to about 50 nM, about 1 pM to about 1 nM, about 1 pM to about 800 pM, about 1 pM to about 600 pM, about 1 pM to about 400 pM, about 1 pM to about 200 pM, about 200 pM to about 100 TM, about 200 pM to about 95 TM, about 200 pM to about 90 TM, about 200 pM to about 85 TM, about 200 pM to about 80 TM, about 200 pM to about 75 TM, about 200 pM to about 70 TM, about 200 pM to about 65 TM, about 200 pM to about 60 TM, about 200 pM to about 55 TM, about 200 pM to about 50 TM, about 200 pM to about 45 TM, about 200 pM to about 40 TM, about 200 PM to about 35 TM, about 200 pM to about 30 TM, about 200 pM to about 25 TM, about 200 pM to about 20 TM, about 200 pM to about 15 TM, about 200 pM to about 10 TM, about 200 pM to about 5 TM, about 200 pM to about 1 TM, about 200 pM to about 900 nM, about 200 pM to about 800 nM, about 200 pM to about 700 nM, about 200 pM to about 600 nM, about 200 pM to about 500 nM, about 200 pM to about 400 nM, about 200 pM to about 300 nM, about 200 pM to about 200 nM, about 200 pM to about 100 nM, about 200 pM to about 50 nM, about 200 pM to about 1 nM, about 200 pM to about 800 pM, about 200 pM to about 600 pM, about 200 pM to about 400 pM, about 400 pM to about 100 TM, about 400 pM to about 95 TM, about 400 pM to about 90 TM, about 400 pM to about 85 TM, about 400 pM to about 80 TM, about 400 PM to about 75 TM, about 400 pM to about 70 TM, about 400 PM to about 65 TM, about 400 PM to about 60 TM, about 400 pM to about 55 TM, about 400 pM to about 50 TM, about 400 PM to about 45 TM, about 400 pM to about 40 TM, about 400 pM to about 35 TM, about 400 pM to about 30 TM, about 400 pM to about 25 TM, about 400 PM to about 20 TM, about 400 PM to about 15 TM, about 400 pM to about 10 TM, about 400 pM to about 5 TM, about 400 pM to about 1 TM, about 400 pM to about 900 nM, about 400 pM to about 800 nM, about 400 pM to about 700 nM, about 400 pM to about 600 nM, about 400 pM to about 500 nM, about 400 pM to about 400 nM, about 400 pM to about 300 nM, about 400 pM to about 200 nM, about 400 pM to about 100 nM, about 400 pM to about 50 nM, about 400 pM to about 1 nM, about 400 PM to about 800 pM, 400 pM to about 600 pM, about 600 pM to about 100 TM, about 600 pM to about 95 TM, about 600 pM to about 90 TM, about 600 pM to about 85 TM, about 600 pM to about 80 TM, about 600 pM to about 75 TM, about 600 pM to about 70 TM, about 600 pM to about 65 TM, about 600 pM to about 60 TM, about 600 pM to about 55 TM, about 600 pM to about 50 TM, about 600 pM to about 45 TM, about 600 pM to about 40 TM, about 600 pM to about 35 TM, about 600 pM to about 30 TM, about 600 pM to about 25 TM, about 600 pM to about 20 TM, about 600 pM to about 15 TM, about 600 pM to about 10 TM, about 600 pM to about 5 TM, about 600 pM to about 1 TM, about 600 pM to about 900 nM, about 600 pM to about 800 nM, about 600 pM to about 700 nM, about 600 pM to about 600 nM, about 600 pM to about 500 nM, about 600 pM to about 400 nM, about 600 pM to about 300 nM, about 600 pM to about 200 nM, about 600 pM to about 100 nM, about 600 pM to about 50 nM, about 600 pM to about 1 nM, about 600 pM to about 800 pM, about 800 pM to about 100 TM, about 800 pM to about 95 TM, about 800 pM to about 90 TM, about 800 pM to about 85 TM, about 800 pM to about 80 TM, about 800 pM to about 75 TM, about 800 pM to about 70 TM, about 800 pM to about 65 TM, about 800 pM to about 60 TM, about 800 pM to about 55 TM, about 800 pM to about 50 TM, about 800 pM to about 45 TM, about 800 pM to about 40 TM, about 800 pM to about 35 TM, about 800 pM to about 30 TM, about 800 pM to about 25 TM, about 800 pM to about 20 TM, about 800 pM to about 15 TM, about 800 pM to about 10 TM, about 800 pM to about 5 TM, about 800 pM to about 1 TM, about 800 pM to about 900 nM, about 800 pM to about 800 nM, about 800 pM to about 700 nM, about 800 pM to about 600 nM, about 800 pM to about 500 nM, about 800 pM to about 400 nM, about 800 pM to about 300 nM, about 800 pM to about 200 nM, about 800 pM to about 100 nM, about 800 pM to about 50 nM, about 800 pM to about 1 nM, about 1 nM to about 100 TM, about 1 nM to about 95 TM, about 1 nM to about 90 TM, about 1 nM to about 85 TM, about 1 nM to about 80 TM, about 1 nM to about 75 TM, about 1 nM to about 70 TM, about 1 nM to about 65 TM, about 1 nM to about 60 TM, about 1 nM to about 55 TM, about 1 nM to about 50 TM, about 1 nM to about 45 TM, about 1 nM to about 40 TM, about 1 nM to about 35 TM, about 1 nM to about 30 TM, about 1 nM to about 25 TM, about 1 nM to about 20 TM, about 1 nM to about 15 TM, about 1 nM to about 10 TM, about 1 nM to about 5 TM, about 1 nM to about 1 TM, about 1 nM to about 900 nM, about 1 nM to about 800 nM, about 1 nM to about 700 nM, about 1 nM to about 600 nM, about 1 nM to about 500 nM, about 1 nM to about 400 nM, about 1 nM to about 300 nM, about 1 nM to about 200 nM, about 1 nM to about 100 nM, about 1 nM to about 50 nM, about 50 nM to about 100 TM, about 50 nM to about 95 TM, about 50 nM to about 90 TM, about 50 nM to about 85 TM, about 50 nM to about 80 TM, about 50 nM to about 75 TM, about 50 nM to about 70 TM, about 50 nM to about 65 TM, about 50 nM to about 60 TM, about 50 nM to about 55 TM, about 50 nM to about 50 TM, about 50 nM to about 45 TM, about 50 nM to about 40 TM, about 50 nM to about 35 TM, about 50 nM to about 30 TM, about 50 nM to about 25 TM, about 50 nM to about 20 TM, about 50 nM to about 15 TM, about 50 nM to about 10 TM, about 50 nM to about 5 TM, about 50 nM to about 1 TM, about 50 nM to about 900 nM, about 50 nM to about 800 nM, about 50 nM to about 700 nM, about 50 nM to about 600 nM, about 50 nM to about 500 nM, about 50 nM to about 400 nM, about 50 nM to about 300 nM, about 50 nM to about 200 nM, about 50 nM to about 100 nM, about 100 nM to about 100 TM, about 100 nM to about 95 TM, about 100 nM to about 90 TM, about 100 nM to about 85 TM, about 100 nM to about 80 TM, about 100 nM to about 75 TM, about 100 nM to about 70 TM, about 100 nM to about 65 TM, about 100 nM to about 60 TM, about 100 nM to about 55 TM, about 100 nM to about 50 TM, about 100 nM to about 45 TM, about 100 nM to about 40 TM, about 100 nM to about 35 TM, about 100 nM to about 30 TM, about 100 nM to about 25 TM, about 100 nM to about 20 TM, about 100 nM to about 15 TM, about 100 nM to about 10 TM, about 100 nM to about 5 TM, about 100 nM to about 1 TM, about 100 nM to about 900 nM, about 100 n.M to about 800 nM, about 100 nM to about 700 nM, about 100 nM to about 600 nM, about 100 nM to about 500 nM, about 100 nM to about 400 nM, about 100 nM to about 300 nM, about 100 nM to about 200 nM, about 200 nM to about 100 TM, about 200 nM to about 95 TM, about 200 nM to about 90 TM, about 200 nM to about 85 TM, about 200 nM to about 80 TM, about 200 nM to about 75 TM, about 200 nM to about 70 TM, about 200 nM to about 65 TM, about 200 nM to about 60 TM, about 200 nM to about 55 TM, about 200 nM to about 50 TM, about 200 nM to about 45 TM, about 200 nM to about 40 TM, about 200 nM to about 35 TM, about 200 nM to about 30 TM, about 200 nM to about 25 TM, about 200 nM to about 20 TM, about 200 nM to about 15 TM, about 200 nM to about 10 TM, about 200 nM to about 5 TM, about 200 nM to about 1 TM, about 200 nM to about 900 nM, about 200 nM to about 800 nM, about 200 nM to about 700 nM, about 200 nM to about 600 nM, about 200 nM to about 500 nM, about 200 nM to about 400 nM, about 200 nM to about 300 nM, about 300 nM to about 100 TM, about 300 nM to about 95 TM, about 300 nM to about 90 TM, about 300 nM to about 85 TM, about 300 nM to about 80 TM, about 300 nM to about 75 TM, about 300 nM to about 70 TM, about 300 nM to about 65 TM, about 300 nM to about 60 TM, about 300 nM to about 55 TM, about 300 nM to about 50 TM, about 300 nM to about 45 TM, about 300 nM to about 40 TM, about 300 nM to about 35 TM, about 300 nM to about 30 TM, about 300 nM to about 25 TM, about 300 nM to about 20 TM, about 300 nM to about 15 TM, about 300 nM to about 10 TM, about 300 nM to about 5 TM, about 300 nM to about 1 TM, about 300 nM to about 900 nM, about 300 nM to about 800 nM, about 300 nM to about 700 nM, about 300 nM to about 600 nM, about 300 nM to about 500 nM, about 300 nM to about 400 nM, about 400 nM to about 100 TM, about 400 nM to about 95 TM, about 400 nM to about 90 TM, about 400 nM to about 85 TM, about 400 nM to about 80 TM, about 400 nM to about 75 TM, about 400 nM to about 70 TM, about 400 nM to about 65 TM, about 400 nM to about 60 TM, about 400 nM to about 55 TM, about 400 nM to about 50 TM, about 400 nM to about 45 TM, about 400 nM to about 40 TM, about 400 nM to about 35 TM, about 400 nM to about 30 TM, about 400 nM to about 25 TM, about 400 nM to about 20 TM, about 400 nM to about 15 TM, about 400 nM to about 10 TM, about 400 nM to about 5 TM, about 400 nM to about 1 TM, about 400 nM to about 900 nM, about 400 nM to about 800 nM, about 400 nM to about 700 nM, 400 nM to about 600 nM, about 400 nM to about 500 nM, about 500 nM to about 100 TM, about 500 nM to about 95

TM, about 500 nM to about 90 TM, about 500 nM to about 85 TM, about 500 nM to about 80 TM, about 500 nM to about 75 TM, about 500 nM to about 70 TM, about 500 nM to about 65 TM, about 500 nM to about 60 TM, about 500 nM to about 55 TM, about 500 nM to about 50 TM, about 500 nM to about 45 TM, about 500 nM to about 40 TM, about 500 nM to about 35 TM, about 500 nM to about 30 TM, about 500 nM to about 25 TM, about 500 nM to about 20 TM, about 500 nM to about 15 TM, about 500 nM to about 10 TM, about 500 nM to about 5 TM, about 500 nM to about 1 TM, about 500 nM to about 900 nM, about 500 nM to about 800 nM, about 500 nM to about 700 nM, about 500 nM to about 600 nM, about 600 nM to about 100 TM, about 600 nM to about 95 TM, about 600 nM to about 90 TM, about 600 nM to about 85 TM, about 600 nM to about 80 TM, about 600 nM to about 75 TM, about 600 nM to about 70 TM, about 600 nM to about 65 TM, about 600 nM to about 60 TM, about 600 nM to about 55 TM, about 600 nM to about 50 TM, about 600 nM to about 45 TM, about 600 nM to about 40 TM, about 600 nM to about 35 TM, about 600 nM to about 30 TM, about 600 nM to about 25 TM, about 600 nM to about 20 TM, about 600 nM to about 15 TM, about 600 nM to about 10 TM, about 600 nM to about 5 TM, about 600 nM to about 1 TM, about 600 nM to about 900 nM, about 600 nM to about 800 nM, about 600 nM to about 700 nM, about 700 nM to about 100 TM, about 700 nM to about 95 TM, about 700 nM to about 90 TM, about 700 nM to about 85 TM, about 700 nM to about 80 TM, about 700 nM to about 75 TM, about 700 nM to about 70 TM, about 700 nM to about 65 TM, about 700 nM to about 60 TM, about 700 nM to about 55 TM, about 700 nM to about 50 TM, about 700 nM to about 45 TM, about 700 nM to about 40 TM, about 700 nM to about 35 TM, about 700 nM to about 30 TM, about 700 nM to about 25 TM, about 700 nM to about 20 TM, about 700 nM to about 15 TM, about 700 nM to about 10 TM, about 700 nM to about 5 TM, about 700 nM to about 1 TM, about 700 nM to about 900 nM, about 700 nM to about 800 nM, about 800 nM to about 100 TM, about 800 nM to about 95 TM, about 800 nM to about 90 TM, about 800 nM to about 85 TM, about 800 nM to about 80 TM, about 800 nM to about 75 TM, about 800 nM to about 70 TM, about 800 nM to about 65 TM, about 800 nM to about 60 TM, about 800 nM to about 55 TM, about 800 nM to about 50 TM, about 800 nM to about 45 TM, about 800 nM to about 40 TM, about 800 nM to about 35 TM, about 800 nM to about 30 TM, about 800 nM to about 25 TM, about 800 nM to about 20 TM, about 800 nM to about 15 TM, about 800 nM to about 10 TM, about 800 nM to about 5 TM, about 800 nM to about 1 TM, about 800 nM to about 900 nM, about 900 nM to about 100 TM, about 900 nM to about 95 TM, about 900 nM to about 90 TM, about 900 nM to about 85 TM, about 900 nM to about 80 TM, about 900 nM to about 75 TM, about 900 nM to about 70 TM, about 900 nM to about 65 TM, about 900 nM to about 60 TM, about 900 nM to about 55 TM, about 900 nM to about 50 TM, about 900 nM to about 45 TM, about 900 nM to about 40 TM, about 900 nM to about 35 TM, about 900 nM to about 30 TM, about 900 nM to about 25 TM, about 900 nM to about 20 TM, about 900 nM to about 15 TM, about 900 nM to about 10 TM, about 900 nM to about 5 TM, about 900 nM to about 1 TM, about 1 TM to about 100 TM, about 1 TM to about 95 TM, about 1 TM to about 90 TM, about 1 TM to about 85 TM, about 1 TM to about 80 TM, about 1 TM to about 75 TM, about 1 TM to about 70 TM, about 1 TM to about 65 TM, about 1 TM to about 60 TM, about 1 TM to about 55 TM, about 1 TM to about 50 TM, about 1 TM to about 45 TM, about 1 TM to about 40 TM, about 1 TM to about 35 TM, about 1 TM to about 30 TM, about 1 TM to about 25 TM, about 1 TM to about 20 TM, about 1 TM to about 15 TM, about 1 TM to about 10 TM, about 1 TM to about 5 TM, about 5 TM to about 100 TM, about 5 TM to about 95 TM, about 5 TM to about 90 TM, about 5 TM to about 85 TM, about 5 TM to about 80 TM, about 5 TM to about 75 TM, about 5 TM to about 70 TM, about 5 TM to about 65 TM, about 5 TM to about 60 TM, about 5 TM to about 55 TM, about 5 TM to about 50 TM, about 5 TM to about 45 TM, about 5 TM to about 40 TM, about 5 TM to about 35 TM, about 5 TM to about 30 TM, about 5 TM to about 25 TM, about 5 TM to about 20 TM, about 5 TM to about 15 TM, about 5 TM to about 10 TM, about 10 TM to about 100 TM, about 10 TM to about 95 TM, about 10 TM to about 90 TM, about 10 TM to about 85 TM, about 10 TM to about 80 TM, about 10 TM to about 75 TM, about 10 TM to about 70 TM, about 10 TM to about 65 TM, about 10 TM to about 60 TM, about 10 TM to about 55 TM, about 10 TM to about 50 TM, about 10 TM to about 45 TM, about 10 TM to about 40 TM, about 10 TM to about 35 TM, about 10 TM to about 30 TM, about 10 TM to about 25 TM, about 10 TM to about 20 TM, about 10 TM to about 15 TM, about 15 TM to about 100 TM, about 15 TM to about 95 TM, about 15 TM to about 90 TM, about 15 TM to about 85 TM, about 15 TM to about 80 TM, about 15 TM to about 75 TM, about 15 TM to about 70 TM, about 15 TM to about 65 TM, about 15 TM to about 60 TM, about 15 TM to about 55 TM, about 15 TM to about 50 TM, about 15 TM to about 45 TM, about 15 TM to about 40 TM, about 15 TM to about 35 TM, about 15 TM to about 30 TM, about 15 TM to about 25 TM, about 15 TM to about 20 TM, about 20 TM to about 100 TM, about 20 TM to about 95 TM, about 20 TM to about 90 TM, about 20 TM to about 85 TM, about 20 TM to about 80 TM, about 20 TM to about 75 TM, about 20 TM to about 70 TM, about 20 TM to about 65 TM, about 20 TM to about 60 TM, about 20 TM to about 55 TM, about 20 TM to about 50 TM, about 20 TM to about 45 TM, about 20 TM to about 40 TM, about 20 TM to about 35 TM, about 20 TM to about 30 TM, about 20 TM to about 25 TM, about 25 TM to about 100 TM, about 25 TM to about 95 TM, about 25 TM to about 90 TM, about 25 TM to about 85 TM, about 25 TM to about 80 TM, about 25 TM to about 75 TM, about 25 TM to about 70 TM, about 25 TM to about 65 TM, about 25 TM to about 60 TM, about 25 TM to about 55 TM, about 25 TM to about 50 TM, about 25 TM to about 45 TM, about 25 TM to about 40 TM, about 25 TM to about 35 TM, about 25 TM to about 30 TM, about 30 TM to about 100 TM, about 30 TM to about 95 TM, about 30 TM to about 90 TM, about 30 TM to about 85 TM, about 30 TM to about 80 TM, about 30 TM to about 75 TM, about 30 TM to about 70 TM, about 30 TM to about 65 TM, about 30 TM to about 60 TM, about 30 TM to about 55 TM, about 30 TM to about 50 TM, about 30 TM to about 45 TM, about 30 TM to about 40 TM, about 30 TM to about 35 TM, about 35 TM to about 100 TM, about 35 TM to about 95 TM, about 35 TM to about 90 TM, about 35 TM to about 85 TM, about 35 TM to about 80 TM, about 35 TM to about 75 TM, about 35 TM to about 70 TM, about 35 TM to about 65 TM, about 35 TM to about 60 TM, about 35 TM to about 55 TM, about 35 TM to about 50 TM, about 35 TM to about 45 TM, about 35 TM to about 40 TM, about 40 TM to about 100 TM, about 40 TM to about 95 TM, about 40 TM to about 90 TM, about 40 TM to about 85 TM, about 40 TM to about 80 TM, about 40 TM to about 75 TM, about 40 TM to about 70 TM, about 40 TM to about 65 TM, about 40 TM to about 60 TM, about 40 TM to about 55 TM, about 40 TM to about 50 TM, about 40 TM to about 45 TM, about 45 TM to about 100 TM, about 45 TM to about 95 TM, about 45 TM to about 90 TM, about 45 TM to about 85 TM, about 45 TM to about 80 TM, about 45 TM to about 75 TM, about 45 TM to about 70 TM, about 45 TM to about 65 TM, about 45 TM to about 60 TM, about 45 TM to about 55 TM, about 45 TM to about 50 TM, about 50 TM to about 100 TM, about 50 TM to about 95 TM, about 50 TM to about 90 TM, about 50 TM to about 85 TM, about 50 TM to about 80 TM, about 50 TM to about 75 TM, about 50 TM to about 70 TM, about 50 TM to about 65 TM, about 50 TM to about 60 TM, about 50 TM to about 55 TM, about 55 TM to about 100 TM, about 55 TM to about 95 TM, about 55 TM to about 90 TM, about 55 TM to about 85 TM, about 55 TM to about 80 TM, about 55 TM to about 75 TM, about 55 TM to about 70 TM, about 55 TM to about 65 TM, about 55 TM to about 60 TM, about 60 TM to about 100 TM, about 60 TM to about 95 TM, about 60 TM to about 90 TM, about 60 TM to about 85 TM, about 60 TM to about 80 TM, about 60 TM to about 75 TM, about 60 TM to about 70 TM, about 60 TM to about 65 TM, about 65 TM to about 100 TM, about 65 TM to about 95 TM, about 65 TM to about 90 TM, about 65 TM to about 85 TM, about 65 TM to about 80 TM, about 65 TM to about 75 TM, about 70 TM to about 100 TM, about 70 TM to about 95 TM, about 70 TM to about 90 TM, about 70 TM to about 85 TM, about 70 TM to about 80 TM, about 75 TM to about 100 TM, about 75 TM to about 95 TM, about 75 TM to about 90 TM, about 75 TM to about 80 TM, about 80 TM to about 100 TM, about 80 TM to about 95 TM, about 80 TM to about 90 TM, about 80 TM to about 85 TM, about 85 TM to about 95 TM, about 85 TM to about 90 TM, about 90 TM to about 100 TM, about 90 TM to about 95 TM, or about 95 TM to about 100 TM.

IL-12/IL-23 Inhibitors

The term "IL-12/IL-23 inhibitors" refers to an agent which decreases IL-12 or IL-23 expression and/or the ability of IL-12 to bind to an IL-12 receptor or the ability of IL-23 to bind to an IL-23 receptor. IL-12 is a heterodimeric cytokine that includes both IL-12A (p35) and IL-12B (p40) polypeptides. IL-23 is a heterodimeric cytokine that includes both IL-23 (p19) and IL-12B (p40) polypeptides. The receptor for IL-12 is a heterodimeric receptor includes IL-12R β1 and IL-12R β2. The receptor for IL-23 receptor is a heterodimeric receptor that includes both IL-12R β1 and IL-23R.

In some embodiments, the IL-12/IL-23 inhibitor can decrease the binding of IL-12 to the receptor for IL-12. In some embodiments, the IL-12/IL-23 inhibitor can decrease the binding of IL-23 to the receptor for IL-23. In some embodiments, the IL-12/IL-23 inhibitor decreases the expression of IL-12 or IL-23. In some embodiments, the IL-12/IL-23 inhibitor decreases the expression of a receptor for IL-12. In some embodiments, the IL-12/IL-23 inhibitor decreases the expression of a receptor for IL-23.

In some embodiments, the IL-12/IL-23 inhibitory agent targets IL-12B (p40) subunit. In some embodiments, the IL-12/IL-23 inhibitory agent targets IL-12A (p35). In some embodiments, the IL-12/IL-23 inhibitory agent targets IL-23 (p19). In some embodiments, the IL-12/IL-23 inhibitory agent targets the receptor for IL-12 (one or both of IL-12R β1 or IL-12R β2). In some embodiments, the IL-12/IL-23 inhibitory agent targets the receptor for IL-23 (one or both of IL-12R β1 and IL-23R).

Inhibitory Nucleic Acids

In some embodiments, an IL-12/IL-23 inhibitor can be an inhibitory nucleic acid. In some embodiments, the inhibitory nucleic acid can be an antisense nucleic acid, a ribozyme, and a small interfering RNA (siRNA). Examples of aspects of these different oligonucleotides are described below. Any of the examples of inhibitory nucleic acids that can decrease expression of IL-12A (p35), IL-12B (p40), IL-23 (p19), IL-12R β1, IL-12R 2, or IL-23R mRNA in a mammalian cell can be synthesized in vitro.

Inhibitory nucleic acids that can decrease the expression of IL-12A (p35), IL-12B (p40), IL-23 (p19), IL-12R β1, IL-12R β2, or IL-23R mRNA expression in a mammalian cell include antisense nucleic acid molecules, i.e., nucleic acid molecules whose nucleotide sequence is complementary to all or part of an IL-12A (p35), IL-12B (p40), IL-23 (p19), IL-12R β1, IL-12R β2, or IL-23R mRNA (e.g., complementary to all or a part of any one of SEQ ID NOs: 1-12).

```
Human IL-12A (p35) mRNA
                                                           (SEQ ID NO: 1)
   1 tttcgctttc attttgggcc gagctggagg cggcggggcc gtcccggaac ggctgcggcc 61 gggcacccccg ggagttaatc cgaaagcgcc gcaagccccg cgggccggcc gcaccgcacg 121 tgtcaccgag aagctgatgt agagagagac acagaaggag acagaaagca agagaccaga 181 gtcccgggaa agtcctgccg cgcctcggga caattataaa aatgtggccc cctgggtcag 241 cctcccagcc accgccctca cctgccgcgg ccacaggtct gcatccagcg gctcgccctg 301 tgtccctgca gtgccggctc agcatgtgtc cagcgcgcag cctcctcctt gtggctaccc 361 tggtcctcct ggaccacctc agtttggcca gaaacctccc cgtggccact ccagacccag 421 gaatgttccc atgccttcac cactcccaaa acctgctgag ggccgtcagc aacatgctcc 481 agaaggccag acaaactcta gaattttacc cttgcacttc tgaagagatt gatcatgaag 541 atatcacaaa agataaaacc agcacagtgg aggcctgttt accattggaa ttaaccaaga 601 atgagagttg cctaaattcc agagagacct ctttcataac taatgggagt tgcctggcct 661 ccagaaagac ctctttttatg atggccctgt gccttagtag tatttatgaa gacttgaaga 721 tgtaccaggt ggagttcaag accatgaatg caaagcttct gatggatcct aagaggcaga 781 tctttctaga tcaaaacatg ctggcagtta ttgatgagct gatgcaggcc ctgaatttca
```

-continued

```
 841 acagtgagac tgtgccacaa aaatcctccc ttgaagaacc ggatttttat aaaactaaaa
 901 tcaagctctg catacttctt catgctttca gaattcgggc agtgactatt gatagagtga
 961 tgagctatct gaatgcttcc taaaaagcga ggtccctcca accgttgtc attttttataa
1021 aactttgaaa tgaggaaact ttgataggat gtggattaag aactagggag ggggaaagaa
1081 ggatgggact attacatcca catgatacct ctgatcaagt attttttgaca tttactgtgg
1141 ataaattgtt tttaagtttt catgaatgaa ttgctaagaa gggaaaatat ccatcctgaa
1201 ggtgtttttc attcactta atagaagggc aaatatttat aagctatttc tgtaccaaag
1261 tgtttgtgga aacaaacatg taagcataac ttattttaaa atatttattt ataaacttg
1321 gtaatcatga aagcatctga gctaacttat atttatttat gttatattta ttaaattatt
1381 tatcaagtgt atttgaaaaa tattttttaag tgttctaaaa ataaaagtat tgaattaaag
1441 tgaaaaaaaa
```

Human IL-12B (p40) mRNA
(SEQ ID NO: 2)

```
   1 ctgtttcagg gccattggac tctccgtcct gcccagagca agatgtgtca ccagcagttg
  61 gtcatctctt ggttttccct ggttttttctg catctccccc tcgtggccat atgggaactg
 121 aagaaagatg tttatgtcgt agaattggat tggtatccgg atgcccctgg agaaatggtg
 181 gtcctcacct gtgacacccc tgaagaagat ggtatcacct ggaccttgga ccagagcagt
 241 gaggtcttag gctctggcaa acccctgacc atccaagtca aagagtttgg agatgctggc
 301 cagtacacct gtcacaaagg aggcgaggtt ctaagccatt cgctcctgct gcttcacaaa
 361 aaggaagatg gaatttggtc cactgatatt ttaaaggacc agaaagaacc caaaaataag
 421 acctttctaa gatgcgaggc caagaattat tctggacgtt tcacctgctg gtggctgacg
 481 acaatcagta ctgatttgac attcagtgtc aaaagcagca gaggctcttc tgaccccaa
 541 ggggtgacgt gcggagctgc tacactctct gcagagagag tcagagggga caacaaggag
 601 tatgagtact cagtggagtg ccaggaggac agtgcctgcc cagctgctga ggagagtctg
 661 cccattgagg tcatggtgga tgccgttcac aagctcaagt atgaaaacta caccagcagc
 721 ttattcatca gggacatcat caaacctgac ccacccaaga acttgcagct gaagccatta
 781 aagaattctc ggcaggtgga ggtcagctgg gagtaccctg acacctggag tactccacat
 841 tcctacttct ccctgacatt ctgcgttcag gtccagggca gagcaagag agaaaagaaa
 901 gatagagtct tcacggacaa gacctcagcc acggtcatct gccgcaaaaa tgccagcatt
 961 agcgtgcggg cccaggaccg ctactatagc tcatcttgga gcgaatgggc atctgtgccc
1021 tgcagttagg ttctgatcca ggatgaaaat ttggaggaaa agtggaagat attaagcaaa
1081 atgtttaaag acacaacgga atagacccaa aaagataatt tctatctgat ttgctttaaa
1141 acgttttttt aggatcacaa tgatatcttt gctgtatttg tatagttaga tgctaaatgc
1201 tcattgaaac aatcagctaa tttatgtata gattttccag ctctcaagtt gccatgggcc
1261 ttcatgctat ttaaatattt aagtaattta tgtatttatt agtatattac tgttatttaa
1321 cgtttgtctg ccaggatgta tggaatgttt catactctta tgacctgatc catcaggatc
1381 agtccctatt atgcaaaatg tgaatttaat tttatttgta ctgacaactt ttcaagcaag
1441 gctgcaagta catcagtttt atgacaatca ggaagaatgc agtgttctga taccagtgcc
1501 atcatacact tgtgatggat gggaacgcaa gagatactta catggaaacc tgacaatgca
1561 aacctgttga gaagatccag gagaacaaga tgctagttcc catgtctgtg aagacttcct
1621 ggagatggtg ttgataaagc aatttagggc cacttacact tctaagcaag tttaatcttt
```

-continued
```
1681 ggatgcctga attttaaaag ggctagaaaa aaatgattga ccagcctggg aaacataaca 1741 agaccccgtc tctacaaaaa aaatttaaaa ttagccaggc gtggtggctc atgcttgtgg 1801 tcccagctgt tcaggaggat gaggcaggag gatctcttga gcccaggagg tcaaggctat 1861 ggtgagccgt gattgtgcca ctgcatacca gcctaggtga cagaatgaga ccctgtctca 1921 aaaaaaaaaa tgattgaaat taaaattcag ctttagcttc catggcagtc ctcaccccca 1981 cctctctaaa agacacagga ggatgacaca gaaacaccgt aagtgtctgg aaggcaaaaa 2041 gatcttaaga ttcaagagag aggacaagta gttatggcta aggacatgaa attgtcagaa 2101 tggcaggtgg cttcttaaca gccctgtgag aagcagacag atgcaaagaa aatctggaat 2161 ccctttctca ttagcatgaa tgaacctgat acacaattat gaccagaaaa tatggctcca 2221 tgaaggtgct acttttaagt aatgtatgtg cgctctgtaa agtgattaca tttgtttcct 2281 gtttgtttat ttatttattt attttgcat tctgaggctg aactaataaa aactcttat 2341 tgtaatc
```
Human IL-23 (p19) mRNA
(SEQ ID NO: 3)
```
  1 aaaacaacag gaagcagctt acaaactcgg tgaacaactg agggaaccaa accagagacg 61 cgctgaacag agagaatcag gctcaaagca agtggaagtg ggcagagatt ccaccaggac 121 tggtgcaagg cgcagagcca gccagatttg agaagaaggc aaaaagatgc tggggagcag 181 agctgtaatg ctgctgtttg tgctgcccty gacagctcag ggcagagctg tgcctggggg 241 cagcagccct gcctggactc agtgccagca gctttcacag aagctctgca cactggcctg 301 gagtgcacat ccactagtgg gacacatgga tctaagagaa gagggagatg aagagactac 361 aaatgatgtt ccccatatcc agtgtggaga tggctgtgac ccccaaggac tcagggacaa 421 cagtcagttc tgcttgcaaa ggatccacca gggtctgatt ttttatgaga gctgctagg 481 atcggatatt ttcacagggg agccttctct gctccctgat agccctgtgg gccagcttca 541 tgcctcccta ctgggcctca gccaactcct gcagcctgag gtcaccact gggagactca 601 gcagattcca agcctcagtc ccagccagcc atggcagcgt tccttctcc gcttcaaaat 661 ccttcgcagc ctccaggcct tgtggctgt agccgcccgg tctttgccc atggagcagc 721 aaccctgagt ccctaaaggc agcagctcaa ggatggcact cagatctcca tggcccagca 781 aggccaagat aaatctacca ccccaggcac ctgtgagcca acaggttaat tagtccatta 841 attttagtgg gacctgcata tgttgaaaat taccaatact gactgacatg tgatgctgac 901 ctatgataag gttgagtatt tattagatgg gaagggaaat ttggggatta tttatcctcc 961 tggggacagt ttggggagga ttatttattg tatttatatt gaattatgta ctttttttcaa 1021 taaagtctta ttttttgtggc taaaaaaaa
```
Human IL-12R β1 mRNA Variant 1
(SEQ ID NO: 4)
```
  1 cttttttcact ttgacttgcc ttagggatgg gctgtgacac ttttacttttt ttcttttttc 61 ttttttttca gtcttttctc cttgctcagc ttcaatgtgt tccggagtgg ggacggggtg 121 gctgaacctc gcaggtggca gagaggctcc cctggggctg tggggctcta cgtggatccg 181 atggagccgc tggtgacctg ggtggtcccc ctcctcttcc tcttcctgct gtccaggcag 241 ggcgctgcct gcagaaccag tgagtgctgt tttcaggacc cgccatatcc ggatgcagac 301 tcaggctcgg cctcgggccc tagggacctg agatgctatc ggatatccag tgatcgttac 361 gagtgctcct ggcagtatga gggtcccaca gctggggtca gccacttcct gcggtgttgc 421 cttagctccg ggcgctgctg ctacttcgcc gccggctcag ccaccaggct gcagttctcc 481 gaccaggctg gggtgtctgt gctgtacact gtcacactct gggtggaatc ctgggccagg
```

-continued

```
 541 aaccagacag agaagtctcc tgaggtgacc ctgcagctct acaactcagt taaatatgag
 601 cctcctctgg gagacatcaa ggtgtccaag ttggccgggc agctgcgtat ggagtgggag
 661 accccggata accaggttgg tgctgaggtg cagttccggc accggacacc cagcagccca
 721 tggaagttgg gcgactgcgg acctcaggat gatgatactg agtcctgcct ctgcccctg
 781 gagatgaatg tggcccagga attccagctc cgacgacggc agctggggag ccaaggaagt
 841 tcctggagca agtggagcag ccccgtgtgc gttccccctg aaaaccccc acagcctcag
 901 gtgagattct cggtggagca gctgggccag gatgggagga ggcggctgac cctgaaagag
 961 cagccaaccc agctggagct tccagaaggc tgtcaagggc tggcgcctgg cacggaggtc
1021 acttaccgac tacagctcca catgctgtcc tgcccgtgta aggccaaggc caccaggacc
1081 ctgcacctgg ggaagatgcc ctatctctcg ggtgctgcct acaacgtggc tgtcatctcc
1141 tcgaaccaat tggtcctggg cctgaaccag acgtggcaca ttcctgccga cacccacaca
1201 gaaccagtgg ctctgaatat cagcgtcgga accaacggga ccaccatgta ttggccagcc
1261 cgggctcaga gcatgacgta ttgcattgaa tggcagcctg tgggccagga cgggggcctt
1321 gccacctgca gcctgactgc gccgcaagac ccggatccgg ctggaatggc aacctacagc
1381 tggagtcgag agtctggggc aatggggcag gaaaagtgtt actacattac catctttgcc
1441 tctgcgcacc ccgagaagct caccttgtgg tctacggtcc tgtccaccta ccactttggg
1501 ggcaatgcct cagcagctgg gacaccgcac cacgtctcgg tgaagaatca tagcttggac
1561 tctgtgtctg tggactgggc accatccctg ctgagcacct gtcccggcgt cctaaaggag
1621 tatgttgtcc gctgccgaga tgaagacagc aaacaggtgt cagagcatcc cgtgcagccc
1681 acagagaccc aagttaccct cagtggcctg cgggctggtg tagcctacac ggtgcaggtg
1741 cgagcagaca cagcgtggct gaggggtgtc tggagccagc ccagcgcttt cagcatcgaa
1801 gtgcaggttt ctgattggct catcttcttc gcctccctgg ggagcttcct gagcatcctt
1861 ctcgtgggcg tccttggcta ccttggcctg aacagggccg cacggcacct gtgcccgccg
1921 ctgcccacac cctgtgccag ctccgccatt gagttccctg gagggaagga gacttggcag
1981 tggatcaacc cagtggactt ccaggaagag gcatccctgc aggaggccct ggtggtagag
2041 atgtcctggg acaaaggcga gaggactgag cctctcgaga agacagagct acctgagggt
2101 gcccctgagc tggccctgga tacagagttg tccttggagg atggagacag gtgcaaggcc
2161 aagatgtgat cgttgaggct cagagagggt gagtgactcg cccgaggcta cgtagcacac
2221 acaggagtca catttggacc caaataaccc agagctcctc caggctccag tgcacctgcc
2281 tcctctctgc cccgtgcctg ttgccaccca tcctgcgggg aaccctaga tgctgccatg
2341 aaatggaagc tgctgcaccc tgctgggcct ggcatccgtg gggcaggagc agaccctgcc
2401 atttacctgt tctggcgtag aatggactgg gaatggggc aaggggggct cagatggatc
2461 cctggaccct gggctgggca tccacccca ggagcactgg atggggagtc tggactcaag
2521 ggctccctgc agcattgcgg ggtcttgtag cttggaggat ccaggcatat agggaagggg
2581 gctgtaaact ttgtgggaaa aatgacggtc ctcccatccc accccccacc ccaccctcac
2641 ccccctataa aatgggggtg gtgataatga ccttacacag ctgttcaaaa tcatcgtaaa
2701 tgagcctcct cttgggtatt ttttcctgt ttgaagcttg aatgtcctgc tcaaaatctc
2761 aaaacacgag ccttggaatt caaaaaaaaa aaaaaaaaa
```

-continued

Human IL-12R β1 mRNA Variant 2
(SEQ ID NO: 5)

```
   1 ctctttcact tgacttgcc ttagggatgg gctgtgacac tttacttttt ttattttttc
  61 ttttttttca gtcttttctc cttgctcagc ttcaatgtgt tccggagtgg ggacggggtg
 121 gctgaacctc gcaggtggca gagaggctcc cctggggctg tggggctcta cgtggatccg
 181 atggagccgc tggtgacctg ggtggtcccc ctcctcttcc tcttcctgct gtccaggcag
 241 ggcgctgcct gcagaaccag tgagtgctgt tttcaggacc cgccatatcc ggatgcagac
 301 tcaggctcgg cctcgggccc tagggacctg agatgctatc ggatatccag tgatcgttac
 361 gagtgctcct ggcagtatga gggtcccaca gctggggtca gccacttcct gcgtgttgc
 421 cttagctccg gcgctgctg ctacttcgcc gccggctcag ccaccaggct gcagttctcc
 481 gaccaggctg gggtgtctgt gctgtacact gtcacactct gggtggaatc ctgggccagg
 541 aaccagacag agaagtctcc tgaggtgacc ctgcagctct acaactcagt taaatatgag
 601 cctcctctgg agacatcaa ggtgtccaag ttggccgggc agctgcgtat ggagtgggag
 661 accccggata ccaggttgg tgctgaggtg cagttccggc accggacacc cagcagccca
 721 tggaagttgg gcgactgcgg acctcaggat gatgatactg agtcctgcct ctgcccctg
 781 gagatgaatg tggcccagga attccagctc cgacgacggc agctggggag ccaaggaagt
 841 tcctggagca agtggagcag ccccgtgtgc gttcccctg aaaaccccc acagcctcag
 901 gtgagattct cggtggagca gctgggccag gatgggagga ggcggctgac cctgaaagag
 961 cagccaaccc agctggagct tccagaaggc tgtcaagggc tggcgcctgg cacggaggtc
1021 acttaccgac tacagctcca catgctgtcc tgcccgtgta aggccaaggc caccaggacc
1081 ctgcacctgg ggaagatgcc ctatctctcg ggtgctgcct acaacgtggc tgtcatctcc
1141 tcgaaccaat tggtcctgg cctgaaccag acgtggcaca ttcctgccga cacccacaca
1201 gatggcatga tctcagctca ctgcaacctc cgccttccag attcaagaga ttctcctgct
1261 tcagcctccc gagtagctgg gattacaggc atctgccacc atacccggct aattttgtat
1321 ttttagtaga cgggggttt caccacgttg ccaggctgg tctcgaactc ctgacctcaa
1381 gtgatccacc tgccttggcc tcccaaagtg ttgggattat aggcgtgagc accatgccc
1441 agcctaattt ttgtattttt agtagagatg agtttcacc atgttgccca ggctggtctc
1501 aaactcctgc cctcaggtga tccacccacc tcagcctctc aaagtgctgg gattacaggt
1561 gtgagccact gtggccgacc tactatttt attattttg agctaggttc tcagtctgtt
1621 ggcagactgg agtgcaatca tggctcactg cagccttgaa ctcccagact caagtgatcc
1681 ttccacctca gcctctggag tagctgggac tacagacatg caccaccaca cctggttaat
1741 tttttatttt tattttttgt agagacaggt gtctctctac gttgcccagg ctggtctcga
1801 actcctgggc tcaagtgatc cacccatctc cacctcccaa agtgctagga ttacaggcgt
1861 gagccaccgt acccagcctg gtcccatatc atagtgaaat ggtgcctgta aagctctcag
1921 cattggcttg gcacatgcag ttggtactca ataaacggct gttgctatcc ccaaaaaaaa
1981 aaaaaaaaa aaaaaaa
```

Human IL-12R β1 mRNA Variant 3
(SEQ ID NO: 6)

```
   1 ctctttcact tgacttgcc ttagggatgg gctgtgacac tttacttttt ttcttttttc
  61 ttttttttca gtcttttctc cttgctcagc ttcaatgtgt tccggagtgg ggacggggtg
 121 gctgaacctc gcaggtggca gagaggctcc cctggggctg tggggctcta cgtggatccg
 181 atggagccgc tggtgacctg ggtggtcccc ctcctcttcc tcttcctgct gtccaggcag
```

-continued

```
 241 ggcgctgcct gcagaaccag tgagtgctgt tttcaggacc cgccatatcc ggatgcagac
 301 tcaggctcgg cctcgggccc tagggacctg agatgctatc ggatatccag tgatcgttac
 361 gagtgctcct ggcagtatga gggtcccaca gctggggtca gccacttcct gcggtgttgc
 421 cttagctccg ggcgctgctg ctacttcgcc gccggctcag ccaccaggct gcagttctcc
 481 gaccaggctg gggtgtctgt gctgtacact gtcacactct gggtggaatc ctgggccagg
 541 aaccagacag agaagtctcc tgaggtgacc ctgcagctct acaactcagt taaatatgag
 601 cctcctctgg gagacatcaa ggtgtccaag ttggccgggc agctgcgtat ggagtgggag
 661 accccggata accaggttgg tgctgaggtg cagttccggc accgacacc cagcagccca
 721 tggaagttgg gcgactgcgg acctcaggat gatgatactg agtcctgcct ctgcccctg
 781 gagatgaatg tggcccagga attccagctc cgacgacggc agctggggag ccaaggaagt
 841 tcctggagca agtggagcag ccccgtgtgc gttcccctg aaaacccccc acagcctcag
 901 gtgagattct cggtggagca gctgggccag gatgggagga ggcggctgac cctgaaagag
 961 cagccaaccc agctggagct tccagaaggc tgtcaagggc tggcgcctgg cacggaggtc
1021 acttaccgac tacagctcca catgctgtcc tgcccgtgta aggccaaggc caccaggacc
1081 ctgcacctgg ggaagatgcc ctatctctcg ggtgctgcct acaacgtggc tgtcatctcc
1141 tcgaaccaat ttggtcctgg cctgaaccag acgtggcaca ttcctgccga cacccacaca
1201 gaaccagtgg ctctgaatat cagcgtcgga accacgggaa ccaccatgta ttggccagcc
1261 cgggctcaga gcatgacgta ttgcattgaa tggcagcctg tgggccagga cggggggcctt
1321 gccacctgca gcctgactgc gccgcaagac ccggatccgg ctggaatggc aacctacagc
1381 tggagtcgag agtctggggc aatggggcag gaaaagtgtt actacattac catctttgcc
1441 tctgcgcacc ccgagaagct caccttgtgg tctacggtcc tgtccaccta ccactttggg
1501 ggcaatgcct cagcagctgg gacaccgcac cacgtctcgg tgaagaatca tagcttggac
1561 tctgtgtctg tggactgggc accatccctg ctgagcacct gtcccggcgt cctaaaggag
1621 tatgttgtcc gctgccgaga tgaagacagc aaacaggtgt cagagcatcc cgtgcagccc
1681 acagagaccc aagttaccct cagtggcctg cgggctggtg tagcctacac ggtgcaggtg
1741 cgagcagaca cagcgtggct gaggggtgtc tggagccagc cccagcgctt cagcatcgaa
1801 gtgcaggttt ctgattggct catcttcttc gcctccctgg ggagcttcct gagcatcctt
1861 ctcgtgggcg tccttggcta ccttggcctg aacagggccg cacggcacct gtgcccgccg
1921 ctgcccacac cctgtgccag ctccgccatt gagttccctg gagggaagga gacttggcag
1981 tggatcaacc cagtggactt ccaggaagag gcatccctgc aggaggccct ggtggtagag
2041 atgtcctggg acaaaggcga gaggactgag cctctcgaga agacagagct acctgagggt
2101 gcccctgagc tggccctgga tacagagttg tccttggagg atggagacag atgtgatcgt
2161 tgaggctcag agagggtgag tgactcgccc gaggctacgt agcacacaca ggagtcacat
2221 ttggacccaa ataacccaga gctcctccag gctccagtgc acctgcctcc tctctgcccc
2281 gtgcctgttg ccacccatcc tgcgggggaa ccctagatgc tgccatgaaa tggaagctgc
2341 tgcaccctgc tgggcctggc atccgtgggg caggagcaga ccctgccatt tacctgttct
2401 ggcgtagaat ggactggaa tggggcaag ggggctcag atggatccct ggaccctggg
2461 ctgggcatcc accccagga gcactggatg gggagtctgg actcaagggc tccctgcagc
2521 attgcggggt cttgtagctt ggaggatcca ggcatatagg aaggggggct gtaaactttg
2581 tgggaaaaat gacgtcctc ccatcccacc ccccacccca ccctcacccc cctataaaat
2641 gggggtggtg ataatgacct tacacagctg ttcaaaatca tcgtaaatga gcctcctctt
```

-continued

```
2701 gggtatttt ttcctgtttg aagcttgaat gtcctgctca aaatctcaaa acacgagcct
2761 tggaattcaa aaaaaaaaaa aaaaaaa
```

Human IL-12R β1 mRNA Variant 4

(SEQ ID NO: 7)

```
   1 agaacactcc gctgcctctc cagagccagg cacacagcag gcgctccata aatgttcgtt
  61 ggtcttttct ccttgctcag cttcaatgtg ttccggagtg gggacggggt ggctgaacct
 121 cgcaggtggc agagaggctc ccctggggct gtggggctct acgtggatcc gatggagccg
 181 ctggtgacct gggtggtccc cctcctcttc ctcttcctgc tgtccaggca gggcgctgcc
 241 tgcagaacca gtgagtgctg ttttcaggac ccgccatatc cggatgcaga ctcaggctcg
 301 gcctcgggcc ctagggacct gagatgctat cggatatcca gtgatcgtta cgagtgctcc
 361 tggcagtatg agggtcccac agctggggtc agccacttcc tgcgtgttg ccttagctcc
 421 gggcgctgct gctacttcgc cgccggctca gccaccaggc tgcagttctc cgaccaggct
 481 ggggtgtctg tgctgtacac tgtcacactc tgggtggaat cctgggccag gaaccagaca
 541 gagaagtctc ctgaggtgac cctgcagctc tacaactcag ttaaatatga gcctcctctg
 601 ggagacatca aggtgtccaa gttggccggg cagctgcgta tggagtggga caccccggat
 661 aaccaggttg gtgctgaggt gcagttccgg caccggacac ccagcagccc atggaagttg
 721 ggcgactgcg gacctcagga tgatgatact gagtcctgcc tctgccccct ggagatgaat
 781 gtggcccagg aattccagct ccgacgacgg cagctgggga gccaaggaag ttcctggagc
 841 aagtggagca gccccgtgtg cgttcccct gaaaacccc acagcctca ggtgagattc
 901 tcggtggagc agctgggcca ggatgggagg aggcggctga ccctgaaaga gcagccaacc
 961 cagctggagc ttccagaagg ctgtcaaggg ctggcgcctg gcacggaggt cacttaccga
1021 ctacagctcc acatgctgtc ctgcccgtgt aaggccaagg ccaccaggac cctgcacctg
1081 gggaagatgc cctatctctc gggtgctgcc tacaacgtgg ctgtcatctc ctcgaaccaa
1141 tttggtcctg gcctgaacca gacgtggcac attcctgccg acacccacac agaaccagtg
1201 gctctgaata tcagcgtcgg aaccaacggg accaccatgt attggccagc ccgggctcag
1261 agcatgacgt attgcattga atggcagcct gtgggccagg acgggggcct tgccacctgc
1321 agcctgactg cgccgcaaga cccggatccg gctggaatgg caacctacag ctggagtcga
1381 gagtctgggg caatggggca ggaaaagtgt tactacatta ccatctttgc tctgcgcac
1441 cccgagaagc tcaccttgtg gtctacggtc ctgtccacct accactttgg gggcaatgcc
1501 tcagcagctg gacaccgca ccacgtctcg gtgaagaatc atagcttgga ctctgtgtct
1561 gtggactggg caccatccct gctgagcacc tgtccggcg tcctaaagga gtatgttgtc
1621 cgctgccgag atgaagacag caaacaggtg tcagcatc ccgtgcagcc cacagagacc
1681 caagttaccc tcagtggcct gcgggctggt gtagcctaca cggtgcaggt gcgagcagac
1741 acagcgtggc tgaggggtgt ctggagccag cccagcgct tcagcatcga agtgcaggtt
1801 tctgattggc tcatcttctt cgcctccctg gggagcttcc tgagcatcct tctcgtgggc
1861 gtccttggct accttggcct gaacagggcc gcacggcacc tgtgcccgcc gctgcccaca
1921 ccctgtgcca gctccgccat tgagttccct ggaggaaagg agacttggca gtggatcaac
1981 ccagtggact tccaggaaga ggcatccctg caggaggccc tggtggtaga gatgtcctgg
2041 gacaaaggcg agaggactga gcctctcgag aagacagagc tacctgaggg tgcccctgag
2101 ctggcctgg atacagagtt gtccttggag gatggagaca ggtgcaaggc caagatgtga
2161 tcgttgaggc tcagagaggg tgagtgactc gcccgaggct acgtagcaca cacaggagtc
```

```
2221 acatttggac ccaaataacc cagagctcct ccaggctcca gtgcacctgc ctcctctctg
2281 ccccgtgcct gttgccaccc atcctgcggg ggaaccctag atgctgccat gaaatggaag
2341 ctgctgcacc ctgctgggcc tggcatccgt ggggcaggag cagaccctgc catttacctg
2401 ttctggcgta gaatggactg gaatgggggg caaggggggc tcagatggat ccctggaccc
2461 tgggctgggc atccaccccc aggagcactg gatggggagt ctggactcaa gggctccctg
2521 cagcattgcg ggtcttgta gcttggagga tccaggcata tagggaaggg ggctgtaaac
2581 tttgtgggaa aaatgacggt cctcccatcc cacccccac cccaccctca ccccctata
2641 aaatgggggt ggtgataatg accttacaca gctgttcaaa atcatcgtaa atgagcctcc
2701 tcttgggtat ttttttcctg tttgaagctt gaatgtcctg ctcaaaatct caaaacacga
2761 gccttggaat tcaaaaaaaa aaaaaaaaa a
```

Human IL-12R β2 mRNA Variant 1

(SEQ ID NO: 8)

```
   1 tgcagagcac agagaaagga catctgcgag gaaagttccc tgatggctgt caacaaagtg
  61 ccacgtctct atggctgtga acgctgagca cacgatttta tcgcgcctat catatcttgg
 121 tgcataaacg cacctcacct cggtcaaccc ttgctccgtc ttatgagaca ggctttatta
 181 tccgcatttt atatgagggg aaactgacgg tggagagaga attatcttgc tcaaggcgac
 241 acagcagagc ccacaggtgg cagaatccca cccgagcccg cttcgacccg cggggtggaa
 301 accacgggcg cccgcccggc tgcgcttcca gagctgaact gagaagcgag tcctctccgc
 361 cctgcggcca ccgcccagcc ccgaccccg ccccggcccg atcctcactc gccgccagct
 421 ccccgcgccc accccggagt tggtggcgca gaggcgggag gcggaggcgg gagggcgggc
 481 gctggcaccg ggaacgcccg agcgccggca gagagcgcgg agagcgcgac acgtgcggcc
 541 cagagcaccg ggccacccg gtccccgcag gcccgggacc gcgcccgctg caggcgaca
 601 cgtggaagaa tacggagttc tataccagag ttgattgttg atggcacata cttttagagg
 661 atgctcattg gcatttatgt ttataatcac gtggctgttg attaaagcaa aaatagatgc
 721 gtgcaagaga ggcgatgtga ctgtgaagcc ttcccatgta attttacttg gatccactgt
 781 caatattaca tgctctttga agcccagaca aggctgcttt cactattcca gacgtaacaa
 841 gttaatcctg tacaagtttg acagaagaat caattttcac catggccact ccctcaattc
 901 tcaagtcaca ggtcttcccc ttggtacaac cttgtttgtc tgcaaactgg cctgtatcaa
 961 tagtgatgaa attcaaatat gtggagcaga gatcttcgtt ggtgttgctc cagaacagcc
1021 tcaaaattta tcctgcatac agaagggaga acaggggact gtggcctgca cctgggaaag
1081 aggacgagac acccacttat acactgagta tactctacag ctaagtggac caaaaaattt
1141 aacctggcag aagcaatgta agacattta ttgtgactat ttggactttg gaatcaacct
1201 cacccctgaa tcacctgaat ccaatttcac agccaaggtt actgctgtca atagtcttgg
1261 aagctcctct tcacttccat ccacattcac attcttggac atagtgaggc ctcttcctcc
1321 gtgggacatt agaatcaaat ttcaaaaggc ttctgtgagc agatgtaccc tttattggag
1381 agatgaggga ctggtactgc ttaatcgact cagatatcgg cccagtaaca gcaggctctg
1441 gaatatggtt aatgttacaa aggccaaagg aagacatgat ttgctggatc tgaaaccatt
1501 tacagaatat gaatttcaga tttcctctaa gctacatctt tataagggaa gttggagtga
1561 ttggagtgaa tcattgagag cacaaacacc agaagaagag cctactggga tgttagatgt
1621 ctggtacatg aaacggcaca ttgactacag tagacaacag atttctcttt tctggaagaa
1681 tctgagtgtc tcagaggcaa gaggaaaaat tctccactat caggtgacct tgcaggagct
1741 gacaggaggg aaagccatga cacagaacat cacaggacac acctcctgga ccacagtcat
```

-continued

```
1801 tcctagaacc ggaaattggg ctgtggctgt gtctgcagca aattcaaaag gcagttctct
1861 gcccactcgt attaacataa tgaacctgtg tgaggcaggg ttgctggctc ctcgccaggt
1921 ctctgcaaac tcagagggca tggacaacat tctggtgact tggcagcctc ccaggaaaga
1981 tccctctgct gttcaggagt acgtggtgga atggagagag ctccatccag ggggtgacac
2041 acaggtccct ctaaactggc tacggagtcg accctacaat gtgtctgctc tgatttcaga
2101 gaacataaaa tcctacatct gttatgaaat ccgtgtgtat gcactctcag gggatcaagg
2161 aggatgcagc tccatcctgg gtaactctaa gcacaaagca ccactgagtg gcccccacat
2221 taatgccatc acagaggaaa aggggagcat tttaatttca tggaacagca ttccagtcca
2281 ggagcaaatg ggctgcctcc tccattatag gatatactgg aaggaacggg actccaactc
2341 ccagcctcag ctctgtgaaa ttccctacag agtctcccaa aattcacatc aataaacag
2401 cctgcagccc cgagtgacat atgtcctgtg gatgacagct ctgacagctg ctggtgaaag
2461 ttcccacgga aatgagaggg aattttgtct gcaaggtaaa gccaattgga tggcgtttgt
2521 ggcaccaagc atttgcattg ctatcatcat ggtgggcatt ttctcaacgc attacttcca
2581 gcaaaaggtg tttgttctcc tagcagccct cagacctcag tggtgtagca gagaaattcc
2641 agatccagca aatagcactt gcgctaagaa atatcccatt gcagaggaga agacacagct
2701 gcccttggac aggctcctga tagactggcc cacgcctgaa gatcctgaac cgctggtcat
2761 cagtgaagtc cttcatcaag tgaccccagt tttcagacat ccccctgct ccaactggcc
2821 acaaagggaa aaggaatcc aaggtcatca ggcctctgag aaagacatga tgcacagtgc
2881 ctcaagccca ccacctccaa gagctctcca agctgagagc agacaactgg tggatctgta
2941 caaggtgctg gagagcaggg gctccgaccc aaagcccgaa acccagcct gtccctggac
3001 ggtgctccca gcaggtgacc ttcccaccca tgatggctac ttaccctcca acatagatga
3061 cctcccctca catgaggcac ctctcgctga ctctctggaa gaactggagc ctcagcacat
3121 ctccttct gttttccct caagttctct tcacccactc accttctcct gtggtgataa
3181 gctgactctg gatcagttaa agatgaggtg tgactccctc atgctctgag tggtgaggct
3241 tcaagcctta aagtcagtgt gccctcaacc agcacagcct gccccaattc ccccagcccc
3301 tgctccagca gctgtcatct ctgggtgcca ccatcggtct ggctgcagct agaggacagg
3361 caagccagct ctgggggagt cttaggaact gggagttggt cttcactcag atgcctcatc
3421 ttgcctttcc cagggcctta aaattacatc cttcactgtg tggacctaga gactccaact
3481 tgaattccta gtaactttct tggtatgctg gccagaaagg gaaatgagga ggagagtaga
3541 aaccacagct cttagtagta atggcataca gtctagagga ccattcatgc aatgactatt
3601 tctaaagcac ctgctacaca gcaggctgta cacagcagat cagtactgtt caacagaact
3661 tcctgagatg atggaaatgt tctacctctg cactcactgt ccagtacatt agacactagg
3721 cacattggct gttaatcact tggaatgtgt ttagcttgac tgaggaatta aattttgatt
3781 gtaaatttaa atcgccacac atggctagtg gctactgtat tggagtgcac agctctagat
3841 ggctcctaga ttattgagag ccttcaaaac aaatcaacct agttctatag atgaagacat
3901 aaaagacact ggtaaacacc aaggtaaaag gcccccaag gtggtcatga ctggtctcat
3961 ttgcagaagt ctaagaatgt acctttttct ggccgggcgt ggtagctcat gcctgtaatc
4021 ccagcacttt gggaggctga
```

-continued

Human IL-12R β2 mRNA Variant 2

(SEQ ID NO: 9)

```
   1 tgcagagcac agagaaagga catctgcgag gaaagttccc tgatggctgt caacaaagtg
  61 ccacgtctct atggctgtga acgctgagca cacgatttta tcgcgcctat catatcttgg
 121 tgcataaacg cacctcacct cggtcaaccc ttgctccgtc ttatgagaca ggctttatta
 181 tccgcatttt atatgagggg aaactgacgg tggagagaga attatcttgc tcaaggcgac
 241 acagcagagc ccacaggtgg cagaatccca cccgagcccg cttcgacccg cggggtggaa
 301 accacgggcg cccgcccggc tgcgcttcca gagctgaact gagaagcgag tcctctccgc
 361 cctgcggcca ccgcccagcc ccgaccccg ccccgcccg atcctcactc gccgccagct
 421 ccccgcgccc accccggagt tggtggcgca gaggcgggag gcggaggcgg gagggcgggc
 481 gctggcaccg ggaacgcccg agcgccggca gagagcgcgg agagcgcgac acgtgcggcc
 541 cagagcaccg gggccacccg gtccccgcag gcccgggacc gcgcccgctg gcaggcgaca
 601 cgtggtcacg gtgatccatt tgtaaagtcg gaataaatg acctctgaag tgttgtctgt
 661 atattgatct gctaccagta aaacatatct ctgaagaata cggagttcta taccagagtt
 721 gattgttgat ggcacatact tttagaggat gctcattggc atttatgttt ataatcacgt
 781 ggctgttgat taaagcaaaa atagatgcgt gcaagagagg cgatgtgact gtgaagcctt
 841 cccatgtaat tttacttgga tccactgtca atattacatg ctctttgaag cccagacaag
 901 gctgctttca ctattccaga cgtaacaagt taatcctgta caagtttgac agaagaatca
 961 attttcacca tggccactcc ctcaattctc aagtcacagg tcttcccctt ggtacaacct
1021 tgtttgtctg caaactggcc tgtatcaata gtgatgaaat tcaaatatgt ggagcagaga
1081 tcttcgttgg tgttgctcca gaacagcctc aaaatttatc ctgcatacag aagggagaac
1141 aggggactgt ggcctgcacc tgggaaagag gacgagacac ccacttatac actgagtata
1201 ctctacagct aagtggacca aaaaatttaa cctggcagaa gcaatgtaaa gacatttatt
1261 gtgactattt ggactttgga atcaacctca cccctgaatc acctgaatcc aatttcacag
1321 ccaaggttac tgctgtcaat agtcttggaa gctcctcttc acttccatcc acattcacat
1381 tcttggacat agtgaggcct cttcctccgt gggacattag aatcaaattt caaaaggctt
1441 ctgtgagcag atgtacccct tattggagag atgagggact ggtactgctt aatcgactca
1501 gatatcggcc cagtaacagc aggctctgga atatggttaa tgttacaaag gccaaggaa
1561 gacatgattt gctggatctg aaaccattta cagaatatga atttcagatt cctctaagc
1621 tacatcttta aagggaagt tggagtgatt ggagtgaatc attgagagca caaacaccag
1681 aagaagagcc tactgggatg ttagatgtct ggtacatgaa acggcacatt gactacagta
1741 gacaacagat ttctcttttc tggaagaatc tgagtgtctc agaggcaaga ggaaaaattc
1801 tccactatca ggtgaccttg caggagctga caggagggaa agccatgaca cagaacatca
1861 caggacacac ctcctggacc acagtcattc ctagaaccgg aaattgggct gtggctgtgt
1921 ctgcagcaaa ttcaaaaggc agttctctgc ccactcgtat taacataatg aacctgtgtg
1981 aggcagggtt gctggctcct cgccaggtct ctgcaaactc agagggcatg acaacattc
2041 tggtgacttg gcagcctccc aggaaagatc cctctgctgt tcaggagtac gtggtggaat
2101 ggagagagct ccatccaggg ggtgacacac aggtccctct aaactggcta cggagtcgac
2161 cctacaatgt gtctgctctg atttcagaga acataaaatc ctacatctgt tatgaaatcc
2221 gtgtgtatgc actctcaggg gatcaaggag gatgcagctc catcctgggt aactctaagc
2281 acaaagcacc actgagtggc ccccacatta atgccatcac agaggaaaag gggagcattt
```

```
2341 taatttcatg gaacagcatt ccagtccagg agcaaatggg ctgcctcctc cattatagga
2401 tatactggaa ggaacgggac tccaactccc agcctcagct ctgtgaaatt ccctacagag
2461 tctcccaaaa ttcacatcca ataaacagcc tgcagccccg agtgacatat gtcctgtgga
2521 tgacagctct gacagctgct ggtgaaagtt cccacggaaa tgagagggaa ttttgtctgc
2581 aaggtaaagc caattggatg gcgtttgtgg caccaagcat ttgcattgct atcatcatgg
2641 tgggcatttt ctcaacgcat tacttccagc aaaagagaag acacagctgc ccttggacag
2701 gctcctgata gactggccca cgcctgaaga tcctgaaccg ctggtcatca gtgaagtcct
2761 tcatcaagtg accccagttt tcagacatcc ccctgctcc aactggccac aaagggaaaa
2821 aggaatccaa ggtcatcagg cctctgagaa agacatgatg cacagtgcct caagcccacc
2881 acctccaaga gctctccaag ctgagagcag acaactggtg gatctgtaca aggtgctgga
2941 gagcagggc tccgacccaa agcccgaaaa cccagcctgt ccctggacgg tgctcccagc
3001 aggtgacctt cccacccatg atggctactt accctccaac atagatgacc tcccctcaca
3061 tgaggcacct ctcgctgact ctctggaaga actggagcct cagcacatct cccttttctgt
3121 tttcccctca agttctcttc acccactcac cttctcctgt ggtgataagc tgactctgga
3181 tcagttaaag atgaggtgtg actccctcat gctctgagtg gtgaggcttc aagccttaaa
3241 gtcagtgtgc cctcaaccag cacagcctgc cccaattccc ccagccctg ctccagcagc
3301 tgtcatctct gggtgccacc atcggtctgg ctgcagctag aggacaggca agccagctct
3361 ggggagtct taggaactgg gagttggtct tcactcagat gcctcatctt gcctttccca
3421 gggccttaaa attacatcct tcactgtgtg gacctagaga ctccaacttg aattcctagt
3481 aactttcttg gtatgctggc cagaaaggga aatgaggagg agagtagaaa ccacagctct
3541 tagtagtaat ggcatacagt ctagaggacc attcatgcaa tgactatttc taaagcacct
3601 gctacacagc aggctgtaca cagcagatca gtactgttca acagaacttc ctgagatgat
3661 ggaaatgttc tacctctgca ctcactgtcc agtacattag acactaggca cattggctgt
3721 taatcacttg gaatgtgttt agcttgactg aggaattaaa ttttgattgt aaatttaaat
3781 cgccacacat ggctagtggc tactgtattg gagtgcacag ctctagatgc ctcctagatt
3841 attgagagcc ttcaaaacaa atcaacctag ttctatagat gaagacataa aagacactgg
3901 taaacaccaa ggtaaaaggg cccccaaggt ggtcatgact ggtctcattt gcagaagtct
3961 aagaatgtac ctttttctgg ccgggcgtgg tagctcatgc ctgtaatccc agcactttgg
4021 gaggctga
```

Human IL-12R β2 mRNA Variant 3
(SEQ ID NO: 10)
```
  1 tgcagagcac agagaaagga catctgcgag gaaagttccc tgatggctgt caacaaagtg
 61 ccacgtctct atggctgtga acgctgagca cacgatttta tcgcgcctat catatcttgg
121 tgcataaacg cacctcacct cggtcaaccc ttgctccgtc ttatgagaca ggctttatta
181 tccgcatttt atatgagggg aaactgacgt ggagagaga attatcttgc tcaaggcgac
241 acagcagagc ccacaggtgg cagaatccca cccgagcccg cttcgacccg cggggtggaa
301 accacggcg cccgcccggc tgcgcttcca gagctgaact gagaagcgag tcctctccgc
361 cctgcggcca ccgcccagcc ccgaccccg cccggcccg atcctcactc gccgccagct
421 ccccgcgccc accccggagt tggtggcgca gaggcgggag gcggaggcgg gagggcgggc
481 gctggcaccg ggaacgcccg agcgccggca gagagcgcgg agagcgcgac acgtgcggcc
541 cagagcaccg gggccacccg gtccccgcag gcccgggacc gcgcccgctg gcaggcgaca
601 cgtggaagaa tacggagttc tataccagag ttgattgttg atggcacata cttttagagg
```

-continued

```
 661 atgctcattg gcatttatgt ttataatcac gtggctgttg attaaagcaa aaatagatgc
 721 gtgcaagaga ggcgatgtga ctgtgaagcc ttcccatgta attttacttg gatccactgt
 781 caatattaca tgctctttga agcccagaca aggctgcttt cactattcca gacgtaacaa
 841 gttaatcctg tacaagtttg acagaagaat caattttcac catggccact ccctcaattc
 901 tcaagtcaca ggtcttcccc ttggtacaac cttgtttgtc tgcaaactgg cctgtatcaa
 961 tagtgatgaa attcaaatat gtggagcaga gatcttcgtt ggtgttgctc cagaacagcc
1021 tcaaaattta tcctgcatac agaagggaga cagggggact gtggcctgca cctgggaaag
1081 aggacgagac acccacttat acactgagta tactctacag ctaagtggac caaaaaattt
1141 aacctggcag aagcaatgta aagacattta ttgtgactat ttggactttg aatcaacct
1201 caccctgaa tcacctgaat ccaatttcac agccaaggtt actgctgtca atagtcttgg
1261 aagctcctct tcacttccat ccacattcac attcttggac atagtgaggc ctcttcctcc
1321 gtgggacatt agaatcaaat ttcaaaaggc ttctgtgagc agatgtaccc tttattggag
1381 agatgaggga ctggtactgc ttaatcgact cagatatcgg cccagtaaca gcaggctctg
1441 gaatatggtt aatgttacaa aggccaaagg aagacatgat ttgctggatc tgaaaccatt
1501 tacagaatat gaatttcaga tttcctctaa gctacatctt tataagggaa gttggagtga
1561 ttggagtgaa tcattgagag cacaaacacc agaagaagag cctactggga tgttagatgt
1621 ctggtacatg aaacggcaca ttgactacag tagacaacag atttctcttt tctggaagaa
1681 tctgagtgtc tcagaggcaa gaggaaaaat tctccactat caggtgacct tgcaggagct
1741 gacaggaggg aaagccatga cacagaacat cacaggacac acctcctgga ccacagtcat
1801 tcctagaacc ggaaattggg ctgtggctgt gtctgcagca aattcaaaag gcagttctct
1861 gcccactcgt attaacataa tgaacctgtg tgaggcaggg ttgctggctc ctcgccaggt
1921 ctctgcaaac tcagagggca tggacaacat tctggtgact ggcagcctc ccaggaaaga
1981 tccctctgct gttcaggagt acgtggtgga atggagagag ctccatccag ggggtgacac
2041 acaggtccct ctaaactggc tacggagtcg accctacaat gtgtctgctc tgatttcaga
2101 aattccctac agagtctccc aaaattcaca tccaataaac agcctgcagc cccgagtgac
2161 atatgtcctg tggatgacag ctctgacagc tgctggtgaa agttcccacg gaaatgagag
2221 ggaattttgt ctgcaaggta agccaattg gatggcgttt gtggcaccaa gcatttgcat
2281 tgctatcatc atggtgggca ttttctcaac gcattacttc cagcaaaagg tgtttgttct
2341 cctagcagcc ctcagacctc agtggtgtag cagagaaatt ccagatccag caaatagcac
2401 ttgcgctaag aaatatccca ttgcagagga aagacacag ctgcccttgg acaggctcct
2461 gatagactgg cccacgcctg aagatcctga accgctggtc atcagtgaag tccttcatca
2521 agtgacccca gttttcagac atcccccctg ctccaactgg ccacaaaggg aaaaaggaat
2581 ccaaggtcat caggcctctg agaaagacat gatgcacagt gcctcaagcc caccacctcc
2641 aagagctctc caagctgaga gcagacaact ggtggatctg tacaaggtgc tggagagcag
2701 gggctccgac ccaaagcccg aaaaaccagc ctgtccctgg acggtgctcc cagcaggtga
2761 ccttcccacc catgatggct acttaccctc aacatagat gacctcccct cacatgaggc
2821 acctctcgct gactctctgg aagaactgga gcctcagcac atctcccttt ctgttttccc
2881 ctcaagttct cttcacccac tcaccttctc ctgtggtgat aagctgactc tggatcagtt
2941 aaagatgagg tgtgactccc tcatgctctg agtggtgagg cttcaagcct taaagtcagt
3001 gtgccctcaa ccagcacagc ctgccccaat tcccccagcc cctgctccag cagctgtcat
```

```
3061 ctctgggtgc caccatcggt ctggctgcag ctagaggaca ggcaagccag ctctggggga
3121 gtcttaggaa ctgggagttg gtcttcactc agatgcctca tcttgccttt cccagggcct
3181 taaaattaca tccttcactg tgtggaccta gagactccaa cttgaattcc tagtaacttt
3241 cttggtatgc tggccagaaa gggaaatgag gaggagagta gaaaccacag ctcttagtag
3301 taatggcata cagtctagag gaccattcat gcaatgacta tttctaaagc acctgctaca
3361 cagcaggctg tacacagcag atcagtactg ttcaacagaa cttcctgaga tgatggaaat
3421 gttctacctc tgcactcact gtccagtaca ttagacacta ggcacattgg ctgttaatca
3481 cttggaatgt gtttagcttg actgaggaat taaattttga ttgtaaattt aaatcgccac
3541 acatggctag tggctactgt attggagtgc acagctctag atggctccta gattattgag
3601 agccttcaaa acaaatcaac ctagttctat agatgaagac ataaaagaca ctggtaaaca
3661 ccaaggtaaa agggccccca aggtggtcat gactggtctc atttgcagaa gtctaagaat
3721 gtacctttt ctggccgggc gtggtagctc atgcctgtaa tcccagcact ttgggaggct
3781 ga
```

Human IL-12R β2 mRNA Variant 4

(SEQ ID NO: 11)

```
   1 tgcagagcac agagaaagga catctgcgag gaaagttccc tgatggctgt caacaaagtg
  61 ccacgtctct atggctgtga acgctgagca cacgatttta tcgcgcctat catatcttgg
 121 tgcataaacg cacctcacct cggtcaaccc ttgctccgtc ttatgagaca ggctttatta
 181 tccgcatttt atatgagggg aaactgacgg tggagagaga attatcttgc tcaaggcgac
 241 acagcagagc ccacaggtgg cagaatccca cccgagcccg cttcgacccg cggggtggaa
 301 accacgggcg cccgcccggc tgcgcttcca gagctgaact gagaagcgag tcctctccgc
 361 cctgcggcca ccgcccagcc ccgaccccg ccccgcccg atcctcactc gccgccagct
 421 ccccgcgccc accccggagt tggtggcgca gaggcgggag gcggaggcgg gagggcgggc
 481 gctggcaccg gaacgcccg agcgccggca gagagcgcgg agagcgcgac acgtgcggcc
 541 cagagcaccg gggccacccg gtccccgcag gcccgggacc gcgcccgctg gcaggcgaca
 601 cgtggaagaa tacggagttc tataccagag ttgattgttg atggcacata cttttagagg
 661 atgctcattg gcatttatgt ttataatcac gtggctgttg attaaagcaa aaatagatgc
 721 gtgcaagaga ggcgatgtga ctgtgaagcc ttcccatgta attttacttg gatccactgt
 781 caatattaca tgctctttga agcccagaca aggctgcttt cactattcca gacgtaacaa
 841 gttaatcctg tacaagtttg acagaagaat caattttcac catggccact ccctcaattc
 901 tcaagtcaca ggtcttcccc ttggtacaac cttgtttgtc tgcaaactgg cctgtatcaa
 961 tagtgatgaa attcaaatat gtggagcaga gatcttcgtt ggtgttgctc cagaacagcc
1021 tcaaaattta tcctgcatac agaagggaga acaggggact gtggcctgca cctgggaaag
1081 aggacgagac acccacttat acactgagta tactctacag ctaagtggac caaaaaattt
1141 aacctggcag aagcaatgta aagacattta ttgtgactat ttggactttg gaatcaacct
1201 caccccctgaa tcacctgaat ccaatttcac agccaaggtt actgctgtca atagtcttgg
1261 aagctcctct tcacttccat ccacattcac attcttggac atagtgaggc ctcttcctcc
1321 gtgggacatt agaatcaaat ttcaaaaggc ttctgtgagc agatgtaccc tttattggag
1381 agatgaggga ctggtactgc ttaatcgact cagatatcgg cccagtaaca gcaggctctg
1441 gaatatggtt aatgttacaa aggccaaagg aagacatgat ttgctggatc tgaaaccatt
1501 tacagaatat gaattcaga tttcctctaa gctacatctt tataaggga gttggagtga
1561 ttggagtgaa tcattgagag cacaaacacc agaagaagag cctactggga tgttagatgt
```

-continued

```
1621  ctggtacatg aaacggcaca ttgactacag tagacaacag atttctcttt tctggaagaa
1681  tctgagtgtc tcagaggcaa gaggaaaaat tctccactat caggtgacct tgcaggagct
1741  gacaggaggg aaagccatga cacagaacat cacaggacac acctcctgga ccacagtcat
1801  tcctagaacc ggaaattggg ctgtggctgt gtctgcagca aattcaaaag gcagttctct
1861  gcccactcgt attaacataa tgaacctgtg tgaggcaggg ttgctggctc ctcgccaggt
1921  ctctgcaaac tcagagggca tggacaacat tctggtgact tggcagcctc ccaggaaaga
1981  tccctctgct gttcaggagt acgtggtgga atggagagag ctccatccag ggggtgacac
2041  acaggtccct ctaaactggc tacggagtcg accctacaat gtgtctgctc tgatttcaga
2101  gaacataaaa tcctacatct gttatgaaat ccgtgtgtat gcactctcag gggatcaagg
2161  aggatgcagc tccatcctgg gtaactctaa gcacaaagca ccactgagtg gcccccacat
2221  taatgccatc acagaggaaa aggggagcat tttaatttca tggaacagca ttccagtcca
2281  ggagcaaatg ggctgcctcc tccattatag gatatactgg aaggaacggg actccaactc
2341  ccagcctcag ctctgtgaaa ttccctacag agtctcccaa aattcacatc aataaacag
2401  cctgcagccc cgagtgacat atgtcctgtg gatgacagct ctgacagctg ctggtgaaag
2461  ttcccacgga aatgagaggg aattttgtct gcaaggagaa gacacagctg cccttggaca
2521  ggctcctgat agactggccc acgcctgaag atcctgaacc gctggtcatc agtgaagtcc
2581  ttcatcaagt gaccccagtt ttcagacatc cccctgctc caactggcca caaagggaaa
2641  aaggaatcca aggtcatcag gcctctgaga aagacatgat gcacagtgcc tcaagcccac
2701  cacctccaag agctctccaa gctgagagca gacaactggt ggatctgtac aaggtgctgg
2761  agagcagggg ctccgaccca aagcccgaaa acccagcctg tccctggacg gtgctcccag
2821  caggtgacct tcccacccat gatggctact taccctccaa catagatgac ctcccctcac
2881  atgaggcacc tctcgctgac tctctggaag aactggagcc tcagcacatc tccctttctg
2941  ttttcccctc aagttctctt cacccactca ccttctcctg tggtgataag ctgactctgg
3001  atcagttaaa gatgaggtgt gactccctca tgctctgagt ggtgaggctt caagccttaa
3061  agtcagtgtg ccctcaacca gcacagcctg ccccaattcc cccagccct gctccagcag
3121  ctgtcatctc tgggtgccac catcggtctg gctgcagcta aggacaggc aagccagctc
3181  tgggggagtc ttaggaactg ggagttggtc ttcactcaga tgcctcatct tgcctttccc
3241  agggccttaa aattacatcc ttcactgtgt ggacctagag actccaactt gaattcctag
3301  taactttctt ggtatgctgg ccagaaaggg aaatgaggag gagagtagaa accacagctc
3361  ttagtagtaa tggcatacag tctagaggac cattcatgca atgactattt ctaaagcacc
3421  tgctacacag caggctgtac acagcagatc agtactgttc aacgaaactt cctgagatga
3481  tggaaatgtt ctacctctgc actcactgtc cagtacatta gacactaggc acattggctg
3541  ttaatcactt ggaatgtgtt tagcttgact gaggaattaa attttgattg taaattaaa
3601  tcgccacaca tggctagtgg ctactgtatt ggagtgcaca gctctagatg gctcctagat
3661  tattgagagc cttcaaaaca aatcaaccta gttctataga tgaagacata aaagacactg
3721  gtaaacacca aggtaaaagg gcccccaagg tggtcatgac tggtctcatt tgcagaagtc
3781  taagaatgta ccttttttctg gccgggcgtg gtagctcatg cctgtaatcc cagcactttg
3841  ggaggctga
```

Human IL-23R mRNA (SEQ ID NO: 12)

```
   1 acaagggtgg cagcctggct ctgaagtgga attatgtgct tcaaacaggt tgaaagaggg
  61 aaacagtctt ttcctgcttc cagacatgaa tcaggtcact attcaatggg atgcagtaat
 121 agccctttac atactcttca gctggtgtca tggaggaatt acaaatataa actgctctgg
 181 ccacatctgg gtagaaccag ccacaatttt taagatgggt atgaatatct ctatatattg
 241 ccaagcagca attaagaact gccaaccaag gaaacttcat ttttataaaa atggcatcaa
 301 agaaagattt caaatcacaa ggattaataa acaacagct cggctttggt ataaaaactt
 361 tctggaacca catgcttcta tgtactgcac tgctgaatgt cccaaacatt ttcaagagac
 421 actgatatgt ggaaaagaca tttcttctgg atatccgcca gatattcctg atgaagtaac
 481 ctgtgtcatt tatgaatatt caggcaacat gacttgcacc tggaatgctg gaagctcac
 541 ctacatagac acaaaatacg tggtacatgt gaagagttta gagacagaag aagagcaaca
 601 gtatctcacc tcaagctata ttaacatctc cactgattca ttacaaggtg caagaagta
 661 cttggtttgg gtccaagcag caaacgcact aggcatggaa gagtcaaaac aactgcaaat
 721 tcacctggat gatatagtga taccttctgc agccgtcatt tccagggctg agactataaa
 781 tgctacagtg cccaagacca taatttattg ggatagtcaa acaacaattg aaaaggtttc
 841 ctgtgaaatg agatacaagg ctacaacaaa ccaaacttgg aatgttaaag aatttgacac
 901 caattttaca tatgtgcaac agtcagaatt ctacttggag ccaaacatta gtacgtatt
 961 tcaagtgaga tgtcaagaaa caggcaaaag gtactggcag ccttggagtt caccgttttt
1021 tcataaaaca cctgaaacag ttccccaggt cacatcaaaa gcattccaac atgacacatg
1081 gaattctggg ctaacagttg cttccatctc tacagggcac cttacttctg acaacagagg
1141 agacattgga cttttattgg gaatgatcgt ctttgctgtt atgttgtcaa ttctttcttt
1201 gattgggata tttaacagat cattccgaac tgggattaaa gaaggatct tattgttaat
1261 accaaagtgg ctttatgaag atattcctaa tatgaaaaac agcaatgttg tgaaaatgct
1321 acaggaaaat agtgaactta tgaataataa ttccagtgag caggtcctat atgttgatcc
1381 catgattaca gagataaaag aaatcttcat cccagaacac aagcctacag actacaagaa
1441 ggagaataca ggacccctgg agacaagaga ctaccgcaa aactcgctat cgacaatac
1501 tacagttgta tatattcctg atctcaacac tggatataaa ccccaaattt caaattttct
1561 gcctgaggga agccatctca gcaataataa tgaaattact tccttaacac ttaaaccacc
1621 agttgattcc ttagactcag gaaataatcc caggttacaa aagcatccta atttgctttt
1681 ttctgtttca agtgtgaatt cactaagcaa cacaatattt cttggagaat taagcctcat
1741 attaaatcaa ggagaatgca gttctcctga catacaaaac tcagtagagg aggaaaccac
1801 catgctttg gaaaatgatt cacccagtga actattcca gaacagaccc tgcttcctga
1861 tgaatttgtc tcctgtttgg ggatcgtgaa tgaggagttg ccatctatta tacttatttt
1921 tccacaaaat attttggaaa gccacttcaa taggatttca ctcttggaaa agtagagctg
1981 tgtggtcaaa atcaatatga aaagctgcc ttgcaatctg aacttgggtt ttccctgcaa
2041 tagaaattga attctgcctc tttttgaaaa aaatgtattc acatacaaat cttcacatgg
2101 acacatgttt tcatttccct tggataaata cctaggtagg ggattgctgg gccatatgat
2161 aagcatatgt ttcagttcta ccaatcttgt ttccagagta gtgacatttc tgtgctccta
2221 ccatcaccat gtaagaattc ccggagctc catgcctttt taattttagc cattcttctg
2281 cctcatttct taaaattaga gaattaaggt cccgaaggtg gaacatgctt catggtcaca
```

```
-continued
2341 catacaggca caaaaacagc attatgtgga cgcctcatgt atttttata gagtcaacta 2401 tttcctcttt attttccctc attgaaagat gcaaaacagc tctctattgt gtacagaaag 2461 ggtaaataat gcaaaatacc tggtagtaaa ataaatgctg aaaattttcc tttaaaatag 2521 aatcattagg ccaggcgtgg tggctcatgc ttgtaatccc agcactttgg taggctgagg 2581 tgggtggatc acctgaggtc aggagttcga gtccagcctg gccaatatgc tgaaaccctg 2641 tctctactaa aattacaaaa attagccggc catggtggca ggtgcttgta atcccagcta 2701 cttgggaggc tgaggcagga gaatcacttg aaccaggaag gcagaggttg cactgagctg 2761 agattgtgcc actgcactcc agcctgggca acaagagcaa aactctgtct ggaaaaaaaa 2821 aaaaaa
```

An antisense nucleic acid molecule can be complementary to all or part of a non-coding region of the coding strand of a nucleotide sequence encoding an IL-12A (p35), IL-12B (p40), IL-23 (p19), IL-12R β1, IL-12R β2, or IL-23R protein. Non-coding regions (5' and 3' untranslated regions) are the 5' and 3' sequences that flank the coding region in a gene and are not translated into amino acids.

Based upon the sequences disclosed herein, one of skill in the art can easily choose and synthesize any of a number of appropriate antisense nucleic acids to target a nucleic acid encoding an IL-12A (p35), IL-12B (p40), IL-23 (p19), IL-12R β1, IL-12R β2, or IL-23R protein described herein. Antisense nucleic acids targeting a nucleic acid encoding an IL-12A (p35), IL-12B (p40), IL-23 (p19), IL-12R β1, IL-12R β2, or IL-23R protein can be designed using the software available at the Integrated DNA Technologies website.

An antisense nucleic acid can be, for example, about 5, 10, 15, 20, 25, 30, 35, 40, 45, or 50 nucleotides or more in length. An antisense oligonucleotide can be constructed using chemical synthesis and enzymatic ligation reactions using procedures known in the art. For example, an antisense nucleic acid can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used.

Examples of modified nucleotides which can be used to generate an antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, $N^6$-isopentenyladenine, 1-methylguanine, 1-methylinosine, 2,2-dimethylguanine, 2-methyladenine, 2-methylguanine, 3-methylcytosine, 5-methylcytosine, $N^6$-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-$N^6$-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3) w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest).

The antisense nucleic acid molecules described herein can be prepared in vitro and administered to a mammal, e.g., a human. Alternatively, they can be generated in situ such that they hybridize with or bind to cellular mRNA and/or genomic DNA encoding an IL-12A (p35), IL-12B (p40), IL-23 (p19), IL-12R β1, IL-12R β2, or IL-23R protein to thereby inhibit expression, e.g., by inhibiting transcription and/or translation. The hybridization can be by conventional nucleotide complementarities to form a stable duplex, or, for example, in the case of an antisense nucleic acid molecule that binds to DNA duplexes, through specific interactions in the major groove of the double helix. The antisense nucleic acid molecules can be delivered to a mammalian cell using a vector (e.g., a lentivirus, a retrovirus, or an adenovirus vector).

An antisense nucleic acid can be an α-anomeric nucleic acid molecule. An α-anomeric nucleic acid molecule forms specific double-stranded hybrids with complementary RNA in which, contrary to the usual, β-units, the strands run parallel to each other (Gaultier et al., Nucleic Acids Res. 15:6625-6641, 1987). The antisense nucleic acid can also comprise a 2'-O-methylribonucleotide (Inoue et al., Nucleic Acids Res. 15:6131-6148, 1987) or a chimeric RNA-DNA analog (Inoue et al., FEBS Lett. 215:327-330, 1987). Non-limiting examples of antisense nucleic acids are described in Vaknin-Dembinsky et al., J. Immunol. 176 (12): 7768-7774, 2006.

Another example of an inhibitory nucleic acid is a ribozyme that has specificity for a nucleic acid encoding an IL-12A (p35), IL-12B (p40), IL-23 (p19), IL-12R β1, IL-12R β2, or IL-23R protein (e.g., specificity for an IL-12A (p35), IL-12B (p40), IL-23 (p19), IL-12R β1, IL-12R β2, or IL-23R mRNA, e.g., specificity for any one of SEQ ID NOs: 1-12). Ribozymes are catalytic RNA molecules with ribonuclease activity that are capable of cleaving a single-stranded nucleic acid, such as an mRNA, to which they have a complementary region. Thus, ribozymes (e.g., hammerhead ribozymes (described in Haselhoff and Gerlach, Nature 334:585-591, 1988)) can be used to catalytically cleave mRNA transcripts to thereby inhibit translation of the protein encoded by the mRNA. A ribozyme having specificity for an IL-12A (p35), IL-12B (p40), IL-23 (p19), IL-12R β1, IL-12R β2, or IL-23R mRNA can be designed based upon the nucleotide sequence of any of the IL-12A (p35), IL-12B (p40), IL-23 (p19), IL-12R β1, IL-12R β2, and IL-23R mRNA sequences disclosed herein. For example, a derivative of a Tetrahymena L-19 IVS RNA can be constructed in which the nucleotide sequence of the active site is complementary to the nucleotide sequence to be cleaved in an IL-12A (p35), IL-12B (p40), IL-23 (p19), IL-12R β1, IL-12R β2, or IL-23R mRNA (see, e.g., U.S. Pat. Nos. 4,987,071 and 5,116,742). Alternatively, an IL-12A (p35), IL-12B (p40), IL-23 (p19), IL-12R β1, IL-12R β2, or IL-23R mRNA can be used to select a catalytic RNA having a specific ribonuclease activity from a pool of RNA molecules. See, e.g., Bartel et al., *Science* 261:1411-1418, 1993.

An inhibitor nucleic acid can also be a nucleic acid molecule that forms triple helical structures. For example, expression of an IL-12A (p35), IL-12B (p40), IL-23 (p19), IL-12R β1, IL-12R β2, or IL-23R protein can be inhibited by targeting nucleotide sequences complementary to the regulatory region of the gene encoding the IL-12A (p35), IL-12B (p40), IL-23 (p19), IL-12R β1, IL-12R β2, or IL-23R protein (e.g., the promoter and/or enhancer, e.g., a sequence that is at least 1 kb, 2 kb, 3 kb, 4 kb, or 5 kb upstream of the transcription initiation start state) to form triple helical structures that prevent transcription of the gene in target cells. See generally Helene, *Anticancer Drug Des.* 6 (6): 569-84, 1991; Helene, *Ann. N.Y. Acad. Sci.* 660:27-36, 1992; and Maher, *Bioassays* 14 (12): 807-15, 1992.

In various embodiments, inhibitory nucleic acids can be modified at the base moiety, sugar moiety, or phosphate backbone to improve, e.g., the stability, hybridization, or solubility of the molecule. For example, the deoxyribose phosphate backbone of the nucleic acids can be modified to generate peptide nucleic acids (see, e.g., Hyrup et al., *Bioorganic Medicinal Chem.* 4 (1): 5-23, 1996). Peptide nucleic acids (PNAs) are nucleic acid mimics, e.g., DNA mimics, in which the deoxyribose phosphate backbone is replaced by a pseudopeptide backbone and only the four natural nucleobases are retained. The neutral backbone of PNAs allows for specific hybridization to DNA and RNA under conditions of low ionic strength. The synthesis of PNA oligomers can be performed using standard solid phase peptide synthesis protocols (see, e.g., Perry-O'Keefe et al., *Proc. Natl. Acad. Sci. U.S.A.* 93:14670-675, 1996). PNAs can be used as antisense or antigene agents for sequence-specific modulation of gene expression by, e.g., inducing transcription or translation arrest or inhibiting replication.

PNAs can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras can be generated which may combine the advantageous properties of PNA and DNA. Such chimeras allow DNA recognition enzymes, e.g., RNAse H and DNA polymerases, to interact with the DNA portion while the PNA portion would provide high binding affinity and specificity. PNA-DNA chimeras can be linked using linkers of appropriate lengths selected in terms of base stacking, number of bonds between the nucleobases, and orientation.

The synthesis of PNA-DNA chimeras can be performed as described in Finn et al., *Nucleic Acids Res.* 24:3357-63, 1996. For example, a DNA chain can be synthesized on a solid support using standard phosphoramidite coupling chemistry and modified nucleoside analogs. Compounds such as 5'-(4-methoxytrityl)amino-5'-deoxy-thymidine phosphoramidite can be used as a link between the PNA and the 5' end of DNA (Mag et al., *Nucleic Acids Res.* 17:5973-88, 1989). PNA monomers are then coupled in a stepwise manner to produce a chimeric molecule with a 5' PNA segment and a 3' DNA segment (Finn et al., *Nucleic Acids Res.* 24:3357-63, 1996). Alternatively, chimeric molecules can be synthesized with a 5' DNA segment and a 3' PNA segment (Peterser et al., *Bioorganic Med. Chem. Lett.* 5:1119-11124, 1975).

In some embodiments, the inhibitory nucleic acids can include other appended groups such as peptides, or agents facilitating transport across the cell membrane (see, Letsinger et al., *Proc. Natl. Acad. Sci. U.S.A.* 86:6553-6556, 1989; Lemaitre et al., *Proc. Natl. Acad. Sci. U.S.A.* 84:648-652, 1989; and WO 88/09810). In addition, the inhibitory nucleic acids can be modified with hybridization-triggered cleavage agents (see, e.g., Krol et al., *Bio/Techniques* 6:958-976, 1988) or intercalating agents (see, e.g., Zon, *Pharm. Res.* 5:539-549, 1988). To this end, the oligonucleotide may be conjugated to another molecule, e.g., a peptide, hybridization triggered cross-linking agent, transport agent, hybridization-triggered cleavage agent, etc.

Another means by which expression of an IL-12A (p35), IL-12B (p40), IL-23 (p19), IL-12R β1, IL-12R β2, or IL-23R mRNA can be decreased in a mammalian cell is by RNA interference (RNAi). RNAi is a process in which mRNA is degraded in host cells. To inhibit an mRNA, double-stranded RNA (dsRNA) corresponding to a portion of the gene to be silenced (e.g., a gene encoding an IL-12A (p35), IL-12B (p40), IL-23 (p19), IL-12R β1, IL-12R β2, or IL-23R protein) is introduced into a mammalian cell. The dsRNA is digested into 21-23 nucleotide-long duplexes called short interfering RNAs (or siRNAs), which bind to a nuclease complex to form what is known as the RNA-induced silencing complex (or RISC). The RISC targets the homologous transcript by base pairing interactions between one of the siRNA strands and the endogenous mRNA. It then cleaves the mRNA about 12 nucleotides from the 3' terminus of the siRNA (see Sharp et al., *Genes Dev.* 15:485-490, 2001, and Hammond et al., *Nature Rev. Gen.* 2:110-119, 2001).

RNA-mediated gene silencing can be induced in a mammalian cell in many ways, e.g., by enforcing endogenous expression of RNA hairpins (see, Paddison et al., *Proc. Natl. Acad. Sci. U.S.A.* 99:1443-1448, 2002) or, as noted above, by transfection of small (21-23 nt) dsRNA (reviewed in Caplen, *Trends Biotech.* 20:49-51, 2002). Methods for modulating gene expression with RNAi are described, e.g., in U.S. Pat. No. 6,506,559 and US 2003/0056235, which are hereby incorporated by reference.

Standard molecular biology techniques can be used to generate siRNAs. Short interfering RNAs can be chemically synthesized, recombinantly produced, e.g., by expressing RNA from a template DNA, such as a plasmid, or obtained from commercial vendors, such as Dharmacon. The RNA used to mediate RNAi can include synthetic or modified nucleotides, such as phosphorothioate nucleotides. Methods of transfecting cells with siRNA or with plasmids engineered to make siRNA are routine in the art.

The siRNA molecules used to decrease expression of an IL-12A (p35), IL-12B (p40), IL-23 (p19), IL-12R β1, IL-12R β2, or IL-23R mRNA can vary in a number of ways. For example, they can include a 3' hydroxyl group and strands of 21, 22, or 23 consecutive nucleotides. They can be blunt ended or include an overhanging end at either the 3' end, the 5' end, or both ends. For example, at least one strand of the RNA molecule can have a 3' overhang from about 1 to about 6 nucleotides (e.g., 1-5, 1-3, 2-4 or 3-5 nucleotides (whether pyrimidine or purine nucleotides) in length. Where both strands include an overhang, the length of the overhangs may be the same or different for each strand.

To further enhance the stability of the RNA duplexes, the 3' overhangs can be stabilized against degradation (by, e.g., including purine nucleotides, such as adenosine or guanosine nucleotides or replacing pyrimidine nucleotides by modified analogues (e.g., substitution of uridine 2-nucleotide 3' overhangs by 2'-deoxythymidine is tolerated and does not affect the efficiency of RNAi). Any siRNA can be used in the methods of decreasing IL-12A (p35), IL-12B (p40), IL-23 (p19), IL-12R β1, IL-12R β2, or IL-23R mRNA, provided it has sufficient homology to the target of interest (e.g., a sequence present in any one of SEQ ID NOs: 1-12, e.g., a target sequence encompassing the translation start site or the first exon of the mRNA). There is no upper limit on the length of the siRNA that can be used (e.g., the siRNA can range from about 21 base pairs of the gene to the full length of the gene or more (e.g., about 20 to about 30 base pairs, about 50 to about 60 base pairs, about 60 to about 70 base pairs, about 70 to about 80 base pairs, about 80 to about 90 base pairs, or about 90 to about 100 base pairs).

Non-limiting examples of siRNAs targeting IL-12A (p35), IL-12B (p40), IL-23 (p19), IL-12R β1, IL-12R β2, or IL-23R are described in Tan et al., *J. Alzheimers Dis.* 38 (3): 633-646, 2014; Niimi et al., *J. Neuroimmunol.* 254 (1-2): 39-45, 2013. Non-limiting examples of short hairpin RNA (shRNA) targeting IL-12A (p35), IL-12B (p40), IL-23 (p19), IL-12R β1, IL-12R β2, or IL-23R are described in Bak et al., *BMC Dermatol.* 11:5, 2011.

Non-limiting examples of inhibitory nucleic acids are microRNAs (e.g., microRNA-29 (Brain et al., *Immunity* 39 (3): 521-536, 2013), miR-10a (Xue et al., *J. Immunol.* 187 (11): 5879-5886, 2011), microRNA-155 (Podsiad et al., *Am. J. Physiol. Lung Cell Mol. Physiol.* 310 (5): L465-75, 2016).

In some embodiments, a therapeutically effective amount of an inhibitory nucleic acid targeting IL-12A (p35), IL-12B (p40), IL-23 (p19), IL-12R β1, IL-12R β2, or IL-23R can be administered to a subject (e.g., a human subject) in need thereof.

In some embodiments, the inhibitory nucleic acid can be about 10 nucleotides to about 40 nucleotides (e.g., about 10 to about 30 nucleotides, about 10 to about 25 nucleotides, about 10 to about 20 nucleotides, about 10 to about 15 nucleotides, 10 nucleotides, 11 nucleotides, 12 nucleotides, 13 nucleotides, 14 nucleotides, 15 nucleotides, 16 nucleotides, 17 nucleotides, 18 nucleotides, 19 nucleotides, 20 nucleotides, 21 nucleotides, 22 nucleotides, 23 nucleotides, 24 nucleotides, 25 nucleotides, 26 nucleotides, 27 nucleotides, 28 nucleotides, 29 nucleotides, 30 nucleotides, 31 nucleotides, 32 nucleotides, 33 nucleotides, 34 nucleotides, 35 nucleotides, 36 nucleotides, 37 nucleotides, 38 nucleotides, 39 nucleotides, or 40 nucleotides) in length. One skilled in the art will appreciate that inhibitory nucleic acids may comprise at least one modified nucleic acid at either the 5' or 3'end of DNA or RNA.

Any of the inhibitor nucleic acids described herein can be formulated for administration to the gastrointestinal tract. See, e.g., the formulation methods described in US 2016/0090598 and Schoellhammer et al., *Gastroenterology*, doi: 10.1053/j.gastro.2017.01.002, 2017.

As is known in the art, the term "thermal melting point (Tm)" refers to the temperature, under defined ionic strength, pH, and inhibitory nucleic acid concentration, at which 50% of the inhibitory nucleic acids complementary to the target sequence hybridize to the target sequence at equilibrium. In some embodiments, an inhibitory nucleic acid can bind specifically to a target nucleic acid under stringent conditions, e.g., those in which the salt concentration is at least about 0.01 to 1.0 M Na ion concentration (or other salts) at pH 7.0 to 8.3 and the temperature is at least about 30° C. for short oligonucleotides (e.g., 10 to 50 nucleotide). Stringent conditions can also be achieved with the addition of destabilizing agents such as formamide.

In some embodiments of any of the inhibitory nucleic acids described herein, the inhibitory nucleic acid binds to a target nucleic acid (e.g., a nucleic acid encoding any one of IL-12A (p35), IL-12B (p40), IL-23 (p19), IL-12R β1, IL-12R 2, or IL-23R) with a Tm of greater than 20° C., greater than 22° C., greater than 24° C., greater than 26° C., greater than 28° C., greater than 30° C., greater than 32° C., greater than 34° C., greater than 36° C., greater than 38° C., greater than 40° C., greater than 42° C., greater than 44° C., greater than 46° C., greater than 48° C., greater than 50° C., greater than 52° C., greater than 54° C., greater than 56° C., greater than 58° C., greater than 60° C., greater than 62° C., greater than 64° C., greater than 66° C., greater than 68° C., greater than 70° C., greater than 72° C., greater than 74° C., greater than 76° C., greater than 78° C., or greater than 80° C., e.g., as measured in phosphate buffered saline using a UV spectrophotometer.

In some embodiments of any of the inhibitor nucleic acids described herein, the inhibitory nucleic acid binds to a target nucleic acid (e.g., a nucleic acid encoding any one of IL-12A (p35), IL-12B (p40), IL-23 (p19), IL-12R β1, IL-12R β2, or IL-23R) with a Tm of about 20° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., about 30° C., about 28° C., about 26° C., about 24° C., or about 22° C. (inclusive); about 22° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., about 30° C., about 28° C., about 26° C., or about 24° C. (inclusive); about 24° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., about 30° C., about 28° C., or about 26° C. (inclusive); about 26° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., about 30° C., or about 28° C. (inclusive); about 28° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., or about 30° C. (inclusive); about 30° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., or about 32° C. (inclusive); about 32° C. to about 80° C., about 78° C., about 76° C., about 74° C., about 72° C., about 70° C., about 68° C., about 66° C., about 64° C., about 62°

C., about 60° C., about 58° C., about 56° C., about 54° C., about 52° C., about 50° C., about 48° C., about 46° C., about 44° C., about 42° C., about 40° C., about 38° C., about 36° C., or about 34° C. (inclusive); about 34° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., or about 36° C. (inclusive); about 36° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., or about 38° C. (inclusive); about 38° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., or about 40° C. (inclusive); about 40° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., or about 42° C. (inclusive); about 42° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., or about 44° C. (inclusive); about 44° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., or about 46° C. (inclusive); about 46° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., or about 48° C. (inclusive); about 48° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., or about 50° C. (inclusive); about 50° C. to about 80° C., about 78° C., about 76° C., about 74° C., about 72° C., about 70° C., about 68° C., about 66° C., about 64° C., about 62° C., about 60° C., about 58° C., about 56° C., or about 54° C. (inclusive); about 54° C. to about 80° C., about 78° C., about 76° C., about 74° C., about 72° C., about 70° C., about 68° C., about 66° C., about 64° C., about 62° C., about 60° C., about 58° C., or about 56° C. (inclusive); about 56° C. to about 80° C., about 78° C., about 76° C., about 74° C., about 72° C., about 70° C., about 68° C., about 66° C., about 64° C., about 62° C., about 60° C., or about 58° C. (inclusive); about 58° C. to about 80° C., about 78° C., about 76° C., about 74° C., about 72° C., about 70° C., about 68° C., about 66° C., about 64° C., about 62° C., or about 60° C. (inclusive); about 60° C. to about 80° C., about 78° C., about 76° C., about 74° C., about 72° C., about 70° C., about 68° C., about 66° C., about 64° C., or about 62° C. (inclusive); about 62° C. to about 80° C., about 78° C., about 76° C., about 74° C., about 72° C., about 70° C., about 68° C., about 66° C., or about 64° C. (inclusive); about 64° C. to about 80° C., about 78° C., about 76° C., about 74° C., about 72° C., about 70° C., about 68° C., or about 66° C. (inclusive); about 66° C. to about 80° C., about 78° C., about 76° C., about 74° C., about 72° C., about 70° C., or about 68° C. (inclusive); about 68° C. to about 80° C., about 78° C., about 76° C., about 74° C., about 72° C., or about 70° C. (inclusive); about 70° C. to about 80° C., about 78° C., about 76° C., about 74° C., or about 72° C. (inclusive); about 72° C. to about 80° C., about 78° C., about 76° C., or about 74° C. (inclusive); about 74° C. to about 80° C., about 78° C., or about 76° C. (inclusive); about 76° C. to about 80° C. or about 78° C. (inclusive); or about 78° C. to about 80° C. (inclusive), In some embodiments, the inhibitory nucleic acid can be formulated in a nanoparticle (e.g., a nanoparticle including one or more synthetic polymers, e.g., Patil et al., *Pharmaceutical Nanotechnol.* 367:195-203, 2009; Yang et al., *ACS Appl. Mater. Interfaces*, doi: 10.1021/acsami.6b16556, 2017; Perepelyuk et al., *Mol. Ther. Nucleic Acids* 6:259-268, 2017). In some embodiments, the nanoparticle can be a mucoadhesive particle (e.g., nanoparticles having a positively-charged exterior surface) (Andersen et al., *Methods Mol. Biol.* 555:77-86, 2009). In some embodiments, the nanoparticle can have a neutrally-charged exterior surface.

In some embodiments, the inhibitory nucleic acid can be formulated, e.g., as a liposome (Buyens et al., *J. Control Release* 158 (3): 362-370, 2012; Scarabel et al., *Expert Opin. Drug Deliv.* 17:1-14, 2017), a micelle (e.g., a mixed micelle) (Tangsangasaksri et al., *BioMacromolecules* 17:246-255, 2016; Wu et al., *Nanotechnology*, doi: 10.1088/1361-6528/aa6519, 2017), a microemulsion (WO 11/004395), a nanoemulsion, or a solid lipid nanoparticle (Sahay et al., *Nature Biotechnol.* 31:653-658, 2013; and Lin et al., *Nanomedicine* 9 (1): 105-120, 2014). Additional exemplary structural features of inhibitory nucleic acids and formulations of inhibitory nucleic acids are described in US 2016/0090598.

In some embodiments, a pharmaceutical composition can include a sterile saline solution and one or more inhibitory nucleic acid (e.g., any of the inhibitory nucleic acids described herein). In some examples, a pharmaceutical composition consists of a sterile saline solution and one or more inhibitory nucleic acid (e.g., any of the inhibitory nucleic acids described herein). In certain embodiments, the sterile saline is a pharmaceutical grade saline. In certain embodiments, a pharmaceutical composition can include one or more inhibitory nucleic acid (e.g., any of the inhibitory nucleic acids described herein) and sterile water. In certain embodiments, a pharmaceutical composition consists of one or more inhibitory nucleic acid (e.g., any of the inhibitory nucleic acids described herein) and sterile water. In certain embodiments, a pharmaceutical composition includes one or more inhibitory nucleic acid (e.g., any of the inhibitory nucleic acids described herein) and phosphate-buffered saline (PBS). In certain embodiments, a pharmaceutical composition consists of one or more inhibitory nucleic acids (e.g., any of the inhibitory nucleic acids described herein) and sterile phosphate-buffered saline (PBS). In some examples, the sterile saline is a pharmaceutical grade PBS.

In certain embodiments, one or more inhibitory nucleic acids (e.g., any of the inhibitory nucleic acids described herein) may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

Pharmaceutical compositions including one or more inhibitory nucleic acids encompass any pharmaceutically acceptable salts, esters, or salts of such esters. Non-limiting examples of pharmaceutical compositions include pharmaceutically acceptable salts of inhibitory nucleic acids. Suitable pharmaceutically acceptable salts include, but are not limited to, sodium and potassium salts.

Also provided herein are prodrugs that can include additional nucleosides at one or both ends of an inhibitory nucleic acid which are cleaved by endogenous nucleases within the body, to form the active inhibitory nucleic acid.

Lipid moieties can be used to formulate an inhibitory nucleic acid. In certain such methods, the inhibitory nucleic acid is introduced into preformed liposomes or lipoplexes made of mixtures of cationic lipids and neutral lipids. In certain methods, inhibitory nucleic acid complexes with mono- or poly-cationic lipids are formed without the presence of a neutral lipid. In certain embodiments, a lipid moiety is selected to increase distribution of an inhibitory nucleic acid to a particular cell or tissue in a mammal. In some examples, a lipid moiety is selected to increase distribution of an inhibitory nucleic acid to fat tissue in a mammal. In certain embodiments, a lipid moiety is selected to increase distribution of an inhibitory nucleic acid to muscle tissue.

In certain embodiments, pharmaceutical compositions provided herein comprise one or more inhibitory nucleic acid and one or more excipients. In certain such embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In some examples, a pharmaceutical composition provided herein includes liposomes and emulsions. Liposomes and emulsions can be used to formulate hydrophobic compounds. In some examples, certain organic solvents such as dimethylsulfoxide are used.

In some examples, a pharmaceutical composition provided herein includes one or more tissue-specific delivery molecules designed to deliver one or more inhibitory nucleic acids to specific tissues or cell types in a mammal. For example, a pharmaceutical composition can include liposomes coated with a tissue-specific antibody.

In some embodiments, a pharmaceutical composition provided herein can include a co-solvent system. Examples of such co-solvent systems include benzyl alcohol, a non-polar surfactant, a water-miscible organic polymer, and an aqueous phase. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. As can be appreciated, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In some examples, a pharmaceutical composition can be formulated for oral administration. In some examples, pharmaceutical compositions are formulated for buccal administration.

In some examples, a pharmaceutical composition is formulated for administration by injection (e.g., intravenous, subcutaneous, intramuscular, etc.). In some of these embodiments, a pharmaceutical composition includes a carrier and is formulated in aqueous solution, such as water or physiologically compatible buffers such as Hanks's solution, Ringer's solution, or physiological saline buffer. In some examples, other ingredients are included (e.g., ingredients that aid in solubility or serve as preservatives). In some examples, injectable suspensions are prepared using appropriate liquid carriers, suspending agents, and the like. Some pharmaceutical compositions for injection are formulated in unit dosage form, e.g., in ampoules or in multi-dose containers. Some pharmaceutical compositions for injection are suspensions, solutions, or emulsions in oily or aqueous vehicles, and may contain formulatory agents such as suspending, stabilizing, and/or dispersing agents. Solvents suitable for use in pharmaceutical compositions for injection include, but are not limited to, lipophilic solvents and fatty oils, such as sesame oil, synthetic fatty acid esters, such as ethyl oleate or triglycerides, and liposomes.

Antibodies

In some embodiments, the IL-12/IL-23 inhibitor is an antibody or an antigen-binding fragment thereof (e.g., a Fab or a scFv). In some embodiments, an antibody or antigen-binding fragment described herein binds specifically to any one of IL-12A (p35), IL-12B (p40), IL-23 (p19), IL-12R β1, IL-12R β2, or IL-23R, or a combination thereof.

In some embodiments, the antibody can be a humanized antibody, a chimeric antibody, a multivalent antibody, or a fragment thereof. In some embodiments, an antibody can be a scFv-Fc, a $V_H$H domain, a $V_{NAR}$ domain, a (scFv) 2, a minibody, or a BITE. In some embodiments, an antibody can be a DVD-Ig, and a dual-affinity re-targeting antibody (DART), a triomab, kih IgG with a common LC, a crossmab, an ortho-Fab IgG, a 2-in-1-IgG, IgG-ScFv, scFv2-Fc, a bi-nanobody, tanden antibody, a DART-Fc, a scFv-HAS-scFv, DNL-Fab3, DAF (two-in-one or four-in-one), Duta-Mab, DT-IgG, knobs-in-holes common LC, knobs-in-holes assembly, charge pair antibody, Fab-arm exchange antibody, SEEDbody, Triomab, LUZ-Y, Fcab, kλ-body, orthogonal Fab, DVD-IgG, IgG (H)-scFv, scFv-(H) IgG, IgG (L)-scFv, scFv-(L)-IgG, IgG (L,H)-Fc, IgG (H)-V, V (H)-IgG, IgG (L)-V, V (L)-IgG, KIH IgG-scFab, 2scFv-IgG, IgG-2scFv, scFv4-Ig, Zybody, DVI-IgG, nanobody, nanobody-HSA, a diabody, a TandAb, scDiabody, scDiabody-CH3, Diabody-CH3, Triple Body, miniantibody, minibody, TriBi minibody, scFv-CH3 KIH, Fab-scFv, scFv-CH-CL-scFv, F(ab')2-scFV2, scFv-KIH, Fab-scFv-Fc, tetravalent HCAb, scDiabody-Fc, diabody-Fc, tandem scFv-Fc, intrabody, dock and lock bispecific antibody, ImmTAC, HSAbody, scDiabody-HAS, tandem scFv, IgG-IgG, Cov-X-Body, and scFv1-PEG-scFv2.

Non-limiting examples of an antigen-binding fragment of an antibody include an Fv fragment, a Fab fragment, a F(ab')$_2$ fragment, and a Fab' fragment. Additional examples of an antigen-binding fragment of an antibody is an antigen-binding fragment of an IgG (e.g., an antigen-binding fragment of IgG1, IgG2, IgG3, or IgG4) (e.g., an antigen-binding fragment of a human or humanized IgG, e.g., human or humanized IgG1, IgG2, IgG3, or IgG4); an antigen-binding fragment of an IgA (e.g., an antigen-binding fragment of IgA1 or IgA2) (e.g., an antigen-binding fragment of a human or humanized IgA, e.g., a human or humanized IgA1 or IgA2); an antigen-binding fragment of an IgD (e.g., an antigen-binding fragment of a human or humanized IgD); an antigen-binding fragment of an IgE (e.g., an antigen-binding fragment of a human or humanized IgE); or an antigen-binding fragment of an IgM (e.g., an antigen-binding fragment of a human or humanized IgM).

In some embodiments, the antibody is a humanized antibody, a chimeric antibody, a multivalent antibody, or a fragment thereof. In some embodiments, the antibody is a monoclonal antibody. In some embodiments, the antibody is a humanized monoclonal antibody. See e.g., Hunter & Jones, *Nat. Immunol.* 16:448-457, 2015; Heo et al., *Oncotarget* 7 (13): 15460-15473, 2016. Additional examples of antibodies and antigen-binding fragments thereof are described in U.S. Pat. Nos. 8,440,196; 7,842,144; 8,034,344; and 8,529,895; US 2013/0317203; US 2014/0322239; US 2015/0166666; US 2016/0152714; and US 2017/0002082, each of which is incorporated by reference in its entirety.

In some embodiments, the antibody is ustekinumab (CNTO 1275, Stelara®) or a variant thereof (Krueger et al., *N. Engl. J. Med.* 356 (6): 580-592, 2007; Kauffman et al., *J. Invest. Dermatol.* 123 (6): 1037-1044, 2004; Gottlieb et al., *Curr. Med. Res. Opin.* 23 (5): 1081-1092, 2007; Leonardi et al., *Lancet* 371 (9625): 1665-1674, 2008; Papp et al., *Lancet* 371 (9625): 1675-1684, 2008). In some embodiments, the antibody is briakinumab (ABT-874, J-695) or a variant thereof (Gordon et al., *J. Invest. Dermatol.* 132 (2): 304-314, 2012; Kimball et al., *Arch Dermatol.* 144 (2): 200-207, 2008).

In some embodiments, the antibody is guselkumab (CNTO-1959) (Callis-Duffin et al., *J. Am. Acad. Dermatol.* 70 (5 Suppl 1), 2014); AB162 (Sofen et al., *J. Allergy Clin. Immunol.* 133:1032-40, 2014); tildrakizumab (MK-3222, SCH900222) (Papp et al. (2015) *Br. J. Dermatol.* 2015); Langley et al., *Oral Presentation at: American Academy of Dermatology*, March 21-25, Denver CO, 2014); AMG 139 (MEDI2070, brazikumab) (Gomollon, Gastroenterol. Hepatol. 38 (Suppl. 1): 13-19, 2015; Kock et al., *Br. J. Pharmacol.* 172 (1): 159-172, 2015); FM-202 (Tang et al., *Immunology* 135 (2): 112-124, 2012); FM-303 (Tang et al., *Immunology* 135 (2): 112-124, 2012); ADC-1012 (Tang et al., *Immunology* 135 (2): 112-124, 2012); LY-2525623 (Gaffen et al., *Nat. Rev. Immunol.* 14:585-600, 2014; Sands, Gastroenterol. Hepatol. 12 (12): 784-786, 2016), LY-3074828 (Coskun et al., *Trends Pharmacol. Sci.* 38 (2): 127-142, 2017), BI-655066 (risankizumab) (Singh et al., *MAbs* 7 (4): 778-791, 2015; Krueger et al., *J. Allergy Clin. Immunol.* 136 (1): 116-124, 2015) or a variant thereof.

See e.g., Tang et al., *Immunology* 135 (2): 112-124, 2012. Further teachings of IL-12/IL-23 antibodies and antigen-binding fragments thereof are described in U.S. Pat. Nos. 6,902,734; 7,247,711; 7,252,971; and 7,491,391; US 2012/0288494; and US 2013/0302343, each of which is incorporated by reference in its entirety.

In some embodiments, the IL-12/IL-23 inhibitor is PTG-200, an IL-23R inhibitor currently in preclinical development by Protagonist Therapeutics.

In some embodiments, the IL-12/IL-23 inhibitor is Mirikizumab (LY 3074828), an IL-23R inhibitor currently in clinical development (Phase II) by Eli Lilly. In some embodiments, any of the antibodies or antigen-binding fragments described herein has a dissociation constant ($K_D$) of less than $1 \times 10^{-5}$ M (e.g., less than $0.5 \times 10^{-5}$ M, less than $1 \times 10^{-6}$ M, less than $0.5 \times 10^{-6}$ M, less than $1 \times 10^{-7}$ M, less than $0.5 \times 10^{-7}$ M, less than $1 \times 10^{-8}$ M, less than $0.5 \times 10^{-8}$ M, less than $1 \times 10^{-9}$ M, less than $0.5 \times 10^{-9}$ M, less than $1 \times 10^{-10}$ M, less than $0.5 \times 10^{-10}$ M, less than $1 \times 10^{-11}$ M, less than $0.5 \times 10^{-11}$ M, or less than $1 \times 10^{-12}$ M), e.g., as measured in phosphate buffered saline using surface plasmon resonance (SPR).

In some embodiments, any of the antibodies or antigen-binding fragments described herein has a $K_D$ of about $1 \times 10^{-12}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$ M, about $0.5 \times 10^{-9}$ M, about $1 \times 10^{-10}$ M, about $0.5 \times 10^{-10}$ M, about $1 \times 10^{-11}$ M, or about $0.5 \times 10^{-11}$ M (inclusive); about $0.5 \times 10^{-11}$ M to about $1 \times 10^{-5}$ M, about $0.5 \times 10^{5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$M, about $0.5 \times 10^{-9}$ M, about $1 \times 10^{-10}$M, about $0.5 \times 10^{-10}$ M, or about $1 \times 10^{-11}$ M (inclusive); about $1 \times 10^{-11}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$M, about $0.5 \times 10^{-7}$ M, about $1 \times 10^{-8}$ M, about $0.5 \times 10^{-8}$ M, about $1 \times 10^{-9}$M, about $0.5 \times 10^{-9}$ M, about $1 \times 10^{-10}$ M, or about $0.5 \times 10^{-10}$ M (inclusive); about $0.5 \times 10^{-10}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$M, about $0.5 \times 10^{-7}$ M, about $1 \times 10^{-8}$ M, about $0.5 \times 10^{-8}$ M, about $1 \times 10^{-9}$ M, about $0.5 \times 10^{-9}$ M, or about $1 \times 10^{-10}$M (inclusive); about $1 \times 10^{-10}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$M, about $0.5 \times 10^{-7}$ M, about $1 \times 10^{-8}$ M, about $0.5 \times 10^{-8}$ M, about $1 \times 10^{-9}$M, or about $0.5 \times 10^{-9}$ M (inclusive); about $0.5 \times 10^{-9}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$M, about $0.5 \times 10^{-7}$ M, about $1 \times 10^{-8}$ M, about $0.5 \times 10^{-8}$ M, or about $1 \times 10^{-9}$M (inclusive); about $1 \times 10^{-9}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$M, about $0.5 \times 10^{-7}$ M, about $1 \times 10^{-8}$ M, or about $0.5 \times 10^{-8}$ M (inclusive); about $0.5 \times 10^{-8}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$M, about $0.5 \times 10^{-7}$ M, or about $1 \times 10^{-8}$ M (inclusive); about $1 \times 10^{-8}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, or about $0.5 \times 10^{-7}$ M (inclusive); about $0.5 \times 10^{-7}$ M to about $1 \times 10^{-5}$ M, about $0.5 \times 10^{-5}$ M, about $1 \times 10^{-6}$ M, about $0.5 \times 10^{-6}$ M, or about $1 \times 10^{-7}$M (inclusive); about $1 \times 10^{-7}$ M to about $1 \times 10^{-5}$ M, about $0.5 \times 10^{-5}$ M, about $1 \times 10^{-6}$ M, or about $0.5 \times 10^{-6}$ M (inclusive); about $0.5 \times 10^{-6}$ M to about $1 \times 10^{-5}$ M, about $0.5 \times 10^{-5}$ M, or about $1 \times 10^{-6}$ M (inclusive); about $1 \times 10^{-6}$ M to about $1 \times 10^{-5}$ M or about $0.5 \times 10^{-5}$ M (inclusive); or about $0.5 \times 10^{-5}$ M to about $1 \times 10^{-5}$ M (inclusive), e.g., as measured in phosphate buffered saline using surface plasmon resonance (SPR).

In some embodiments, any of the antibodies or antigen-binding fragments described herein has a $K_{off}$ of about $1 \times 10^{-6}$ s$^{-1}$ to about $1 \times 10^{-3}$ s$^{-1}$, about $0.5 \times 10^{-3}$ s$^{-1}$, about $1 \times 10^{-4}$ s$^{-1}$, about $0.5 \times 10^{-4}$ s$^{-1}$, about $1 \times 10^{-5}$ s$^{-1}$, or about $0.5 \times 10^{-5}$ s$^{-1}$ (inclusive); about $0.5 \times 10^{-5}$ s$^{-1}$ to about $1 \times 10^{-3}$ s$^{-1}$, about $0.5 \times 10^{-3}$ s$^{-1}$, about $1 \times 10^{-4}$ s$^{-1}$, about $0.5 \times 10^{-4}$ s$^{-1}$, or about $1 \times 10^{-5}$ s$^{-1}$ (inclusive); about $1 \times 10^{-5}$ s$^{-1}$ to about $1 \times 10^{-3}$ s$^{-1}$, about $0.5 \times 10^{-3}$ s$^{-1}$, about $1 \times 10^{-4}$ s$^{-1}$, or about $0.5 \times 10^{-4}$ s$^{-1}$ (inclusive); about $0.5 \times 10^{-4}$ s$^{-1}$ to about $1 \times 10^{-3}$ s$^{-1}$, about $0.5 \times 10^{-3}$ s$^{-1}$, or about $1 \times 10^{-4}$ s$^{-1}$ (inclusive); about $1 \times 10^{-4}$ s$^{-1}$ to about $1 \times 10^{-3}$ s$^{-1}$, or about $0.5 \times 10^{-3}$ s$^{-1}$ (inclusive); or about $0.5 \times 10^{-5}$ s$^{-1}$ to about $1 \times 10^{-3}$ s$^{-1}$ (inclusive), e.g., as measured in phosphate buffered saline using surface plasmon resonance (SPR).

In some embodiments, any of the antibodies or antigen-binding fragments described herein has a $K_{on}$ of about $1 \times 10^{2}$ M$^{-1}$s$^{-1}$ to about $1 \times 10^{6}$ M$^{-1}$s$^{-1}$, about $0.5 \times 10^{6}$ M$^{-1}$s$^{-1}$, about $1 \times 10^{5}$ M$^{-1}$s$^{-1}$, about $0.5 \times 10^{5}$ M$^{-1}$s$^{-1}$, about $1 \times 10^{4}$ M$^{-1}$s$^{-1}$, about $0.5 \times 10^{4}$ M$^{-1}$s$^{-1}$, about $1 \times 10^{3}$ M$^{-1}$s$^{-1}$, or about $0.5 \times 10^{3}$ M$^{-1}$s$^{-1}$ (inclusive); about $0.5 \times 10^{3}$ M$^{-1}$s$^{-1}$ to about $1 \times 10^{6}$ M$^{-1}$s$^{-1}$, about $0.5 \times 10^{6}$ M$^{-1}$s$^{-1}$, about $1 \times 10^{5}$ M$^{-1}$s$^{-1}$, about $0.5 \times 10^{5}$ M$^{-1}$s$^{-1}$, about $1 \times 10^{4}$ M$^{-1}$s$^{-1}$, about $0.5 \times 10^{4}$ M$^{-1}$s$^{-1}$, or about $1 \times 10^{3}$ M$^{-1}$s$^{-1}$ (inclusive); about $1 \times 10^{3}$ M$^{-1}$s$^{-1}$ to about $1 \times 10^{6}$ M$^{-1}$s$^{-1}$, about $0.5 \times 10^{6}$ M$^{-1}$s$^{-1}$, about $1 \times 10^{5}$ M$^{-1}$s$^{-1}$, about $0.5 \times 10^{5}$ M$^{-1}$s$^{-1}$, about $1 \times 10^{4}$ M$^{-1}$s$^{-1}$, or about $0.5 \times 10^4$ $M^{-1}s^{-1}$ (inclusive); about $0.5 \times 10^4$ $M^{-1}s^{-1}$ to about $1 \times 10^6$ $M^{-1}s^{-1}$, about $0.5 \times 10^6$ $M^{-1}s^{-1}$, about $1 \times 10^5$ $M^{-1}s^{-1}$, about $0.5 \times 10^5$ $M^{-1}s^{-1}$, or about $1 \times 10^4$ $M^{-1}s^{-1}$ (inclusive); about $1 \times 10^4$ $M^{-1}s^{-1}$ to about $1 \times 10^6$ $M^{-1}s^{-1}$, about $0.5 \times 10^6$ $M^{-1}s^{-1}$, about $1 \times 10^5$ $M^{-1}s^{-1}$, or about $0.5 \times 10^5$ $M^{-1}s^{-1}$ (inclusive); about $0.5 \times 10^5$ $M^{-1}s^{-1}$ to about $1 \times 10^6$ $M^{-1}s^{-1}$, about $0.5 \times 10^6$ $M^{-1}s^{-1}$, or about $1 \times 10^5$ $M^{-1}s^{-1}$ (inclusive); about $1 \times 10^5$ $M^{-1}s^{-1}$ to about $1 \times 10^6$ $M^{-1}s^{-1}$, or about $0.5 \times 10^6$ $M^{-1}s^{-1}$ (inclusive); or about $0.5 \times 10^6$ $M^{-1}s^{-1}$ to about $1 \times 10^6$ $M^{-1}s^{-1}$ (inclusive), e.g., as measured in phosphate buffered saline using surface plasmon resonance (SPR).

Fusion Protein Inhibitors of IL-12/IL-23

In some embodiments, the IL-12/IL-23 inhibitor is a fusion protein, a soluble antagonist, or an antimicrobial peptide. In some embodiments, the fusion protein comprises a soluble fragment of a receptor of IL-12 or a soluble fragment of a receptor of IL-23. In some embodiments, the fusion protein comprises an extracellular domain of a receptor of IL-12 or an extracellular domain of a receptor of IL-23.

In some embodiments, the fusion protein is adnectin or a variant thereof (Tang et al., *Immunology* 135 (2): 112-124, 2012). In some embodiments, the soluble antagonist is a human IL-23Ra-chain mRNA transcript (Raymond et al., *J. Immunol.* 185 (12): 7302-7308, 2010). In some embodiments, the IL-12/IL-23 is an antimicrobial peptide (e.g., MP-196 (Wenzel et al., *PNAS* 111 (14): E1409-E1418, 2014)).

Small Molecule Inhibitors of IL-12/IL-23

In some embodiments, the IL-12/IL-23 inhibitor is a small molecule. In some embodiments, the small molecule is STA-5326 (apilimod) or a variant thereof (Keino et al., *Arthritis Res. Ther.* 10: R122, 2008; Wada et al., *Blood* 109 (3): 1156-1164, 2007; Sands et al., *Inflamm. Bowel Dis.* 16 (7): 1209-1218, 2010).

TNFα Inhibitors

The term "TNFα inhibitor" refers to an agent which directly or indirectly inhibits, impairs, reduces, down-regulates, or blocks TNFα activity and/or expression. As used herein, "TNF" is interchangeable with the terms "TNF-alpha" and "TNF-α" and the term "TNF inhibitor," as used herein, is interchangeable with the term "anti-TNF agent." In some embodiments, a TNFα inhibitor is an inhibitory nucleic acid, an antibody or an antigen-binding fragment thereof, a fusion protein, a soluble TNFα receptor (a soluble TNFR1 or a soluble TNFR2), or a small molecule TNFα antagonist. In some embodiments, the inhibitory nucleic acid is a ribozyme, small hairpin RNA, a small interfering RNA, an antisense nucleic acid, or an aptamer.

Exemplary TNFα inhibitors that directly inhibit, impair, reduce, down-regulate, or block TNFα activity and/or expression can, e.g., inhibit or reduce binding of TNFα to its receptor (TNFR1 and/or TNFR2) and/or inhibit or decrease the expression level of TNFα or a receptor of TNFα (TNFR1 or TNFR2) in a cell (e.g., a mammalian cell). Non-limiting examples of TNFα inhibitors that directly inhibit, impair, reduce, down-regulate, or block TNFα activity and/or expression include inhibitory nucleic acids (e.g., any of the examples of inhibitory nucleic acids described herein), an antibody or fragment thereof, a fusion protein, a soluble TNFα receptor (e.g., a soluble TNFR1 or soluble TNFR2), and a small molecule TNFα antagonist.

Exemplary TNFα inhibitors that can indirectly inhibit, impair, reduce, down-regulate, or block TNFα activity and/or expression can, e.g., inhibit or decrease the level of downstream signaling of a TNFα receptor (e.g., TNFR1 or TNFR2) in a mammalian cell (e.g., decrease the level and/or activity of one or more of the following signaling proteins: TRADD, TRAF2, MEKK1/4, MEKK4/7, JNK, AP-1, ASK1, RIP, MEKK 3/6, MAPK, NIK, IKK, and NF-κB in a mammalian cell), and/or decrease the level of TNFα-induced gene expression in a mammalian cell (e.g., decrease the transcription of genes regulated by, e.g., one or more transcription factors selected from the group of NF-κB, c-Jun, and ATF2). A description of downstream signaling of a TNFα receptor is provided in Wajant et al., *Cell Death Differentiation* 10:45-65, 2003 (incorporated herein by reference). For example, such indirect TNFα inhibitors can be an inhibitory nucleic acid that targets (decreases the expression) a signaling component downstream of a TNFα receptor (e.g., any one or more of the signaling components downstream of a TNFα receptor described herein or known in the art), a TNFα-induced gene (e.g., any TNFα-induced gene known in the art), or a transcription factor selected from the group of NF-κB, c-Jun, and ATF2.

In other examples, such indirect TNFα inhibitors can be a small molecule inhibitor of a signaling component downstream of a TNFα receptor (e.g., any of the signaling components downstream of a TNFα receptor described herein or known in the art), a small molecule inhibitor of a protein encoded by a TNFα-induced gene (e.g., any protein encoded by a TNFα-induced gene known in the art), and a small molecule inhibitor of a transcription factor selected from the group of NF-κB, c-Jun, and ATF2.

In other embodiments, TNFα inhibitors that can indirectly inhibit, impair, reduce, down-regulate, or block one or more components in a mammalian cell (e.g., a macrophage, a CD4+ lymphocyte, a NK cell, a neutrophil, a mast cell, a eosinophil, or a neuron) that are involved in the signaling pathway that results in TNFα mRNA transcription, TNFα mRNA stabilization, and TNFα mRNA translation (e.g., one or more components selected from the group of CD14, MyD88, IRAK, lipopolysaccharide binding protein (LBP), TRAF6, ras, raf, MEK1/2, ERK1/2, NIK, IKK, IκB, NF-κB, rac, MEK4/7, JNK, c-jun, MEK3/6, p38, PKR, TTP, and MK2). For example, such indirect TNFα inhibitors can be an inhibitory nucleic acid that targets (decreases the expression) of a component in a mammalian cell that is involved in the signaling pathway that results in TNFα mRNA transcription, TNFα mRNA stabilization, and TNFα mRNA translation (e.g., a component selected from the group of CD14, MyD88, IRAK, lipopolysaccharide binding protein (LBP), TRAF6, ras, raf, MEK1/2, ERK1/2, NIK, IKK, IκB, NF-κB, rac, MEK4/7, JNK, c-jun, MEK3/6, p38, PKR, TTP, and MK2). In other examples, an indirect TNFα inhibitors is a small molecule inhibitor of a component in a mammalian cell that is involved in the signaling pathway that results in TNFα mRNA transcription, TNFα mRNA stabilization, and TNFα mRNA translation (e.g., a component selected from the group of CD14, MyD88, IRAK, lipopolysaccharide binding protein (LBP), TRAF6, ras, raf, MEK1/2, ERK1/2, NIK, IKK, IκB, NF-κB, rac, MEK4/7, JNK, c-jun, MEK3/6, p38, PKR, TTP, and MK2).

Inhibitory Nucleic Acids

Inhibitory nucleic acids that can decrease the expression of TNFα, TNFR1, TNFR2, TRADD, TRAF2, MEKK1/4, MEKK4/7, JNK, AP-1, ASK1, RIP, MEKK 3/6, MAPK, NIK, IKK, NF-κB, CD14, MyD88, IRAK, lipopolysaccharide binding protein (LBP), TRAF6, ras, raf, MEK1/2, ERK1/2, NIK, IKK, IκB, NF-κB, rac, MEK4/7, JNK, c-jun, MEK3/6, p38, PKR, TTP, or MK2 mRNA expression in a mammalian cell include antisense nucleic acid molecules, i.e., nucleic acid molecules whose nucleotide sequence is complementary to all or part of a TNFα, TNFR1, TNFR2, TRADD, TRAF2, MEKK1/4, MEKK4/7, JNK, AP-1, ASK1, RIP, MEKK 3/6, MAPK, NIK, IKK, NF-κB, CD14, MyD88, IRAK, lipopolysaccharide binding protein (LBP), TRAF6, ras, raf, MEK1/2, ERK1/2, NIK, IKK, IκB, NF-κB, rac, MEK4/7, JNK, c-jun, MEK3/6, p38, PKR, TTP, or MK2 mRNA (e.g., complementary to all or a part of any one of SEQ ID NOs: 13-49).

Human TNFα CDS
(SEQ ID NO: 13)
ATGAGCACTGAAAGCATGATCCGGGACGTGGAGCTGGCCGAGGAGGCGCTCCCCAAGAA
GACAGGGGGGCCCCAGGGCTCCAGGCGGTGCTTGTTCCTCAGCCTCTTCTCCTTCCTGAT
CGTGGCAGGCGCCACCACGCTCTTCTGCCTGCTGCACTTTGGAGTGATCGGCCCCCAGAG
GGAAGAGTTCCCCAGGGACCTCTCTCTAATCAGCCCTCTGGCCCAGGCAGTCAGATCATC
TTCTCGAACCCCGAGTGACAAGCCTGTAGCCCATGTTGTAGCAAACCCTCAAGCTGAGGG
GCAGCTCCAGTGGCTGAACCGCCGGGCCAATGCCCTCCTGGCCAATGGCGTGGAGCTGAG
AGATAACCAGCTGGTGGTGCCATCAGAGGGCCTGTACCTCATCTACTCCCAGGTCCTCTTC
AAGGGCCAAGGCTGCCCCTCCACCCATGTGCTCCTCACCCACACCATCAGCCGCATCGCC
GTCTCCTACCAGACCAAGGTCAACCTCCTCTCTGCCATCAAGAGCCCCTGCCAGAGGGAG
ACCCCAGAGGGGGCTGAGGCCAAGCCCTGGTATGAGCCCATCTATCTGGGAGGGGTCTTC
CAGCTGGAGAAGGGTGACCGACTCAGCGCTGAGATCAATCGGCCCGACTATCTCGACTTT
GCCGAGTCTGGGCAGGTCTACTTTGGGATCATTGCCCTGTGA
Human TNFR1 CDS
(SEQ ID NO: 14)
ATGGGCCTCTCCACCGTGCCTGACCTGCTGCTGCCGCTGGTGCTCCTGGAGCTGTTGGTG
GGAATATACCCCTCAGGGGTTATTGGACTGGTCCCTCACCTAGGGGACAGGGAGAAGAGA
GATAGTGTGTGTCCCCAAGGAAAATATATCCACCCTCAAAATAATTCGATTTGCTGTACCAA
GTGCCACAAAGGAACCTACTTGTACAATGACTGTCCAGGCCCGGGGCAGGATACGGACTG
CAGGGAGTGTGAGAGCGGCTCCTTCACCGCTTCAGAAAACCACCTCAGACACTGCCTCA
GCTGCTCCAAATGCCGAAAGGAAATGGGTCAGGTGGAGATCTCTTCTTGCACAGTGGACC
GGGACACCGTGTGTGGCTGCAGGAAGAACCAGTACCGGCATTATTGGAGTGAAAACCTTT
TCCAGTGCTTCAATTGCAGCCTCTGCCTCAATGGGACCGTGCACCTCTCCTGCCAGGAGA
AACAGAACACCGTGTGCACCTGCCATGCAGGTTTCTTTCTAAGAGAAAACGAGTGTGTCT
CCTGTAGTAACTGTAAGAAAAGCCTGGAGTGCACGAAGTTGTGCCTACCCCAGATTGAGA
ATGTTAAGGGCACTGAGGACTCAGGCACCACAGTGCTGTTGCCCCTGGTCATTTTCTTTGG
TCTTTGCCTTTTATCCCTCCTCTTCATTGGTTTAATGTATCGCTACCAACGGTGGAAGTCCA
AGCTCTACTCCATTGTTTGTGGGAAATCGACACCTGAAAAAGAGGGGAGCTTGAAGGA
ACTACTACTAAGCCCCTGGCCCCAAACCCAAGCTTCAGTCCCACTCCAGGCTTCACCCCC
ACCCTGGGCTTCAGTCCCGTGCCCAGTTCCACCTTCACCTCCAGCTCCACCTATACCCCCG
GTGACTGTCCCAACTTTGCGGCTCCCCGCAGAGAGGTGGCACCACCCTATCAGGGGCTG
ACCCCATCCTTGCGACAGCCCTCGCCTCCGACCCCATCCCCAACCCCCTTCAGAAGTGGG
AGGACAGCGCCCACAAGCCACAGAGCCTAGACACTGATGACCCCGCGACGCTGTACGCC
GTGGTGGAGAACGTGCCCCCGTTGCGCTGGAAGGAATTCGTGCGGCGCCTAGGGCTGAG
CGACCACGAGATCGATCGGCTGGAGCTGCAGAACGGGCGCTGCCTGCGCGAGGCGCAAT
ACAGCATGCTGGCGACCTGGAGGCGGCGCACGCCGCGGCGCGAGGCCACGCTGGAGCTG
CTGGGACGCGTGCTCCGCGACATGGACCTGCTGGGCTGCCTGGAGGACATCGAGGAGGC
GCTTTGCGGCCCCGCCGCCCTCCCGCCCGCGCCCAGTCTTCTCAGATGA
Human TNFR2 CDS
(SEQ ID NO: 15)
ATGGCGCCCGTCGCCGTCTGGGCCGCGCTGGCCGTCGGACTGGAGCTCTGGGCTGCGGCG
CACGCCTTGCCCGCCCAGGTGGCATTTACACCCTACGCCCCGGAGCCCGGGAGCACATGC
CGGCTCAGAGAATACTATGACCAGACAGCTCAGATGTGCTGCAGCAAATGCTCGCCGGGC

```
CAACATGCAAAAGTCTTCTGTACCAAGACCTCGGACACCGTGTGTGACTCCTGTGAGGAC

AGCACATACACCCAGCTCTGGAACTGGGTTCCCGAGTGCTTGAGCTGTGGCTCCCGCTGT

AGCTCTGACCAGGTGGAAACTCAAGCCTGCACTCGGGAACAGAACCGCATCTGCACCTG

CAGGCCCGGCTGGTACTGCGCGCTGAGCAAGCAGGAGGGGTGCCGGCTGTGCGCGCCGC

TGCGCAAGTGCCGCCCGGGCTTCGGCGTGGCCAGACCAGGAACTGAAACATCAGACGTG

GTGTGCAAGCCCTGTGCCCCGGGGACGTTCTCCAACACGACTTCATCCACGGATATTTGCA

GGCCCCACCAGATCTGTAACGTGGTGGCCATCCCTGGGAATGCAAGCATGGATGCAGTCT

GCACGTCCACGTCCCCACCCGGAGTATGGCCCCAGGGGCAGTACACTTACCCCAGCCAG

TGTCCACACGATCCCAACACACGCAGCCAACTCCAGAACCCAGCACTGCTCCAAGCACCT

CCTTCCTGCTCCCAATGGGCCCCAGCCCCCAGCTGAAGGGAGCACTGGCGACTTCGCTC

TTCCAGTTGGACTGATTGTGGGTGTGACAGCCTTGGGTCTACTAATAATAGGAGTGGTGAA

CTGTGTCATCATGACCCAGGTGAAAAAGAAGCCCTTGTGCCTGCAGAGAGAAGCCAAGG

TGCCTCACTTGCCTGCCGATAAGGCCCGGGGTACACAGGGCCCCGAGCAGCAGCACCTGC

TGATCACAGCGCCGAGCTCCAGCAGCAGCTCCCTGGAGAGCTCGGCCAGTGCGTTGGAC

AGAAGGGCGCCCACTCGGAACCAGCCACAGGCACCAGGCGTGGAGGCCAGTGGGGCCG

GGGAGGCCCGGGCCAGCACCGGGAGCTCAGATTCTTCCCCTGGTGGCCATGGGACCCAG

GTCAATGTCACCTGCATCGTGAACGTCTGTAGCAGCTCTGACCACAGCTCACAGTGCTCCT

CCCAAGCCAGCTCCACAATGGGAGACACAGATTCCAGCCCCTCGGAGTCCCCGAAGGAC

GAGCAGGTCCCCTTCTCCAAGGAGGAATGTGCCTTTCGGTCACAGCTGGAGACGCCAGA

GACCCTGCTGGGAGCACCGAAGAGAAGCCCCTGCCCCTTGGAGTGCCTGATGCTGGGAT

GAAGCCCAGTTAA
Human TRADD CDS
                                                          (SEQ ID NO: 16)
ATGGCAGCTGGGCAAAATGGGCACGAAGAGTGGGTGGGCAGCGCATACCTGTTTGTGGA

GTCCTCGCTGGACAAGGTGGTCCTGTCGGATGCCTACGCGCACCCCCAGCAGAAGGTGGC

AGTGTACAGGGCTCTGCAGGCTGCCTTGGCAGAGAGCGGCGGGAGCCCGGACGTGCTGC

AGATGCTGAAGATCCACCGCAGCGACCCGCAGCTGATCGTGCAGCTGCGATTCTGCGGGC

GGCAGCCCTGTGGCCGCTTCCTCCGCGCCTACCGCGAGGGGGCGCTGCGCGCCGCGCTGC

AGAGGAGCCTGGCGGCCGCGCTCGCCCAGCACTCGGTGCCGCTGCAACTGGAGCTGCGC

GCCGGCGCCGAGCGGCTGGACGCTTTGCTGGCGGACGAGGAGCGCTGTTTGAGTTGCATC

CTAGCCCAGCAGCCCGACCGGCTCCGGGATGAAGAACTGGCTGAGCTGGAGGATGCGCT

GCGAAATCTGAAGTGCGGCTCGGGGGCCCGGGTGGCGACGGGGAGGTCGCTTCGGCCC

CCTTGCAGCCCCGGTGCCCTCTCTGTCGGAGGTGAAGCCGCCGCCGCCGCCGCCACCTG

CCCAGACTTTTCTGTTCCAGGGTCAGCCTGTAGTGAATCGGCCGCTGAGCCTGAAGGACC

AACAGACGTTCGCGCGCTCTGTGGGTCTCAAATGGCGCAAGGTGGGGCGCTCACTGCAG

CGAGGCTGCCGGGCGCTGCGGGACCCGGCGCTGGACTCGCTGGCCTACGAGTACGAGCG

CGAGGGACTGTACGAGCAGGCCTTCCAGCTGCTGCGGCGCTTCGTGCAGGCCGAGGGCC

GCCGCGCCACGCTGCAGCGCCTGGTGGAGGCACTCGAGGAGAACGAGCTCACCAGCCTG

GCAGAGGACTTGCTGGGCCTGACCGATCCCAATGGCGGCCTGGCCTAG
```

```
Human TRAF2 CDS
                                              (SEQ ID NO: 17)
ATGGCTGCAGCTAGCGTGACCCCCCCTGGCTCCCTGGAGTTGCTACAGCCCGGCTTCTCCA

AGACCCTCCTGGGGACCAAGCTGGAAGCCAAGTACCTGTGCTCCGCCTGCAGAAACGTC

CTCCGCAGGCCCTTCCAGGCGCAGTGTGGCCACCGGTACTGCTCCTTCTGCCTGGCCAGC

ATCCTCAGCTCTGGGCCTCAGAACTGTGCTGCCTGTGTTCACGAGGGCATATATGAAGAAG

GCATTTCTATTTTAGAAAGCAGTTCGGCCTTCCCAGATAATGCTGCCCGCAGGGAGGTGGA

GAGCCTGCCGGCCGTCTGTCCCAGTGATGGATGCACCTGGAAGGGGACCCTGAAAGAATA

CGAGAGCTGCCACGAAGGCCGCTGCCCGCTCATGCTGACCGAATGTCCCGCGTGCAAAG

GCCTGGTCCGCCTTGGTGAAAAGGAGCGCCACCTGGAGCACGAGTGCCCGGAGAGAAGC

CTGAGCTGCCGGCATTGCCGGGCACCCTGCTGCGGAGCAGACGTGAAGGCGCACCACGA

GGTCTGCCCCAAGTTCCCCTTAACTTGTGACGGCTGCGGCAAGAAGAAGATCCCCCGGGA

GAAGTTTCAGGACCACGTCAAGACTTGTGGCAAGTGTCGAGTCCCTTGCAGATTCCACGC

CATCGGCTGCCTCGAGACGGTAGAGGGTGAGAACAGCAGGAGCACGAGGTGCAGTGGC

TGCGGGAGCACCTGGCCATGCTACTGAGCTCGGTGCTGGAGGCAAAGCCCCTCTTGGGAG

ACCAGAGCCACGCGGGGTCAGAGCTCCTGCAGAGGTGCGAGAGCCTGGAGAAGAAGAC

GGCCACTTTTGAGAACATTGTCTGCGTCCTGAACCGGGAGGTGGAGAGGGTGGCCATGAC

TGCCGAGGCCTGCAGCCGGCAGCACCGGCTGGACCAAGACAAGATTGAAGCCCTGAGTA

GCAAGGTGCAGCAGCTGGAGAGGAGCATTGGCCTCAAGGACCTGGCGATGGCTGACTTG

GAGCAGAAGGTCTTGGAGATGGAGGCATCCACCTACGATGGGGTCTTCATCTGGAAGATC

TCAGACTTCGCCAGGAAGCGCCAGGAAGCTGTGGCTGGCCGCATACCCGCCATCTTCTCC

CCAGCCTTCTACACCAGCAGGTACGGCTACAAGATGTGTCTGCGTATCTACCTGAACGGCG

ACGGCACCGGGCGAGGAACACACCTGTCCCTCTTCTTTGTGGTGATGAAGGGCCCGAATG

ACGCCCTGCTGCGGTGGCCCTTCAACCAGAAGGTGACCTTAATGCTGCTCGACCAGAATA

ACCGGGAGCACGTGATTGACGCCTTCAGGCCCGACGTGACTTCATCCTCTTTTCAGAGGC

CAGTCAACGACATGAACATCGCAAGCGGCTGCCCCCTCTTCTGCCCCGTCTCCAAGATGG

AGGCAAAGAATTCCTACGTGCGGGACGATGCCATCTTCATCAAGGCCATTGTGGACCTGA

CAGGGCTCTAA
Human MEKK1 CDS
                                              (SEQ ID NO: 18)
ATGGCGGCGGCGGCGGGAATCGCGCCTCGTCGTCGGGATTCCCGGGCGCCAGGGCTACG

AGCCCTGAGGCAGGCGGCGGCGGAGGAGCCCTCAAGGCGAGCAGCGCGCCCGCGGCTG

CCGCGGGACTGCTGCGGGAGGCGGCAGCGGGGGCCGCGAGCGGGCGGACTGGCGGCG

GCGGCAGCTGCGCAAAGTGCGGAGTGTGGAGCTGGACCAGCTGCCTGAGCAGCCGCTCT

TCCTTGCCGCCTCACCGCCGGCCTCCTCGACTTCCCCGTCGCCGGAGCCCGCGGACGCAG

CGGGGAGTGGGACCGGCTTCCAGCCTGTGGCGGTGCCGCCGCCCCACGGAGCCGCGAGC

CGCGGCGGCGCCCACCTTACCGAGTCGGTGGCGGCGCCGGACAGCGGCGCCTCGAGTCC

CGCAGCGGCCGAGCCCGGGGAGAAGCGGGCGCCCGCCGCCGAGCCGTCTCCTGCAGCGG

CCCCCGCCGGTCGTGAGATGGAGAATAAAGAAACTCTCAAAGGGTTGCACAAGATGGATG

ATCGTCCAGAGGAACGAATGATCAGGGAGAAACTGAAGGCAACCTGTATGCCAGCCTGG

AAGCACGAATGGTTGGAAAGGAGAAATAGGCGAGGGCCTGTGGTGGTAAAACCAATCCC

AGTTAAAGGAGATGGATCTGAAATGAATCACTTAGCAGCTGAGTCTCCAGGAGAGGTCCA
```

-continued

```
GGCAAGTGCGGCTTCACCAGCTTCCAAAGGCCGACGCAGTCCTTCTCCTGGCAACTCCCC

ATCAGGTCGCACAGTGAAATCAGAATCTCCAGGAGTAAGGAGAAAAAGAGTTTCCCCAG

TGCCTTTTCAGAGTGGCAGAATCACACCACCCCGAAGAGCCCCTTCACCAGATGGCTTCT

CACCATATAGCCCTGAGGAAACAAACCGCCGTGTTAACAAAGTGATGCGGGCCAGACTGT

ACTTACTGCAGCAGATAGGGCCTAACTCTTTCCTGATTGGAGGAGACAGCCCAGACAATA

AATACCGGGTGTTTATTGGGCCTCAGAACTGCAGCTGTGCACGTGGAACATTCTGTATTCA

TCTGCTATTTGTGATGCTCCGGGTGTTTCAACTAGAACCTTCAGACCCAATGTTATGGAGA

AAAACTTTAAAGAATTTTGAGGTTGAGAGTTTGTTCCAGAAATATCACAGTAGGCGTAGCT

CAAGGATCAAAGCTCCATCTCGTAACACCATCCAGAAGTTTGTTTCACGCATGTCAAATTC

TCATACATTGTCATCATCTAGTACTTCTACGTCTAGTTCAGAAAACAGCATAAAGGATGAAG

AGGAACAGATGTGTCCTATTTGCTTGTTGGGCATGCTTGATGAAGAAAGTCTTACAGTGTG

TGAAGACGGCTGCAGGAACAAGCTGCACCACCACTGCATGTCAATTTGGGCAGAAGAGT

GTAGAAGAAATAGAGAACCTTTAATATGTCCCCTTTGTAGATCTAAGTGGAGATCTCATGAT

TTCTACAGCCACGAGTTGTCAAGTCCTGTGGATTCCCCTTCTTCCCTCAGAGCTGCACAGC

AGCAAACCGTACAGCAGCAGCCTTTGGCTGGATCACGAAGGAATCAAGAGAGCAATTTTA

ACCTTACTCATTATGGAACTCAGCAAATCCCTCCTGCTTACAAAGATTTAGCTGAGCCATG

GATTCAGGTGTTTGGAATGGAACTCGTTGGCTGCTTATTTTCTAGAAACTGGAATGTGAGA

GAGATGGCCCTCAGGCGTCTTTCCCATGATGTCAGTGGGCCCTGCTGTTGGCAAATGGG

GAGAGCACTGGAAATTCTGGGGGCAGCAGTGGAAGCAGCCCGAGTGGGGGAGCCACCA

GTGGGTCTTCCCAGACCAGTATCTCAGGAGATGTGGTGGAGGCATGCTGCAGCGTTCTGT

CAATGGTCTGTGCTGACCCTGTCTACAAAGTGTACGTTGCTGCTTTAAAAACATTGAGAGC

CATGCTGGTATATACTCCTTGCCACAGTTTAGCGGAAAGAATCAAACTTCAGAGACTTCTC

CAGCCAGTTGTAGACACCATCCTAGTCAAATGTGCAGATGCCAATAGCCGCACAAGTCAG

CTGTCCATATCAACACTGTTGGAACTGTGCAAAGGCCAAGCAGGAGAGTTGGCAGTTGGC

AGAGAAATACTAAAAGCTGGATCCATTGGTATTGGTGGTGTTGATTATGTCTTAAATTGTAT

TCTTGGAAACCAAACTGAATCAAACAATTGGCAAGAACTTCTTGGCCGCCTTTGTCTTATA

GATAGACTGTTGTTGGAATTTCCTGCTGAATTTTATCCTCATATTGTCAGTACTGATGTTTCA

CAAGCTGAGCCTGTTGAAATCAGGTATAAGAAGCTGCTGTCCCTCTTAACCTTTGCTTTGC

AGTCCATTGATAATTCCCACTCAATGGTTGGCAAACTTTCCAGAAGGATCTACTTGAGTTC

TGCAAGAATGGTTACTACAGTACCCCATGTGTTTTCAAAACTGTTAGAAATGCTGAGTGTT

TCCAGTTCCACTCACTTCACCAGGATGCGTCGCCGTTTGATGGCTATTGCAGATGAGGTGG

AAATTGCCGAAGCCATCCAGTTGGGCGTAGAAGACACTTTGGATGGTCAACAGGACAGCT

TCTTGCAGGCATCTGTTCCCAACAACTATCTGGAAACCACAGAGAACAGTTCCCCTGAGT

GCACAGTCCATTTAGAGAAAACTGGAAAAGGATTATGTGCTACAAAATTGAGTGCCAGTT

CAGAGGACATTTCTGAGAGACTGGCCAGCATTTCAGTAGGACCTTCTAGTTCAACAACAA

CAACAACAACAACAGAGCAACCAAAGCCAATGGTTCAAACAAAAGGCAGACCCCA

CAGTCAGTGTTTGAACTCCTCTCCTTTATCTCATCATTCCCAATTAATGTTTCCAGCCTTGTC

AACCCCTTCTTCTTCTACCCCATCTGTACCAGCTGGCACTGCAACAGATGTCTCTAAGCATA

GACTTCAGGGATTCATTCCCTGCAGAATACCTTCTGCATCTCCTCAAACACAGCGCAAGTT

TTCTCTACAATTCCACAGAAACTGTCCTGAAAACAAAGACTCAGATAAACTTTCCCCAGTC

TTTACTCAGTCAAGACCCTTGCCCTCCAGTAACATACACAGGCCAAAGCCATCTAGACCTA
```

-continued

```
CCCCAGGTAATACAAGTAAACAGGGAGATCCCTCAAAAAATAGCATGACACTTGATCTGA

ACAGTAGTTCCAAATGTGATGACAGCTTTGGCTGTAGCAGCAATAGTAGTAATGCTGTTAT

ACCCAGTGACGAGACAGTGTTCACCCCAGTAGAGGAGAAATGCAGATTAGATGTCAATAC

AGAGCTCAACTCCAGTATTGAGGACCTTCTTGAAGCATCTATGCCTTCAAGTGATACAACA

GTAACTTTTAAGTCAGAAGTTGCTGTCCTGTCTCCTGAAAAGGCTGAAAATGATGATACCT

ACAAAGATGATGTGAATCATAATCAAAAGTGCAAAGAGAAGATGGAAGCTGAAGAAGAA

GAAGCTTTAGCAATTGCCATGGCAATGTCAGCGTCTCAGGATGCCCTCCCCATAGTTCCTC

AGCTGCAGGTTGAAAATGGAGAAGATATCATCATTATTCAACAGGATACACCAGAGACTCT

ACCAGGACATACCAAAGCAAAACAACCGTATAGAGAAGACACTGAATGGCTGAAAGGTC

AACAGATAGGCCTTGGAGCATTTTCTTCTTGTTATCAGGCTCAAGATGTGGGAACTGGAAC

TTTAATGGCTGTTAAACAGGTGACTTATGTCAGAAACACATCTTCTGAGCAAGAAGAAGTA

GTAGAAGCACTAAGAGAAGAGATAAGAATGATGAGCCATCTGAATCATCCAAACATCATTA

GGATGTTGGGAGCCACGTGTGAGAAGAGCAATTACAATCTCTTCATTGAATGGATGGCAG

GGGGATCGGTGGCTCATTTGCTGAGTAAATATGGAGCCTTCAAAGAATCAGTAGTTATTAA

CTACACTGAACAGTTACTCCGTGGCCTTTCGTATCTCCATGAAAACCAAATCATTCACAGA

GATGTCAAAGGTGCCAATTTGCTAATTGACAGCACTGGTCAGAGACTAAGAATTGCAGATT

TTGGAGCTGCAGCCAGGTTGGCATCAAAAGGAACTGGTGCAGGAGAGTTTCAGGGACAA

TTACTGGGGACAATTGCATTTATGGCACCTGAGGTACTAAGAGGTCAACAGTATGGAAGG

AGCTGTGATGTATGGAGTGTTGGCTGTGCTATTATAGAAATGGCTTGTGCAAAACCACCAT

GGAATGCAGAAAAACACTC CAATCATCTTGCTTTGATATTTAAGATTGCTAGTGCAACTACT

GCTCCATCGATCCCTTCACATTTGTCTCCTGGTTTACGAGATGTGGCTCTTCGTTGTTTAGA

ACTTCAACCTCAGGACAGACCTCCATCAAGAGAGCTACTGAAGCATCCAGTCTTTCGTAC

TACATGGTAG
```

Human MEKK4 CDS
(SEQ ID NO: 19)

```
ATGAGAGAAGCCGCTGCCGCGCTGGTCCCTCCTCCCGCCTTTGCCGTCACGCCTGCCGCC

GCCATGGAGGAGCCGCCGCCACCGCCGCCGCCGCCACCACCGCCACCGGAACCCGAGAC

CGAGTCAGAACCCGAGTGCTGCTTGGCGGCGAGGCAAGAGGGCACATTGGGAGATTCAG

CTTGCAAGAGTCCTGAATCTGATCTAGAAGACTTCTCCGATGAAACAAATACAGAGAATCT

TTATGGTACCTCTCCCCCCAGCACACCTCGACAGATGAAACGCATGTCAACCAAACATCAG

AGGAATAATGTGGGGAGGCCAGCCAGTCGGTCTAATTTGAAAGAAAAAATGAATGCACCA

AATCAGCCTCCACATAAAGACACTGGAAAAACAGTGGAGAATGTGGAAGAATACAGCTAT

AAGCAGGAGAAAAGATCCGAGCAGCTCTTAGAACAACAGAGCGTGATCATAAAAAAAA

TGTACAGTGCTCATTCATGTTAGACTCAGTGGGTGGATCTTTGCCAAAAAAATCAATTCCA

GATGTGGATCTCAATAAGCCTTACCTCAGCCTTGGCTGTAGCAATGCTAAGCTTCCAGTATC

TGTGCCCATGCCTATAGCCAGACCTGCACGCCAGACTTCTAGGACTGACTGTCCAGCAGAT

CGTTTAAAGTTTTTTGAAACTTTACGACTTTTGCTAAAGCTTACCTCAGTCTCAAAGAAAA

AAGACAGGGAGCAAAGAGGACAAGAAAATACGTCTGGTTTCTGGCTTAACCGATCTAAC

GAACTGATCTGGTTAGAGCTACAAGCCTGGCATGCAGGACGGACAATTAACGACCAGGAC

TTCTTTTTATATACAGCCCGTCAAGCCATCCCAGATATTATTAATGAAATCCTTACTTTCAAA

GTCGACTATGGGAGCTTCGCCTTTGTTAGAGATAGAGCTGGTTTTAATGGTACTTCAGTAG
```

-continued

```
AAGGGCAGTGCAAAGCCACTCCTGGAACAAAGATTGTAGGTTACTCAACACATCATGAGC
ATCTCCAACGCCAGAGGGTCTCATTTGAGCAGGTAAAACGGATAATGGAGCTGCTAGAGT
ACATAGAAGCACTTTATCCATCATTGCAGGCTCTTCAGAAGGACTATGAAAAATATGCTGC
AAAAGACTTCCAGGACAGGGTGCAGGCACTCTGTTTGTGGTTAAACATCACAAAAGACTT
AAATCAGAAATTAAGGATTATGGGCACTGTTTTGGGCATCAAGAATTTATCAGACATTGGC
TGGCCAGTGTTTGAAATCCCTTCCCCTCGACCATCCAAAGGTAATGAGCCGGAGTATGAGG
GTGATGACACAGAAGGAGAATTAAAGGAGTTGGAAAGTAGTACGGATGAGAGTGAAGAA
GAACAAATCTCTGATCCTAGGGTACCGGAAATCAGACAGCCCATAGATAACAGCTTCGAC
ATCCAGTCGCGGGACTGCATATCCAAGAAGCTTGAGAGGCTCGAATCTGAGGATGATTCTC
TTGGCTGGGGAGCACCAGACTGGAGCACAGAAGCAGGCTTTAGTAGACATTGTCTGACTT
CTATTTATAGACCATTTGTAGACAAAGCACTGAAGCAGATGGGGTTAAGAAAGTTAATTTT
AAGACTTCACAAGCTAATGGATGGTTCCTTGCAAAGGGCACGTATAGCATTGGTAAAGAA
CGATCGTCCAGTGGAGTTTTCTGAATTTCCAGATCCCATGTGGGGTTCAGATTATGTGCAG
TTGTCAAGGACACCACCTTCATCTGAGGAGAAATGCAGTGCTGTGTCGTGGGAGGAGCTG
AAGGCCATGGATTTACCTTCATTCGAACCTGCCTTCCTAGTTCTCTGCCGAGTCCTTCTGAA
TGTCATACATGAGTGTCTGAAGTTAAGATTGGAGCAGAGACCTGCTGGAGAACCATCTCTC
TTGAGTATTAAGCAGCTGGTGAGAGAGTGTAAGGAGGTCCTGAAGGGCGGCCTGCTGATG
AAGCAGTACTACCAGTTCATGCTGCAGGAGGTTCTGGAGGACTTGGAGAAGCCCGACTGC
AACATTGACGCTTTTGAAGAGGATCTACATAAAATGCTTATGGTGTATTTTGATTACATGAG
AAGCTGGATCCAAATGCTACAGCAATTACCTCAAGCATCGCATAGTTTAAAAAATCTGTTA
GAAGAAGAATGGAATTTCACCAAAGAAATAACTCATTACATACGGGAGGAGAAGCACA
GGCCGGGAAGCTTTTCTGTGACATTGCAGGAATGCTGCTGAAATCTACAGGAAGTTTTTTA
GAATTTGGCTTACAGGAGAGCTGTGCTGAATTTTGGACTAGTGCGGATGACAGCAGTGCT
TCCGACGAAATCAGGAGGTCTGTTATAGAGATCAGTCGAGCCCTGAAGGAGCTCTTCCAT
GAAGCAGAGAAAGGGCTTCCAAAGCACTTGGATTTGCTAAAATGTTGAGAAAGGACCT
GGAAATAGCAGCAGAATTCAGGCTTTCAGCCCCAGTTAGAGACCTCCTGGATGTTCTGAA
ATCAAAACAGTATGTCAAGGTGCAAATTCCTGGGTTAGAAAACTTGCAAATGTTTGTTCCA
GACACTCTTGCTGAGGAGAAGAGTATTATTTTGCAGTTACTCAATGCAGCTGCAGGAAAG
GACTGTTCAAAAGATTCAGATGACGTACTCATCGATGCCTATCTGCTTCTGACCAAGCACG
GTGATCGAGCCCGTGATTCAGAGGACAGCTGGGGCACCTGGGAGGCACAGCCTGTCAAA
GTCGTGCCTCAGGTGGAGACTGTTGACACCCTGAGAAGCATGCAGGTGGATAATCTTTTA
CTAGTTGTCATGCAGTCTGCGCATCTCACAATTCAGAGAAAAGCTTTCCAGCAGTCCATTG
AGGGACTTATGACTCTGTGCCAGGAGCAGACATCCAGTCAGCCGGTCATCGCCAAAGCTT
TGCAGCAGCTGAAGAATGATGCATTGGAGCTATGCAACAGGATAAGCAATGCCATTGACC
GCGTGGACCACATGTTCACATCAGAATTTGATGCTGAGGTTGATGAATCTGAATCTGTCAC
CTTGCAACAGTACTACCGAGAAGCAATGATTCAGGGGTACAATTTTGGATTTGAGTATCAT
AAAGAAGTTGTTCGTTTGATGTCTGGGGAGTTTAGACAGAAGATAGGAGACAAATATATAA
GCTTTGCCCGGAAGTGGATGAATTATGTCCTGACTAAATGTGAGAGTGGTAGAGGTACAA
GACCCAGGTGGGCGACTCAAGGATTTGATTTTCTACAAGCAATTGAACCTGCCTTTATTTC
AGCTTTACCAGAAGATGACTTCTTGAGTTTACAAGCCTTGATGAATGAATGCATTGGCCAT
GTCATAGGAAAACCACACAGTCCTGTTACAGGTTTGTACCTTGCCATTCATCGGAACAGCC
```

```
CCCGTCCTATGAAGGTACCTCGATGCCATAGTGACCCTCCTAACCCACACCTCATTATCCCC

ACTCCAGAGGGATTCAGCACTCGGAGCATGCCTTCCGACGCGCGGAGCCATGGCAGCCCT

GCTGCTGCTGCTGCTGCTGCTGCTGCTGTTGCTGCCAGTCGGCCCAGCCCCTCTGGTG

GTGACTCTGTGCTGCCCAAATCCATCAGCAGTGCCCATGATACCAGGGGTTCCAGCGTTCC

TGAAAATGATCGATTGGCTTCCATAGCTGCTGAATTGCAGTTTAGGTCCCTGAGTCGTCAC

TCAAGCCCCACGGAGGAGCGAGATGAACCAGCATATCCAAGAGGAGATTCAAGTGGGTC

CACAAGAAGAAGTTGGGAACTTCGGACACTAATCAGCCAGAGTAAAGATACTGCTTCTAA

ACTAGGACCCATAGAAGCTATCCAGAAGTCAGTCCGATTGTTTGAAGAAAAGAGGTACCG

AGAAATGAGGAGAAAGAATATCATTGGTCAAGTTTGTGATACGCCTAAGTCCTATGATAAT

GTTATGCACGTTGGCTTGAGGAAGGTGACCTTCAAATGGCAAAGAGGAAACAAAATTGG

AGAAGGCCAGTATGGGAAGGTGTACACCTGCATCAGCGTCGACACCGGGGAGCTGATGG

CCATGAAAGAGATTCGATTTCAACCTAATGACCATAAGACTATCAAGGAAACTGCAGACG

AATTGAAAATATTCGAAGGCATCAAACACCCCAATCTGGTTCGGTATTTTGGTGTGGAGCT

CCATAGAGAAGAAATGTACATCTTCATGGAGTACTGCGATGAGGGGACTTTAGAAGAGGT

GTCAAGGCTGGGACTTCAGGAACATGTGATTAGGCTGTATTCAAAGCAGATCACCATTGCG

ATCAACGTCCTCCATGAGCATGGCATAGTCCACCGTGACATTAAAGGTGCCAATATCTTCCT

TACCTCATCTGGATTAATCAAACTGGGAGATTTTGGATGTTCAGTAAAGCTCAAAAACAAT

GCCCAGACCATGCCTGGTGAAGTGAACAGCACCCTGGGGACAGCAGCATACATGGCACCT

GAAGTCATCACTCGTGCCAAAGGAGAGGGCCATGGGCGTGCGGCCGACATCTGGAGTCT

GGGGTGTGTTGTCATAGAGATGGTGACTGGCAAGAGGCCTTGGCATGAGTATGAGCACAA

CTTTCAAATTATGTATAAAGTGGGGATGGGACATAAGCCACCAATCCCTGAAAGATTAAGC

CCTGAAGGAAAGGACTTCCTTTCTCACTGCCTTGAGAGTGACCCAAAGATGAGATGGACC

GCCAGCCAGCTCCTCGACCATTCGTTTGTCAAGGTTTGCACAGATGAAGAATGA

Human MEKK7 CDS
                                                     (SEQ ID NO: 20)
ATGTCTACAGCCTCTGCCGCCTCCTCCTCCTCGTCTTCGGCCGGTGAGATGATCGAAG

CCCCTTCCCAGGTCCTCAACTTTGAAGAGATCGACTACAAGGAGATCGAGGTGGAAGAGG

TTGTTGGAAGAGGAGCCTTTGGAGTTGTTTGCAAAGCTAAGTGGAGAGCAAAAGATGTTG

CTATTAAACAAATAGAAAGTGAATCTGAGAGGAAAGCGTTTATTGTAGAGCTTCGGCAGTT

ATCCCGTGTGAACCATCCTAATATTGTAAAGCTTTATGGAGCCTGCTTGAATCCAGTGTGTC

TTGTGATGGAATATGCTGAAGGGGGCTCTTTATATAATGTGCTGCATGGTGCTGAACCATTG

CCATATTATACTGCTGCCCACGCAATGAGTTGGTGTTTACAGTGTTCCCAAGGAGTGGCTT

ATCTTCACAGCATGCAACCCAAAGCGCTAATTCACAGGGACCTGAAACCACCAAACTTAC

TGCTGGTTGCAGGGGGGACAGTTCTAAAAATTTGTGATTTTGGTACAGCCTGTGACATTCA

GACACACATGACCAATAACAAGGGGAGTGCTGCTTGGATGGCACCTGAAGTTTTTGAAGG

TAGTAATTACAGTGAAAAATGTGACGTCTTCAGCTGGGGTATTATTCTTTGGGAAGTGATA

ACGCGTCGGAAACCCTTTGATGAGATTGGTGGCCCAGCTTTCCGAATCATGTGGGCTGTTC

ATAATGGTACTCGACCACCACTGATAAAAAATTTACCTAAGCCCATTGAGAGCCTGATGAC

TCGTTGTTGGTCTAAAGATCCTTCCCAGCGCCCTTCAATGGAGGAAATTGTGAAAATAATG

ACTCACTTGATGCGGTACTTTCCAGGAGCAGATGAGCCATTACAGTATCCTTGTCAGTATTC

AGATGAAGGACAGAGCAACTCTGCCACCAGTACAGGCTCATTCATGGACATTGCTTCTAC
```

-continued

AAATACGAGTAACAAAAGTGACACTAATATGGAGCAAGTTCCTGCCACAAATGATACTATT

AAGCGCTTAGAATCAAAATTGTTGAAAAATCAGGCAAAGCAACAGAGTGAATCTGGACGT

TTAAGCTTGGGAGCCTCCCGTGGGAGCAGTGTGGAGAGCTTGCCCCCAACCTCTGAGGGC

AAGAGGATGAGTGCTGACATGTCTGAAATAGAAGCTAGGATCGCCGCAACCACAGGCAAC

GGACAGCCAAGACGTAGATCCATCCAAGACTTGACTGTAACTGGAACAGAACCTGGTCAG

GTGAGCAGTAGGTCATCCAGTCCCAGTGTCAGAATGATTACTACCTCAGGACCAACCTCA

GAAAAGCCAACTCGAAGTCATCCATGGACCCCTGATGATTCCACAGATACCAATGGATCA

GATAACTCCATCCCAATGGCTTATCTTACACTGGATCACCAACTACAGCCTCTAGCACCGTG

CCCAAACTCCAAAGAATCTATGGCAGTGTTTGAACAGCATTGTAAAATGGCACAAGAATAT

ATGAAAGTTCAAACAGAAATTGCATTGTTATTACAGAGAAAGCAAGAACTAGTTGCAGAA

CTGGACCAGGATGAAAAGGACCAGCAAAATACATCTCGCCTGGTACAGGAACATAAAAA

GCTTTTAGATGAAAACAAAAGCCTTTCTACTTACTACCAGCAATGCAAAAAACAACTAGA

GGTCATCAGAAGTCAGCAGCAGAAACGACAAGGCACTTCATGA

Human JNK CDS
(SEQ ID NO: 21)
ATGAGCAGAAGCAAGCGTGACAACAATTTTTATAGTGTAGAGATTGGAGATTCTACATTCA

CAGTCCTGAAACGATATCAGAATTTAAAACCTATAGGCTCAGGAGCTCAAGGAATAGTATG

CGCAGCTTATGATGCCATTCTTGAAAGAAATGTTGCAATCAAGAAGCTAAGCCGACCATTT

CAGAATCAGACTCATGCCAAGCGGGCCTACAGAGAGCTAGTTCTTATGAAATGTGTTAATC

ACAAAAATATAATTGGCCTTTTGAATGTTTTCACACCACAGAAATCCCTAGAAGAATTTCA

AGATGTTTACATAGTCATGGAGCTCATGGATGCAAATCTTTGCCAAGTGATTCAGATGGAG

CTAGATCATGAAAGAATGTCCTACCTTCTCTATCAGATGCTGTGTGGAATCAAGCACCTTC

ATTCTGCTGGAATTATTCATCGGGACTTAAAGCCCAGTAATATAGTAGTAAAATCTGATTGC

ACTTTGAAGATTCTTGACTTCGGTCTGGCCAGGACTGCAGGAACGAGTTTTATGATGACGC

CTTATGTAGTGACTCGCTACTACAGAGCACCCGAGGTCATCCTTGGCATGGGCTACAAGGA

AAACGTTGACATTTGGTCAGTTGGGTGCATCATGGGAGAAATGATCAAAGGTGGTGTTTT

GTTCCCAGGTACAGATCATATTGATCAGTGGAATAAAGTTATTGAACAGCTTGGAACACCA

TGTCCTGAATTCATGAAGAAACTGCAACCAACAGTAAGGACTTACGTTGAAAACAGACCT

AAATATGCTGGATATAGCTTTGAGAAACTCTTCCCTGATGTCCTTTTCCCAGCTGACTCAGA

ACACAACAAACTTAAAGCCAGTCAGGCAAGGGATTTGTTATCCAAAATGCTGGTAATAGAT

GCATCTAAAAGGATCTCTGTAGATGAAGCTCTCCAACACCCGTACATCAATGTCTGGTATG

ATCCTTCTGAAGCAGAAGCTCCACCACCAAAGATCCCTGACAAGCAGTTAGATGAAAGGG

AACACACAATAGAAGAGTGGAAAGAATTGATATATAAGGAAGTTATGGACTTGGAGGAGA

GAACCAAGAATGGAGTTATACGGGGGCAGCCCTCTCCTTTAGGTGCAGCAGTGATCAATG

GCTCTCAGCATCCATCATCATCGTCGTCTGTCAATGATGTGTCTTCAATGTCAACAGATCCG

ACTTTGGCCTCTGATACAGACAGCAGTCTAGAAGCAGCAGCTGGGCCTCTGGGCTGCTGT

AGATGA

Human AP-1 CDS
(SEQ ID NO: 22)
ATGACTGCAAAGATGGAAACGACCTTCTATGACGATGCCCTCAACGCCTCGTTCCTCCCGT

CCGAGAGCGGACCTTATGGCTACAGTAACCCCAAGATCCTGAAACAGAGCATGACCCTGA

ACCTGGCCGACCCAGTGGGGAGCCTGAAGCCGCACCTCCGCGCCAAGAACTCGGACCTC

CTCACCTCGCCCGACGTGGGGCTGCTCAAGCTGGCGTCGCCCGAGCTGGAGCGCCTGATA

-continued

```
ATCCAGTCCAGCAACGGGCACATCACCACCACGCCGACCCCCACCCAGTTCCTGTGCCCC

AAGAACGTGACAGATGAGCAGGAGGGCTTCGCCGAGGGCTTCGTGCGCGCCCTGGCCGA

ACTGCACAGCCAGAACACGCTGCCCAGCGTCACGTCGGCGGCGCAGCCGGTCAACGGGG

CAGGCATGGTGGCTCCCGCGGTAGCCTCGGTGGCAGGGGCAGCGGCAGCGGCGGCTTC

AGCGCCAGCCTGCACAGCGAGCCGCCGGTCTACGCAAACCTCAGCAACTTCAACCCAGG

CGCGCTGAGCAGCGGCGGCGGGGCGCCCTCCTACGGCGCGGCCGGCCTGGCCTTTCCCG

CGCAACCCCAGCAGCAGCAGCCGCCGCACCACCTGCCCCAGCAGATGCCCGTGCAG

CACCCGCGGCTGCAGGCCCTGAAGGAGGAGCCTCAGACAGTGCCCGAGATGCCCGGCGA

GACACCGCCCCTGTCCCCCATCGACATGGAGTCCCAGGAGCGGATCAAGGCGGAGAGGA

AGCGCATGAGGAACCGCATCGCTGCCTCCAAGTGCCGAAAAAGGAAGCTGGAGAGAATC

GCCCGGCTGGAGGAAAAAGTGAAAACCTTGAAAGCTCAGAACTCGGAGCTGGCGTCCAC

GGCCAACATGCTCAGGGAACAGGTGGCACAGCTTAAACAGAAAGTCATGAACCACGTTA

ACAGTGGGTGCCAACTCATGCTAACGCAGCAGTTGCAAACATTTTGA
```

Human ASK1 CDS (SEQ ID NO: 23)
```
ATGAGCACGGAGGCGGACGAGGGCATCACTTTCTCTGTGCCACCCTTCGCCCCTCGGGC

TTCTGCACCATCCCCGAGGGCGGCATCTGCAGGAGGGGAGGAGCGGCGGCGGTGGGCGA

GGGCGAGGAGCACCAGCTGCCACCGCCGCCGCCGGGCAGCTTCTGGAACGTGGAGAGCG

CCGCTGCCCCTGGCATCGGTTGTCCGGCGGCCACCTCCTCGAGCAGTGCCACCCGAGGCC

GGGGCAGCTCTGTTGGCGGGGGCAGCCGACGGACCACGGTGGCATATGTGATCAACGAA

GCGAGCCAAGGGCAACTGGTGGTGGCCGAGAGCGAGGCCCTGCAGAGCTTGCGGGAGG

CGTGCGAGACAGTGGGCGCCACCCTGGAAACCCTGCATTTTGGGAAACTCGACTTTGGAG

AAACCACCGTGCTGGACCGCTTTTACAATGCAGATATTGCGGTGGTGGAGATGAGCGATG

CCTTCCGGCAGCCGTCCTTGTTTTACCACCTTGGGGTGAGAGAAAGTTTCAGCATGGCCA

ACAACATCATCCTCTACTGTGATACTAACTCGGACTCTCTGCAGTCACTGAAGGAAATAAT

TTGCCAGAAGAATACTATGTGCACTGGGAACTACACCTTTGTTCCTTACATGATAACTCCA

CATAACAAAGTCTACTGCTGTGACAGCAGCTTCATGAAGGGGTTGACAGAGCTCATGCAA

CCGAACTTCGAGCTGCTTCTTGGACCCATCTGCTTACCTCTTGTGGATCGTTTTATTCAACT

TTTGAAGGTGGCACAAGCAAGTTCTAGCCAGTACTTCCGGGAATCTATACTCAATGACATC

AGGAAAGCTCGTAATTTATACACTGGTAAAGAATTGGCAGCTGAGTTGGCAAGAATTCGG

CAGCGAGTAGATAATATCGAAGTCTTGACAGCAGATATTGTCATAAATCTGTTACTTTCCTA

CAGAGATATCCAGGACTATGATTCTATTGTGAAGCTGGTAGAGACTTTAGAAAAACTGCCA

ACCTTTGATTTGGCCTCCCATCACCATGTGAAGTTTCATTATGCATTTGCACTGAATAGGAG

AAATCTCCCTGGTGACAGAGCAAAAGCTCTTGATATTATGATTCCCATGGTGCAAAGCGAA

GGACAAGTTGCTTCAGATATGTATTGCCTAGTTGGTCGAATCTACAAAGATATGTTTTTGGA

CTCTAATTTCACGGACACTGAAAGCAGAGACCATGGAGCTTCTTGGTTCAAAAAGGCATT

TGAATCTGAGCCAACACTACAGTCAGGAATTAATTATGCGGTCCTCCTCCTGGCAGCTGGA

CACCAGTTTGAATCTTCCTTTGAGCTCCGGAAAGTTGGGGTGAAGCTAAGTAGTCTTCTTG

GTAAAAAGGGAAACTTGGAAAAACTCCAGAGCTACTGGGAAGTTGGATTTTTTCTGGGGG

CCAGCGTCCTAGCCAATGACCACATGAGAGTCATTCAAGCATCTGAAAAGCTTTTTAAACT

GAAGACACCAGCATGGTACCTCAAGTCTATTGTAGAGACAATTTTAATATATAAGCATTTTG
```

-continued

```
TGAAACTGACCACAGAACAGCCTGTGGCCAAGCAAGAACTTGTGGACTTTTGGATGGATT

TCCTGGTCGAGGCCACAAAGACAGATGTTACTGTGGTTAGGTTTCCAGTATTAATATTAGA

ACCAACCAAAATCTATCAACCTTCTTATTTGTCTATCAACAATGAAGTTGAGGAAAAGACA

ATCTCTATTTGGCACGTGCTTCCTGATGACAAGAAAGGTATACATGAGTGGAATTTTAGTGC

CTCTTCTGTCAGGGGAGTGAGTATTTCTAAATTTGAAGAAAGATGCTGCTTTCTTTATGTGC

TTCACAATTCTGATGATTTCCAAATCTATTTCTGTACAGAACTTCATTGTAAAAGTTTTTT

GAGATGGTGAACACCATTACCGAAGAGAAGGGGAGAAGCACAGAGGAAGGAGACTGTG

AAAGTGACTTGCTGGAGTATGACTATGAATATGATGAAAATGGTGACAGAGTCGTTTTAGG

AAAAGGCACTTATGGGATAGTCTACGCAGGTCGGGACTTGAGCAACCAAGTCAGAATTGC

TATTAAGGAAATCCCAGAGAGAGACAGCAGATACTCTCAGCCCCTGCATGAAGAAATAGC

ATTGCATAAACACCTGAAGCACAAAAATATTGTCCAGTATCTGGGCTCTTTCAGTGAGAAT

GGTTTCATTAAAATCTTCATGGAGCAGGTCCCTGGAGGAAGTCTTTCTGCTCTCCTTCGTT

CCAAATGGGGTCCATTAAAAGACAATGAGCAAACAATTGGCTTTTATACAAAGCAAATACT

GGAAGGATTAAAATATCTCCATGACAATCAGATAGTTCACCGGGACATAAAGGGTGACAAT

GTGTTGATTAATACCTACAGTGGTGTTCTCAAGATCTCTGACTTCGGAACATCAAAGAGGC

TTGCTGGCATAAACCCCTGTACTGAAACTTTTACTGGTACCCTCCAGTATATGGCACCAGA

AATAATAGATAAAGGACCAAGAGGCTACGAAAAGCAGCAGACATCTGGTCTCTGGGCTG

TACAATCATTGAAATGGCCACAGGAAAACCCCCATTTTATGAACTGGGAGAACCACAAGC

AGCTATGTTCAAGGTGGGAATGTTTAAAGTCCACCCTGAGATCCCAGAGTCCATGTCTGCA

GAGGCCAAGGCATTCATACTGAAATGTTTTGAACCAGATCCTGACAAGAGAGCCTGTGCT

AACGACTTGCTTGTTGATGAGTTTTTAAAAGTTTCAAGCAAAAAGAAAAAGACACAACCT

AAGCTTTCAGCTCTTTCAGCTGGATCAAATGAATATCTCAGGAGTATATCCTTGCCGGTACC

TGTGCTGGTGGAGGACACCAGCAGCAGCAGTGAGTACGGCTCAGTTTCACCCGACACGG

AGTTGAAAGTGGACCCCTTCTCTTTCAAAACAAGAGCCAAGTCCTGCGGAGAAAGAGAT

GTCAAGGGAATTCGGACACTCTTTTTGGGCATTCCAGATGAGAATTTTGAAGATCACAGTG

CTCCTCCTTCCCCTGAAGAAAAAGATTCTGGATTCTTCATGCTGAGGAAGGACAGTGAGA

GGCGAGCTACCCTTCACAGGATCCTGACGGAAGACCAAGACAAAATTGTGAGAAACCTA

ATGGAATCTTTAGCTCAGGGGCTGAAGAACCGAAACTAAAATGGGAACACATCACAACC

CTCATTGCAAGCCTCAGAGAATTTGTGAGATCCACTGACCGAAAAATCATAGCCACCACA

CTGTCAAAGCTGAAACTGGAGCTGGACTTCGACAGCCATGGCATTAGCCAAGTCCAGGTG

GTACTCTTTGGTTTTCAAGATGCTGTCAATAAAGTTCTTCGGAATCATAACATCAAGCCGC

ACTGGATGTTTGCCTTAGACAGTATCATTCGGAAGGCGGTACAGACAGCCATTACCATCCT

GGTTCCAGAACTAAGGCCACATTTCAGCCTTGCATCTGAGAGTGATACTGCTGATCAAGAA

GACTTGGATGTAGAAGATGACCATGAGGAACAGCCTTCAAATCAAACTGTCCGAAGACCT

CAGGCTGTCATTGAAGATGCTGTGGCTACCTCAGGCGTGAGCACGCTCAGTTCTACTGTGT

CTCATGATTCCCAGAGTGCTCACCGGTCACTGAATGTACAGCTTGGAAGGATGAAAATAG

AAACCAATAGATTACTGGAAGAATTGGTTCGGAAAGAGAAAGAATTACAAGCACTCCTTC

ATCGAGCTATTGAAGAAAAGACCAAGAAATTAAACACCTGAAGCTTAAGTCCCAACCCA

TAGAAATTCCTGAATTGCCTGTATTTCATCTAAATTCTTCTGGCACAAATACTGAAGATTCT

GAACTTACCGACTGGCTGAGAGTGAATGGAGCTGATGAAGACACTATAAGCCGGTTTTG

GCTGAAGATTATACACTATTGGATGTTCTCTACTATGTTACACGTGATGACTTAAAATGCTT
```

-continued

GAGACTAAGGGGAGGGATGCTGTGCACACTGTGGAAGGCTATCATTGACTTTCGAAACAA

ACAGACTTGA

Human RIP CDS (SEQ ID NO: 24)

ATGTGGAGCAAACTGAATAATGAAGAGCACAATGAGCTGAGGGAAGTGGACGGCACCGC

TAAGAAGAATGGCGGCACCCTCTACTACATGGCGCCCGAGCACCTGAATGACGTCAACGC

AAAGCCCACAGAGAAGTCGGATGTGTACAGCTTTGCTGTAGTACTCTGGGCGATATTTGCA

AATAAGGAGCCATATGAAAATGCTATCTGTGAGCAGCAGTTGATAATGTGCATAAAATCTG

GGAACAGGCCAGATGTGGATGACATCACTGAGTACTGCCCAAGAGAAATTATCAGTCTCA

TGAAGCTCTGCTGGGAAGCGAATCCGGAAGCTCGGCCGACATTTCCTGGCATTGAAGAAA

AATTTAGGCCTTTTTATTTAAGTCAATTAGAAGAAAGTGTAGAAGAGGACGTGAAGAGTTT

AAAGAAAGAGTATTCAAACGAAAATGCAGTTGTGAAGAGAATGCAGTCTCTTCAACTTGA

TTGTGTGGCAGTACCTTCAAGCCGGTCAAATTCAGCCACAGAACAGCCTGGTTCACTGCA

CAGTTCCCAGGGACTTGGGATGGGTCCTGTGGAGGAGTCCTGGTTTGCTCCTTCCCTGGA

GCACCCACAAGAAGAGAATGAGCCCAGCCTGCAGAGTAAACTCCAAGACGAAGCCAACT

ACCATCTTTATGGCAGCCGCATGGACAGGCAGACGAAACAGCAGCCCAGACAGAATGTG

GCTTACAACAGAGAGGAGGAAAGGAGACGCAGGGTCTCCCATGACCCTTTTGCACAGCA

AAGACCTTACGAGAATTTTCAGAATACAGAGGGAAAAGGCACTGCTTATTCCAGTGCAGC

CAGTCATGGTAATGCAGTGCACCAGCCCTCAGGGCTCACCAGCCAACCTCAAGTACTGTA

TCAGAACAATGGATTATATAGCTCACATGGCTTTGGAACAAGACCACTGGATCCAGGAACA

GCAGGTCCCAGAGTTTGGTACAGGCCAATTCCAAGTCATATGCCTAGTCTGCATAATATCCC

AGTGCCTGAGACCAACTATCTAGGAAATACACCCACCATGCCATTCAGCTCCTTGCCACCA

ACAGATGAATCTATAAAATATACCATATACAATAGTACTGGCATTCAGATTGGAGCCTACAA

TTATATGGAGATTGGTGGGACGAGTTCATCACTACTAGACAGCACAAATACGAACTTCAAA

GAAGAGCCAGCTGCTAAGTACCAAGCTATCTTTGATAATACCACTAGTCTGACGGATAAAC

ACCTGGACCCAATCAGGGAAAATCTGGGAAAGCACTGGAAAAACTGTGCCCGTAAACTG

GGCTTCACACAGTCTCAGATTGATGAAATTGACCATGACTATGAGCGAGATGGACTGAAA

GAAAAGGTTTACCAGATGCTCCAAAAGTGGGTGATGAGGGAAGGCATAAAGGGAGCCAC

GGTGGGAAGCTGGCCCAGGCGCTCCACCAGTGTTCCAGGATCGACCTTCTGAGCAGCTT

GATTTACGTCAGCCAGAACTAA

Human MEKK 3 CDS (SEQ ID NO: 25)

ATGGACGAACAGGAGGCATTGAACTCAATCATGAACGATCTGGTGGCCCTCCAGATGAAC

CGACGTCACCGGATGCCTGGATATGAGACCATGAAGAACAAAGACACAGGTCACTCAAAT

AGGCAGAAAAAACACAACAGCAGCAGCTCAGCCCTTCTGAACAGCCCCACAGTAACAAC

AAGCTCATGTGCAGGGGCCAGTGAGAAAAAGAAATTTTTGAGTGACGTCAGAATCAAGTT

CGAGCACAACGGGGAGAGGCGAATTATAGCGTTCAGCCGGCCTGTGAAATATGAAGATGT

GGAGCACAAGGTGACAACAGTATTTGGACAACCTCTTGATCTACATTACATGAACAATGA

GCTCTCCATCCTGCTGAAAAACCAAGATGATCTTGATAAAGCAATTGACATTTTAGATAGA

AGCTCAAGCATGAAAAGCCTTAGGATATTGCTGTTGTCCCAGGACAGAAACCATAACAGT

TCCTCTCCCCACTCTGGGGTGTCCAGACAGGTGCGGATCAAGGCTTCCCAGTCCGCAGGG

GATATAAATACTATCTACCAGCCCCCCGAGCCCAGAAGCAGGCACCTCTCTGTCAGCTCCC

-continued

```
AGAACCCTGGCCGAAGCTCACCTCCCCCTGGCTATGTTCCTGAGCGGCAGCAGCACATTG

CCCGGCAGGGGTCCTACACCAGCATCAACAGTGAGGGGGAGTTCATCCCAGAGACCAGC

GAGCAGTGCATGCTGGATCCCCTGAGCAGTGCAGAAAATTCCTTGTCTGGAAGCTGCCAA

TCCTTGGACAGGTCAGCAGACAGCCCATCCTTCCGGAAATCACGAATGTCCCGTGCCCAG

AGCTTCCCTGACAACAGACAGGAATACTCAGATCGGGAAACTCAGCTTTATGACAAAGGG

GTCAAAGGTGGAACCTACCCCCGGCGCTACCACGTGTCTGTGCACCACAAGGACTACAGT

GATGGCAGAAGAACATTTCCCCGAATACGGCGTCATCAAGGCAACTTGTTCACCCTGGTG

CCCTCCAGCCGCTCCCTGAGCACAAATGGCGAGAACATGGGTCTGGCTGTGCAATACCTG

GACCCCCGTGGGCGCCTGCGGAGTGCGGACAGCGAGAATGCCCTCTCTGTGCAGGAGAG

GAATGTGCCAACCAAGTCTCCCAGTGCCCCCATCAACTGGCGCCGGGGAAAGCTCCTGGG

CCAGGGTGCCTTCGGCAGGGTCTATTTGTGCTATGACGTGGACACGGGACGTGAACTTGC

TTCCAAGCAGGTCCAATTTGATCCAGACAGTCCTGAGACAAGCAAGGAGGTGAGTGCTCT

GGAGTGCGAGATCCAGTTGCTAAAGAACTTGCAGCATGAGCGCATCGTGCAGTACTATGG

CTGTCTGCGGGACCGCGCTGAGAAGACCCTGACCATCTTCATGGAGTACATGCCAGGGGG

CTCGGTGAAAGACCAGTTGAAGGCTTACGGTGCTCTGACAGAGCGTGACCCGAAAGT

ACACGCGGCAGATCCTGGAGGGCATGTCCTACCTGCACAGCAACATGATTGTTCACCGGG

ACATTAAGGGAGCCAACATCCTCCGAGACTCTGCTGGGAATGTAAAGCTGGGGACTTTG

GGGCCAGCAAACGCCTGCAGACGATCTGTATGTCGGGGACGGGCATGCGCTCCGTCACTG

GCACACCCTACTGGATGAGCCCTGAGGTGATCAGCGGCGAGGGCTATGGAAGGAAAGCA

GACGTGTGGAGCCTGGGCTGCACTGTGGTGGAGATGCTGACAGAGAAACCACCGTGGGC

AGAGTATGAAGCTATGGCCGCCATCTTCAAGATTGCCACCCAGCCCACCAATCCTCAGCTG

CCCTCCCACATCTCTGAACATGGCCGGGACTTCCTGAGGCGCATTTTTGTGGAGGCTCGCC

AGAGACCTTCAGCTGAGGAGCTGCTCACACACCACTTTGCACAGCTCATGTACTGA
```

Human MEKK 6 CDS
(SEQ ID NO: 26)
```
ATGGCGGGGCCGTGTCCCCGGTCCGGGGCGGAGCGCGCCGGCAGCTGCTGGCAGGACCC

GCTGGCCGTGGCGCTGAGCCGGGGCCGGCAGCTCGCGGCGCCCCCGGGCCGGGGCTGCG

CGCGGAGCCGGCCGCTCAGCGTGGTCTACGTGCTGACCCGGGAGCCGCAGCCCGGGCTC

GAGCCTCGGGAGGGAACCGAGGCGGAGCCGCTGCCCCTGCGCTGCCTGCGCGAGGCTTG

CGCGCAGGTCCCCCGGCCGCGGCCGCCCCCGCAGCTGCGCAGCCTGCCCTTCGGGACGCT

GGAGCTAGGCGACACCGCGGCTCTGGATGCCTTCTACAACGCGGATGTGGTGGTGCTGGA

GGTGAGCAGCTCGCTGGTACAGCCCTCCCTGTTCTACCACCTTGGTGTGCGTGAGAGCTT

CAGCATGACCAACAATGTGCTCCTCTGCTCCCAGGCCGACCTCCCTGACCTGCAGGCCCT

GCGGGAGGATGTTTTCCAGAAGAACTCGGATTGCGTTGGCAGCTACACACTGATCCCCTAT

GTGGTGACGGCCACTGGTCGGGTGCTGTGTGGTGATGCAGGCCTTCTGCGGGGCCTGGCT

GATGGGCTGGTACAGGCTGGAGTGGGGACCGAGGCCCTGCTCACTCCCCTGGTGGGCCG

GCTTGCCCGCCTGCTGGAGGCCACACCCACAGACTCTTGTGGCTATTTCCGGGAGACCAT

TCGGCGGGACATCCGGCAGGCGCGGGAGCGGTTCAGTGGGCCACAGCTGCGGCAGGAGC

TGGCTCGCCTGCAGCGGAGACTGGACAGCGTGGAGCTGCTGAGCCCCGACATCATCATGA

ACTTGCTGCTCTCCTACCGCGATGTGCAGGACTACTCGGCCATCATTGAGCTGGTGGAGAC

GCTGCAGGCCTTGCCCACCTGTGATGTGGCCGAGCAGCATAATGTCTGCTTCCACTACACT

TTTGCCCTCAACCGGAGGAACAGGCCTGGGGACCGGGCGAAGGCCCTGTCTGTGCTGCT
```

-continued

```
GCCGCTGGTACAGCTTGAGGGCTCTGTGGCGCCCGATCTGTACTGCATGTGTGGCCGTATC

TACAAGGACATGTTCTTCAGCTCGGGTTTCCAGGATGCTGGGCACCGGGAGCAGGCCTAT

CACTGGTATCGCAAGGCTTTTGACGTAGAGCCCAGCCTTCACTCAGGCATCAATGCAGCTG

TGCTCCTCATTGCTGCCGGGCAGCACTTTGAGGATTCCAAAGAGCTCCGGCTAATAGGCAT

GAAGCTGGGCTGCCTGCTGGCCCGCAAAGGCTGCGTGGAGAAGATGCAGTATTACTGGGA

TGTGGGTTTCTACCTGGGAGCCCAGATCCTCGCCAATGACCCCACCCAGGTGGTGCTGGC

TGCAGAGCAGCTGTATAAGCTCAATGCCCCCATATGGTACCTGGTGTCCGTGATGGAGACC

TTCCTGCTCTACCAGCACTTCAGGCCCACGCCAGAGCCCCTGGAGGGCCACCACGCCGT

GCCCACTTCTGGCTCCACTTCTTGCTACAGTCCTGCCAACCATTCAAGACAGCCTGTGCCC

AGGGCGACCAGTGCTTGGTGCTGGTCCTGGAGATGAACAAGGTGCTGCTGCCTGCAAAG

CTCGAGGTTCGGGGTACTGACCCAGTAAGCACAGTGACCCTGAGCCTGCTGGAGCCTGAG

ACCCAGGACATTCCCTCCAGCTGGACCTTCCCAGTCGCCTCCATATGCGGAGTCAGCGCCT

CAAAGCGCGACGAGCGCTGCTGCTTCCTCTATGCACTCCCCCCGGCTCAGGACGTCCAGC

TGTGCTTCCCCAGCGTAGGGCACTGCCAGTGGTTCTGCGGCCTGATCCAGGCCTGGGTGA

CGAACCCGGATTCCACGGCGCCCGCGGAGGAGGCGGAGGGCGCGGGGGAGATGTTGGAG

TTTGATTATGAGTACACGGAGACGGGCGAGCGGCTGGTGCTGGGCAAGGGCACGTATGGG

GTGGTGTACGCGGGCCGCGATCGCCACACGAGGGTGCGCATCGCCATCAAGGAGATCCCG

GAGCGGGACAGCAGGTTCTCTCAGCCCCTGCATGAAGAGATCGCTCTTCACAGACGCCTG

CGCCACAAGAACATAGTGCGCTATCTGGGCTCAGCTAGCCAGGGCGGCTACCTTAAGATCT

TCATGGAGGAAGTGCCTGGAGGCAGCCTGTCCTCCTTGCTGCGGTCGGTGTGGGGACCCC

TGAAGGACAACGAGAGCACCATCAGTTTCTACACCCGCCAGATCCTGCAGGGACTTGGCT

ACTTGCACGACAACCACATCGTGCACAGGGACATAAAAGGGGACAATGTGCTGATCAACA

CCTTCAGTGGGCTGCTCAAGATTTCTGACTTCGGCACCTCCAAGCGGCTGGCAGGCATCA

CACCTTGCACTGAGACCTTCACAGGAACTCTGCAGTATATGGCCCCAGAAATCATTGACCA

GGGCCCACGCGGGTATGGGAAAGCAGCTGACATCTGGTCACTGGGCTGCACTGTCATTGA

GATGGCCACAGGTCGCCCCCCCTTCCACGAGCTCGGGAGCCCACAGGCTGCCATGTTTCA

GGTGGGTATGTACAAGGTCCATCCGCCAATGCCCAGCTCTCTGTCGGCCGAGGCCCAAGC

CTTTCTCCTCCGAACTTTTGAGCCAGACCCCCGCCTCCGAGCCAGCGCCCAGACACTGCT

GGGGGACCCCTTCCTGCAGCCTGGGAAAAGGAGCCGCAGCCCCAGCTCCCCACGACATG

CTCCACGGCCCTCAGATGCCCCTTCTGCCAGTCCCACTCCTTCAGCCAACTCAACCACCCA

GTCTCAGACATTCCCGTGCCCTCAGGCACCCTCTCAGCACCCACCCAGCCCCCCGAAGCG

CTGCCTCAGTTATGGGGGCACCAGCCAGCTCCGGGTGCCCGAGGAGCCTGCGGCCGAGG

AGCCTGCGTCTCCGGAGGAGAGTTCGGGGCTGAGCCTGCTGCACCAGGAGAGCAAGCGT

CGGGCCATGCTGGCCGCAGTATTGGAGCAGGAGCTGCCAGCGCTGGCGGAGAATCTGCAC

CAGGAGCAGAAGCAAGAGCAGGGGCCCGTCTGGGCAGAAACCATGTGGAAGAGCTGC

TGCGCTGCCTCGGGGCACACATCCACACTCCCAACCGCCGGCAGCTCGCCCAGGAGCTGC

GGGCGCTGCAAGGACGGCTGAGGGCCCAGGGCCTTGGGCCTGCGCTTCTGCACAGACCG

CTGTTTGCCTTCCCGGATGCGGTGAAGCAGATCCTCCGCAAGCGCCAGATCCGTCCACAC

TGGATGTTCGTTCTGGACTCACTGCTCAGCCGTGCTGTGCGGGCAGCCCTGGGTGTGCTA

GGACCGGAGGTGGAGAAGGAGGCGGTCTCACCGAGGTCAGAGGAGCTGAGTAATGAAG
```

-continued

```
GGGACTCCCAGCAGAGCCCAGGCCAGCAGAGCCCGCTTCCGGTGGAGCCCGAGCAGGGC

CCCGCTCCTCTGATGGTGCAGCTGAGCCTCTTGAGGGCAGAGACTGATCGGCTGCGCGAA

ATCCTGGCGGGGAAGGAACGGGAGTACCAGGCCCTGGTGCAGCGGGCTCTACAGCGGCT

GAATGAGGAAGCCCGGACCTATGTCCTGGCCCCAGAGCCTCCAACTGCTCTTTCAACGGA

CCAGGGCCTGGTGCAGTGGCTACAGGAACTGAATGTGGATTCAGGCACCATCCAAATGCT

GTTGAACCATAGCTTCACCCTCCACACTCTGCTCACCTATGCCACTCGAGATGACCTCATC

TACACCCGCATCAGGGGAGGGATGGTATGCCGCATCTGGAGGGCCATCTTGGCACAGCGA

GCAGGATCCACACCAGTCACCTCTGGACCCTGA
```

Human NIK CDS (SEQ ID NO: 27)
```
ATGGCAGTGATGGAAATGGCCTGCCCAGGTGCCCCTGGCTCAGCAGTGGGGCAGCAGAA

GGAACTCCCCAAAGCCAAGGAGAAGACGCCGCCACTGGGGAAGAAACAGAGCTCCGTC

TACAAGCTTGAGGCCGTGGAGAAGAGCCCTGTGTTCTGCGGAAAGTGGGAGATCCTGAAT

GACGTGATTACCAAGGGCACAGCCAAGGAAGGCTCCGAGGCAGGGCCAGCTGCCATCTC

TATCATCGCCCAGGCTGAGTGTGAGAATAGCCAAGAGTTCAGCCCCACCTTTTCAGAACG

CATTTTCATCGCTGGGTCCAAACAGTACAGCCAGTCCGAGAGTCTTGATCAGATCCCCAAC

AATGTGGCCCATGCTACAGAGGGCAAAATGGCCCGTGTGTGTTGGAAGGGAAAGCGTCG

CAGCAAAGCCCGGAAGAAACGGAAGAAGAAGAGCTCAAAGTCCCTGGCTCATGCAGGA

GTGGCCTTGGCCAAACCCCTCCCCAGGACCCCTGAGCAGGAGAGCTGCACCATCCCAGTG

CAGGAGGATGAGTCTCCACTCGGCGCCCCATATGTTAGAAACACCCCGCAGTTCACCAAG

CCTCTGAAGGAACCAGGCCTTGGGCAACTCTGTTTTAAGCAGCTTGGCGAGGGCCTACGG

CCCGGCTCTGCCTCGATCAGAACTCCACAAACTGATCAGCCCCTTGCAATGTCTGAACCAC

GTGTGGAAACTGCACCACCCCAGGACGGAGGCCCCTGCCCCTGCCCACGCACCCCTTC

CCCTATAGCAGACTGCCTCATCCCTTCCCATTCCACCCTCTCCAGCCCTGGAAACCTCACC

CTCTGGAGTCCTTCCTGGGCAAACTGGCCTGTGTAGACAGCCAGAAACCCTTGCCTGACC

CACACCTGAGCAAACTGGCCTGTGTAGACAGTCCAAAGCCCCTGCCTGGCCCACACCTGG

AGCCCAGCTGCCTGTCTCGTGGTGCCCATGAGAAGTTTTCTGTGGAGGAATACCTAGTGC

ATGCTCTGCAAGGCAGCGTGAGCTCAGGCCAGGCCCACAGCCTGACCAGCCTGGCCAAG

ACCTGGGCAGCAAGGGGCTCCAGATCCCGGGAGCCCAGCCCCAAAACTGAGGACAACGA

GGGTGTCCTGCTCACTGAGAAACTCAAGCCAGTGGATTATGAGTACCGAGAAGAAGTCCA

CTGGGCCACGCACCAGCTCCGCCTGGGCAGAGGCTCCTTCGGAGAGGTGCACAGGATGG

AGGACAAGCAGACTGGCTTCCAGTGCGCTGTCAAAAAGGTGCGGCTGGAAGTATTTCGG

GCAGAGGAGCTGATGGCATGTGCAGGATTGACCTCACCCAGAATTGTCCCTTTGTATGGA

GCTGTGAGAGAAGGGCCTTGGGTCAACATCTTCATGGAGCTGCTGGAAGGTGGCTCCCTG

GGCCAGCTGGTCAAGGAGCAGGGCTGTCTCCCAGAGGACCGGGCCCTGTACTACCTGGG

CCAGGCCCTGGAGGGTCTGGAATACCTCCACTCACGAAGGATTCTGCATGGGGACGTCAA

AGCTGACAACGTGCTCCTGTCCAGCGATGGGAGCCACGCAGCCCTCTGTGACTTTGGCCA

TGCTGTGTGTCTTCAACCTGATGGCCTGGGAAAGTCCTTGCTCACAGGGGACTACATCCCT

GGCACAGAGACCCACATGGCTCCGGAGGTGGTGCTGGGCAGGAGCTGCGACGCCAAGGT

GGATGTCTGGAGCAGCTGCTGTATGATGCTGCACATGCTCAACGGCTGCCACCCCTGGACT

CAGTTCTTCCGAGGGCCGCTCTGCCTCAAGATTGCCAGCGAGCCTCCGCCTGTGAGGGAG

ATCCCACCCTCCTGCGCCCCTCTCACAGCCCAGGCCATCCAAGAGGGGCTGAGGAAAGAG
```

-continued

```
CCCATCCACCGCGTGTCTGCAGCGGAGCTGGGAGGGAAGGTGAACCGGGCACTACAGCA
AGTGGGAGGTCTGAAGAGCCCTTGGAGGGGAGAATATAAAGAACCAAGACATCCACCGC
CAAATCAAGCCAATTACCACCAGACCCTCCATGCCCAGCCGAGAGAGCTTTCGCCAAGGG
CCCCAGGGCCCCGGCCAGCTGAGGAGACAACAGGCAGAGCCCCTAAGCTCCAGCCTCCT
CTCCCACCAGAGCCCCCAGAGCCAAACAAGTCTCCTCCCTTGACTTTGAGCAAGGAGGA
GTCTGGGATGTGGGAACCCTTACCTCTGTCCTCCCTGGAGCCAGCCCCTGCCAGAAACCC
CAGCTCACCAGAGCGGAAAGCAACCGTCCCGGAGCAGGAACTGCAGCAGCTGGAAATAG
AATTATTCCTCAACAGCCTGTCCCAGCCATTTTCTCTGGAGGAGCAGGAGCAAATTCTCTC
GTGCCTCAGCATCGACAGCCTCTCCCTGTCGGATGACAGTGAGAAGAACCCATCAAGGC
CTCTCAAAGCTCGCGGGACACCCTGAGCTCAGGCGTACACTCCTGGAGCAGCCAGGCCG
AGGCTCGAAGCTCCAGCTGGAACATGGTGCTGGCCCGGGGCGGCCCACCGACACCCCA
AGCTATTTCAATGGTGTGAAAGTCCAAATACAGTCTCTTAATGGTGAACACCTGCACATCC
GGGAGTTCCACCGGGTCAAAGTGGGAGACATCGCCACTGGCATCAGCAGCCAGATCCCA
GCTGCAGCCTTCAGCTTGGTCACCAAAGACGGGCAGCCTGTTCGCTACGACATGGAGGTG
CCAGACTCGGGCATCGACCTGCAGTGCACACTGGCCCCTGATGGCAGCTTCGCCTGGAGC
TGGAGGGTCAAGCATGGCCAGCTGGAGAACAGGCCCTAA
```

Human IKK CDS (SEQ ID NO: 28)
```
ATGTTTTCAGGGGGGTGTCATAGCCCCGGGTTTGGCCGCCCCAGCCCCGCCTTCCCGCCC
CGGGGAGCCCGCCCCCTGCCCCGCGTCCCTGCCGACAGGAAACAGGTGAGCAGATTGCC
ATCAAGCAGTGCCGGCAGGAGCTCAGCCCCCGGAACCGAGAGCGGTGGTGCCTGGAGAT
CCAGATCATGAGAAGGCTGACCCACCCCAATGTGGTGGCTGCCCGAGATGTCCCTGAGGG
GATGCAGAACTTGGCGCCCAATGACCTGCCCCTGCTGGCCATGGAGTACTGCCAAGGAGG
AGATCTCCGGAAGTACCTGAACCAGTTTGAGAACTGCTGTGGTCTGCGGGAAGGTGCCAT
CCTCACCTTGCTGAGTGACATTGCCTCTGCGCTTAGATACCTTCATGAAAACAGAATCATC
CATCGGGATCTAAAGCCAGAAAACATCGTCCTGCAGCAAGGAGAACAGAGGTTAATACAC
AAAATTATTGACCTAGGATATGCCAAGGAGCTGGATCAGGGCAGTCTTTGCACATCATTCG
TGGGGACCCTGCAGTACCTGGCCCCAGAGCTACTGGAGCAGCAGAAGTACACAGTGACC
GTCGACTACTGGAGCTTCGGCACCCTGGCCTTTGAGTGCATCACGGGCTTCCGGCCCTTCC
TCCCCAACTGGCAGCCCGTGCAGTGGCATTCAAAAGTGCGGCAGAAGAGTGAGGTGGAC
ATTGTTGTTAGCGAAGACTTGAATGGAACGGTGAAGTTTTCAAGCTCTTTACCCTACCCCA
ATAATCTTAACAGTGTCCTGGCTGAGCGACTGGAGAAGTGGCTGCAACTGATGCTGATGT
GGCACCCCCGACAGAGGGGCACGGATCCCACGTATGGGCCCAATGGCTGCTTCAAGGCCC
TGGATGACATCTTAAACTTAAAGCTGGTTCATATCTTGAACATGGTCACGGGCACCATCCA
CACCTACCCTGTGACAGAGGATGAGAGTCTGCAGAGCTTGAAGGCCAGAATCCAACAGG
ACACGGGCATCCCAGAGGAGGACCAGGAGCTGCTGCAGGAAGCGGGCCTGGCGTTGATC
CCCGATAAGCCTGCCACTCAGTGTATTTCAGACGGCAAGTTAAATGAGGGCCACACATTG
GACATGGATCTTGTTTTTCTCTTTGACAACAGTAAAATCACCTATGAGACTCAGATCTCCCC
ACGGCCCCAACCTGAAAGTGTCAGCTGTATCCTTCAAGAGCCCAAGAGGAATCTCGCCTT
CTTCCAGCTGAGGAAGGTGTGGGGCCAGGTCTGGCACAGCATCCAGACCCTGAAGGAAG
ATTGCAACCGGCTGCAGCAGGGACAGCGAGCCGCCATGATGAATCTCCTCCGAAACAACA
```

```
GCTGCCTCTCCAAAATGAAGAATTCCATGGCTTCCATGTCTCAGCAGCTCAAGGCCAAGTT

GGATTTCTTCAAAACCAGCATCCAGATTGACCTGGAGAAGTACAGCGAGCAAACCGAGTT

TGGGATCACATCAGATAAACTGCTGCTGGCCTGGAGGGAAATGGAGCAGGCTGTGGAGCT

CTGTGGGCGGGAGAACGAAGTGAAACTCCTGGTAGAACGGATGATGGCTCTGCAGACCG

ACATTGTGGACTTACAGAGGAGCCCCATGGGCCGGAAGCAGGGGGGAACGCTGGACGAC

CTAGAGGAGCAAGCAAGGGAGCTGTACAGGAGACTAAGGGAAAAACCTCGAGACCAGC

GAACTGAGGGTGACAGTCAGGAAATGGTACGGCTGCTGCTTCAGGCAATTCAGAGCTTCG

AGAAGAAAGTGCGAGTGATCTATACGCAGCTCAGTAAAACTGTGGTTTGCAAGCAGAAG

GCGCTGGAACTGTTGCCCAAGGTGGAAGAGGTGGTGAGCTTAATGAATGAGGATGAGAA

GACTGTTGTCCGGCTGCAGGAGAAGCGGCAGAAGGAGCTCTGGAATCTCCTGAAGATTG

CTTGTAGCAAGGTCCGTGGTCCTGTCAGTGGAAGCCCGGATAGCATGAATGCCTCTCGACT

TAGCCAGCCTGGGCAGCTGATGTCTCAGCCCTCCACGGCCTCCAACAGCTTACCTGAGCC

AGCCAAGAAGAGTGAAGAACTGGTGGCTGAAGCACATAACCTCTGCACCCTGCTAGAAA

ATGCCATACAGGACACTGTGAGGGAACAAGACCAGAGTTTCACGGCCCTAGACTGGAGCT

GGTTACAGACGGAAGAAGAAGAGCACAGCTGCCTGGAGCAGGCCTCATGA
```

Human NF-κB CDS
(SEQ ID NO: 29)
```
ATGGCAGAAGATGATCCATATTTGGGAAGGCCTGAACAAATGTTTCATTTGGATCCTTCTTT

GACTCATACAATATTTAATCCAGAAGTATTTCAACCACAGATGGCACTGCCAACAGATGGC

CCATACCTTCAAATATTAGAGCAACCTAAACAGAGAGGATTTCGTTTCCGTTATGTATGTGA

AGGCCCATCCCATGGTGGACTACCTGGTGCCTCTAGTGAAAAGAACAAGAAGTCTTACCC

TCAGGTCAAAATCTGCAACTATGTGGGACCAGCAAAGGTTATTGTTCAGTTGGTCACAAAT

GGAAAAAATATCCACCTGCATGCCCACAGCCTGGTGGGAAAACACTGTGAGGATGGGATC

TGCACTGTAACTGCTGGACCCAAGGACATGGTGGTCGGCTTCGCAAACCTGGGTATACTT

CATGTGACAAAGAAAAAGTATTTGAAACACTGGAAGCACGAATGACAGAGGCGTGTATA

AGGGGCTATAATCCTGGACTCTTGGTGCACCCTGACCTTGCCTATTTGCAAGCAGAAGGTG

GAGGGGACCGGCAGCTGGGAGATCGGGAAAAAGAGCTAATCCGCCAAGCAGCTCTGCAG

CAGACCAAGGAGATGGACCTCAGCGTGGTGCGGCTCATGTTTACAGCTTTTCTTCCGGATA

GCACTGGCAGCTTCACAAGGCGCCTGGAACCCGTGGTATCAGACGCCATCTATGACAGTA

AAGCCCCCAATGCATCCAACTTGAAAATTGTAAGAATGGACAGGACAGCTGGATGTGTGA

CTGGAGGGGAGGAAATTTATCTTCTTTGTGACAAAGTTCAGAAAGATGACATCCAGATTC

GATTTTATGAAGAGGAAGAAATGGTGGAGTCTGGGAAGGATTTGGAGATTTTTCCCCCA

CAGATGTTCATAGACAATTTGCCATTGTCTTCAAAACTCCAAAGTATAAAGATATTAATATT

ACAAAACCAGCCTCTGTGTTTGTCCAGCTTCGGAGGAAATCTGACTTGGAAACTAGTGAA

CCAAAACCTTTCCTCTACTATCCTGAAATCAAAGATAAAGAAGAAGTGCAGAGGAAACGT

CAGAAGCTCATGCCCAATTTTTCGGATAGTTTCGGCGGTGGTAGTGGTGCTGGAGCTGGA

GGCGGAGGCATGTTTGGTAGTGGCGGTGGAGGAGGGGCACTGGAAGTACAGGTCCAGG

GTATAGCTTCCCACACTATGGATTTCCTACTTATGGTGGGATTACTTTCCATCCTGGAACTAC

TAAATCTAATGCTGGGATGAAGCATGGAACCATGGACACTGAATCTAAAAAGGACCCTGA

AGGTTGTGACAAAAGTGATGACAAAAACACTGTAAACCTCTTTGGGAAAGTTATTGAAAC

CACAGAGCAAGATCAGGAGCCCAGCGAGGCCACCGTTGGGAATGGTGAGGTCACTCTAA

CGTATGCAACAGGAACAAAAGAAGAGAGTGCTGGAGTTCAGGATAACCTCTTTCTAGAGA
```

```
AGGCTATGCAGCTTGCAAAGAGGCATGCCAATGCCCTTTTCGACTACGCGGTGACAGGAG

ACGTGAAGATGCTGCTGGCCGTCCAGCGCCATCTCACTGCTGTGCAGGATGAGAATGGGG

ACAGTGTCTTACACTTAGCAATCATCCACCTTCATTCTCAACTTGTGAGGGATCTACTAGAA

GTCACATCTGGTTTGATTTCTGATGACATTATCAACATGAGAAATGATCTGTACCAGACGCC

CTTGCACTTGGCAGTGATCACTAAGCAGGAAGATGTGGTGGAGGATTTGCTGAGGGCTGG

GGCCGACCTGAGCCTTCTGGACCGCTTGGGTAACTCTGTTTTGCACCTAGCTGCCAAAGA

AGGACATGATAAAGTTCTCAGTATCTTACTCAAGCACAAAAAGGCAGCACTACTTCTTGAC

CACCCCAACGGGGACGGTCTGAATGCCATTCATCTAGCCATGATGAGCAATAGCCTGCCAT

GTTTGCTGCTGCTGGTGGCCGCTGGGGCTGACGTCAATGCTCAGGAGCAGAAGTCCGGGC

GCACAGCACTGCACCTGGCTGTGGAGCACGACAACATCTCATTGGCAGGCTGCCTGCTCC

TGGAGGGTGATGCCCATGTGGACAGTACTACCTACGATGGAACCACACCCCTGCATATAGC

AGCTGGGAGAGGGTCCACCAGGCTGGCAGCTCTTCTCAAAGCAGCAGGAGCAGATCCCC

TGGTGGAGAACTTTGAGCCTCTCTATGACCTGGATGACTCTTGGGAAAATGCAGGAGAGG

ATGAAGGAGTTGTGCCTGGAACCACGCCTCTAGATATGGCCACCAGCTGGCAGGTATTTG

ACATATTAAATGGGAAACCATATGAGCCAGAGTTTACATCTGATGATTTACTAGCACAAGG

AGACATGAAACAGCTGGCTGAAGATGTGAAGCTGCAGCTGTATAAGTTACTAGAAATTCC

TGATCCAGACAAAAACTGGGCTACTCTGGCGCAGAAATTAGGTCTGGGGATACTTAATAAT

GCCTTCCGGCTGAGTCCTGCTCCTTCCAAAACACTTATGGACAACTATGAGGTCTCTGGGG

GTACAGTCAGAGAGCTGGTGGAGGCCCTGAGACAAATGGGCTACACCGAAGCAATTGAA

GTGATCCAGGCAGCCTCCAGCCCAGTGAAGACCACCTCTCAGGCCCACTCGCTGCCTCTC

TCGCCTGCCTCCACAAGGCAGCAAATAGACGAGCTCCGAGACAGTGACAGTGTCTGCGA

CAGCGGCGTGGAGACATCCTTCCGCAAACTCAGCTTTACCGAGTCTCTGACCAGTGGTGC

CTCACTGCTAACTCTCAACAAAATGCCCCATGATTATGGGCAGGAAGGACCTCTAGAAGG

CAAAATTTAG

Human CD14 CDS
                                                       (SEQ ID NO: 30)
ATGGAGCGCGCGTCCTGCTTGTTGCTGCTGCTGCTGCCGCTGGTGCACGTCTCTGCGACC

ACGCCAGAACCTTGTGAGCTGGACGATGAAGATTTCCGCTGCGTCTGCAACTTCTCCGAA

CCTCAGCCCGACTGGTCCGAAGCCTTCCAGTGTGTGTCTGCAGTAGAGGTGGAGATCCAT

GCCGGCGGTCTCAACCTAGAGCCGTTTCTAAAGCGCGTCGATGCGGACGCCGACCCGCGG

CAGTATGCTGACACGGTCAAGGCTCTCCGCGTGCGGCGGCTCACAGTGGGAGCCGCACA

GGTTCCTGCTCAGCTACTGGTAGGCGCCCTGCGTGTGCTAGCGTACTCCCGCCTCAAGGA

ACTGACGCTCGAGGACCTAAAGATAACCGGCACCATGCCTCCGCTGCCTCTGGAAGCCAC

AGGACTTGCACTTTCCAGCTTGCGCCTACGCAACGTGTCGTGGGCGACAGGGCGTTCTTG

GCTCGCCGAGCTGCAGCAGTGGCTCAAGCCAGGCCTCAAGGTACTGAGCATTGCCCAAG

CACACTCGCCTGCCTTTTCCTGCGAACAGGTTCGCGCCTTCCCGGCCCTTACCAGCCTAGA

CCTGTCTGACAATCCTGGACTGGGCGAACGCGGACTGATGGCGGCTCTCTGTCCCCACAA

GTTCCCGGCCATCCAGAATCTAGCGCTGCGCAACACAGGAATGGAGACGCCCACAGGCGT

GTGCGCCGCACTGGCGGCGGCAGGTGTGCAGCCCCACAGCCTAGACCTCAGCCACAACT

CGCTGCGCGCCACCGTAAACCCTAGCGCTCCGAGATGCATGTGGTCCAGCGCCCTGAACT

CCCTCAATCTGTCGTTCGCTGGGCTGGAACAGGTGCCTAAAGGACTGCCAGCCAAGCTCA
```

```
GAGTGCTCGATCTCAGCTGCAACAGACTGAACAGGGCGCCGCAGCCTGACGAGCTGCCC

GAGGTGGATAACCTGACACTGGACGGGAATCCCTTCCTGGTCCCTGGAACTGCCCTCCCC

CACGAGGGCTCAATGAACTCCGGCGTGGTCCCAGCCTGTGCACGTTCGACCCTGTCGGTG

GGGGTGTCGGGAACCCTGGTGCTGCTCCAAGGGGCCCGGGGCTTTGCCTAA

Human MyD88 CDS
                                                  (SEQ ID NO: 31)
ATGCGACCCGACCGCGCTGAGGCTCCAGGACCGCCCGCCATGGCTGCAGGAGGTCCCGG

CGCGGGGTCTGCGGCCCCGGTCTCCTCCACATCCTCCCTTCCCCTGGCTGCTCTCAACATG

CGAGTGCGGCGCCGCCTGTCTCTGTTCTTGAACGTGCGGACACAGGTGGCGGCCGACTGG

ACCGCGCTGGCGGAGGAGATGGACTTTGAGTACTTGGAGATCCGGCAACTGGAGACACA

AGCGGACCCCACTGGCAGGCTGCTGGACGCCTGGCAGGGACGCCCTGGCGCCTCTGTAG

GCCGACTGCTCGAGCTGCTTACCAAGCTGGGCCGCGACGACGTGCTGCTGGAGCTGGGA

CCCAGCATTGGTGCCGCCGGATGGTGGTGGTTGTCTCTGATGATTACCTGCAGAGCAAGG

AATGTGACTTCCAGACCAAATTTGCACTCAGCCTCTCTCCAGGTGCCCATCAGAAGCGAC

TGA

Human IRAK CDS
                                                  (SEQ ID NO: 32)
ATGGCCGGGGGCCGGGCCCGGGGGAGCCCGCAGCCCCCGGCGCCCAGCACTTCTTGTA

CGAGGTGCCGCCCTGGGTCATGTGCCGCTTCTACAAAGTGATGGACGCCCTGGAGCCCGC

CGACTGGTGCCAGTTCGCCGCCCTGATCGTGCGCGACCAGACCGAGCTGCGGCTGTGCGA

GCGCTCCGGGCAGCGCACGGCCAGCGTCCTGTGGCCCTGGATCAACCGCAACGCCCGTGT

GGCCGACCTCGTGCACATCCTCACGCACCTGCAGCTGCTCCGTGCGCGGGACATCATCAC

AGCCTGGCACCCTCCCGCCCCGCTTCCGTCCCCAGGCACCACTGCCCCGAGGCCCAGCAG

CATCCCTGCACCCGCCGAGGCCGAGGCCTGGAGCCCCCGGAAGTTGCCATCCTCAGCCTC

CACCTTCCTCTCCCCAGCTTTTCCAGGCTCCCAGACCCATTCAGGGCCTGAGCTCGGCCTG

GTCCCAAGCCCTGCTTCCCTGTGGCCTCCACCGCCATCTCCAGCCCCTTCTTCTACCAAGC

CAGGCCCAGAGAGCTCAGTGTCCCTCCTGCAGGGAGCCCGCCCCTTTCCGTTTTGCTGGC

CCCTCTGTGAGATTTCCCGGGGCACCCACAACTTCTCGGAGGAGCTCAAGATCGGGGAGG

GTGGCTTTGGGTGCGTGTACCGGGCGGTGATGAGGAACACGGTGTATGCTGTGAAGAGGC

TGAAGGAGAACGCTGACCTGGAGTGGACTGCAGTGAAGCAGAGCTTCCTGACCGAGGTG

GAGCAGCTGTCCAGGTTTCGTCACCCAAACATTGTGGACTTTGCTGGCTACTGTGCTCAG

AACGGCTTCTACTGCCTGGTGTACGGCTTCCTGCCCAACGGCTCCCTGGAGGACCGTCTC

CACTGCCAGACCCAGGCCTGCCCACCTCTCTCCTGGCCTCAGCGACTGGACATCCTTCTG

GGTACAGCCCGGGCAATTCAGTTTCTACATCAGGACAGCCCCAGCCTCATCCATGGAGAC

ATCAAGAGTTCCAACGTCCTTCTGGATGAGAGGCTGACACCCAAGCTGGGAGACTTTGGC

CTGGCCCGGTTCAGCCGCTTTGCCGGGTCCAGCCCCAGCCAGAGCAGCATGGTGGCCCGG

ACACAGACAGTGCGGGGCACCCTGGCCTACCTGCCCGAGGAGTACATCAAGACGGGAAG

GCTGGCTGTGGACACGGACACCTTCAGCTTTGGGGTGGTAGTGCTAGAGACCTTGGCTGG

TCAGAGGGCTGTGAAGACGCACGGTGCCAGGACCAAGTATCTGAAAGACCTGGTGGAAG

AGGAGGCTGAGGAGGCTGGAGTGGCTTTGAGAAGCACCCAGAGCACACTGCAAGCAGG

TCTGGCTGCAGATGCCTGGGCTGCTCCCATCGCCATGCAGATCTACAAGAAGCACCTGGA

CCCCAGGCCCGGGCCTGCCCACCTGAGCTGGGCCTGGGCCTGGGCCAGCTGGCCTGCTG

CTGCCTGCACCGCCGGGCCAAAAGGAGGCCTCCTATGACCCAGGAGAACTCCTACGTGTC
```

-continued

CAGCACTGGCAGAGCCCACAGTGGGGCTGCTCCATGGCAGCCCCTGGCAGCGCCATCAG

GAGCCAGTGCCCAGGCAGCAGAGCAGCTGCAGAGAGGCCCCAACCAGCCCGTGGAGAG

TGACGAGAGCCTAGGCGGCCTCTCTGCTGCCCTGCGCTCCTGGCACTTGACTCCAAGCTG

CCCTCTGGACCCAGCACCCCTCAGGGAGGCCGGCTGTCCTCAGGGGACACGGCAGGAG

AATCGAGCTGGGGGAGTGGCCCAGGATCCCGGCCCACAGCCGTGGAAGGACTGGCCCTT

GGCAGCTCTGCATCATCGTCGTCAGAGCCACCGCAGATTATCATCAACCCTGCCCGACAGA

AGATGGTCCAGAAGCTGGCCCTGTACGAGGATGGGGCCCTGGACAGCCTGCAGCTGCTGT

CGTCCAGCTCCCTCCCAGGCTTGGGCCTGGAACAGGACAGGCAGGGGCCCGAAGAAAGT

GATGAATTTCAGAGCTGA

Human LBP CDS
(SEQ ID NO: 33)
ATGGGGGCCTTGGCCAGAGCCCTGCCGTCCATACTGCTGGCATTGCTGCTTACGTCCACCC

CAGAGGCTCTGGGTGCCAACCCCGGCTTGGTCGCCAGGATCACCGACAAGGGACTGCAG

TATGCGGCCCAGGAGGGGCTATTAGCTCTGCAGAGTGAGCTGCTCAGGATCACGCTGCCT

GACTTCACCGGGGACTTGAGGATCCCCCACGTCGGCCGTGGGCGCTATGAGTTCCACAGC

CTGAACATCCACAGCTGTGAGCTGCTTCACTCTGCGCTGAGGCCTGTCCCTGGCCAGGGC

CTGAGTCTCAGCATCTCCGACTCCTCCATCCGGGTCCAGGGCAGGTGGAAGGTGCGCAAG

TCATTCTTCAAACTACAGGGCTCCTTTGATGTCAGTGTCAAGGGCATCAGCATTTCGGTCA

ACCTCCTGTTGGGCAGCGAGTCCTCCGGGAGGCCCACAGTTACTGCCTCCAGCTGCAGCA

GTGACATCGCTGACGTGGAGGTGGACATGTCGGGAGACTTGGGGTGGCTGTTGAACCTCT

TCCACAACCAGATTGAGTCCAAGTTCCAGAAAGTACTGGAGAGCAGGATTTGCGAAATGA

TCCAGAAATCAGTGTCCTCCGATCTACAGCCTTATCTCCAAACTCTGCCAGTTACAACAGA

GATTGACAGTTTCGCCGACATTGATTATAGCTTAGTGGAAGCCCCTCGGGCAACAGCCCAG

ATGCTGGAGGTGATGTTTAAGGGTGAAATCTTTCATCGTAACCACCGTTCTCCAGTTACCC

TCCTTGCTGCAGTCATGAGCCTTCCTGAGGAACACAACAAAATGGTCTACTTTGCCATCTC

GGATTATGTCTTCAACACGGCCAGCCTGGTTTATCATGAGGAAGGATATCTGAACTTCTCC

ATCACAGATGACATGATACCGCCTGACTCTAATATCCGACTGACCACCAAGTCCTTCCGAC

CCTTCGTCCCACGGTTAGCCAGGCTCTACCCCAACATGAACCTGGAACTCCAGGGATCAG

TGCCCTCTGCTCCGCTCCTGAACTTCAGCCCTGGGAATCTGTCTGTGGACCCCTATATGGA

GATAGATGCCTTTGTGCTCCTGCCCAGCTCCAGCAAGGAGCCTGTCTTCCGGCTCAGTGTG

GCCACTAATGTGTCCGCCACCTTGACCTTCAATACCAGCAAGATCACTGGGTTCCTGAAGC

CAGGAAAGGTAAAAGTGGAACTGAAAGAATCCAAAGTTGGACTATTCAATGCAGAGCTG

TTGGAAGCGCTCCTCAACTATTACATCCTTAACACCTTCTACCCCAAGTTCAATGATAAGTT

GGCCGAAGGCTTCCCCCTTCCTCTGCTGAAGCGTGTTCAGCTCTACGACCTTGGGCTGCA

GATCCATAAGGACTTCCTGTTCTTGGGTGCCAATGTCCAATACATGAGAGTTTGA

Human TRAF6 CDS
(SEQ ID NO: 34)
ATGAGTCTGCTAAACTGTGAAAACAGCTGTGGATCCAGCCAGTCTGAAAGTGACTGCTGT

GTGGCCATGGCCAGCTCCTGTAGCGCTGTAACAAAAGATGATAGTGTGGGTGGAACTGCC

AGCACGGGGAACCTCTCCAGCTCATTTATGGAGGAGATCCAGGGATATGATGTAGAGTTTG

ACCCACCCCTGGAAAGCAAGTATGAATGCCCCATCTGCTTGATGGCATTACGAGAAGCAG

TGCAAACGCCATGCGGCCATAGGTTCTGCAAAGCCTGCATCATAAAATCAATAAGGGATGC

-continued
```
AGGTCACAAATGTCCAGTTGACAATGAAATACTGCTGGAAAATCAACTATTTCCAGACAAT

TTTGCAAAACGTGAGATTCTTTCTCTGATGGTGAAATGTCCAAATGAAGGTTGTTTGCACA

AGATGGAACTGAGACATCTTGAGGATCATCAAGCACATTGTGAGTTTGCTCTTATGGATTG

TCCCCAATGCCAGCGTCCCTTCCAAAAATTCCATATTAATATTCACATTCTGAAGGATTGTC

CAAGGAGACAGGTTTCTTGTGACAACTGTGCTGCATCAATGGCATTTGAAGATAAAGAGA

TCCATGACCAGAACTGTCCTTTGGCAAATGTCATCTGTGAATACTGCAATACTATACTCATC

AGAGAACAGATGCCTAATCATTATGATCTAGACTGCCCTACAGCCCCAATTCCATGCACATT

CAGTACTTTTGGTTGCCATGAAAAGATGCAGAGGAATCACTTGGCACGCCACCTACAAGA

GAACACCCAGTCACACATGAGAATGTTGGCCCAGGCTGTTCATAGTTTGAGCGTTATACCC

GACTCTGGGTATATCTCAGAGGTCCGGAATTTCCAGGAAACTATTCACCAGTTAGAGGGTC

GCCTTGTAAGACAAGACCATCAAATCCGGGAGCTGACTGCTAAAATGGAAACTCAGAGTA

TGTATGTAAGTGAGCTCAAACGAACCATTCGAACCCTTGAGGACAAAGTTGCTGAAATCG

AAGCACAGCAGTGCAATGGAATTTATATTTGGAAGATTGGCAACTTTGGAATGCATTTGAA

ATGTCAAGAAGAGGAGAAACCTGTTGTGATTCATAGCCCTGGATTCTACACTGGCAAACC

CGGGTACAAACTGTGCATGCGCTTGCACCTTCAGTTACCGACTGCTCAGCGCTGTGCAAA

CTATATATCCCTTTTTGTCCACACAATGCAAGGAGAATATGACAGCCACCTCCCTTGGCCCT

TCCAGGGTACAATACGCCTTACAATTCTTGATCAGTCTGAAGCACCTGTAAGGCAAAACCA

CGAAGAGATAATGGATGCCAAACCAGAGCTGCTTGCTTTCCAGCGACCCACAATCCCACG

GAACCCAAAAGGTTTTGGCTATGTAACTTTTATGCATCTGGAAGCCCTAAGACAAAGAACT

TTCATTAAGGATGACACATTATTAGTGCGCTGTGAGGTCTCCACCCGCTTTGACATGGGTA

GCCTTCGGAGGGAGGGTTTTCAGCCACGAAGTACTGATGCAGGGGTATAG

Human K-Ras CDS
                                                   (SEQ ID NO: 35)
ATGACTGAATATAAACTTGTGGTAGTTGGAGCTGGTGGCGTAGGCAAGAGTGCCTTGACG

ATACAGCTAATTCAGAATCATTTTGTGGACGAATATGATCCAACAATAGAGGATTCCTACAG

GAAGCAAGTAGTAATTGATGGAGAAACCTGTCTCTTGGATATTCTCGACACAGCAGGTCA

AGAGGAGTACAGTGCAATGAGGGACCAGTACATGAGGACTGGGGAGGGCTTTCTTTGTGT

ATTTGCCATAAATAATACTAAATCATTTGAAGATATTCACCATTATAGAGAACAAATTAAA

GAGTTAAGGACTCTGAAGATGTACCTATGGTCCTAGTAGGAAATAAATGTGATTTGCCTTCT

AGAACAGTAGACACAAAACAGGCTCAGGACTTAGCAAGAAGTTATGGAATTCCTTTTATT

GAAACATCAGCAAAGACAAGACAGGGTGTTGATGATGCCTTCTATACATTAGTTCGAGAA

ATTCGAAAACATAAAGAAAAGATGAGCAAAGATGGTAAAAAGAAGAAAAAGAAGTCAAA

GACAAAGTGTGTAATTATGTAA

Human N-Ras CDS
                                                   (SEQ ID NO: 36)
ATGACTGAGTACAAACTGGTGGTGGTTGGAGCAGGTGGTGTTGGGAAAAGCGCACTGAC

AATCCAGCTAATCCAGAACCACTTTGTAGATGAATATGATCCCACCATAGAGGATTCTTACA

GAAAACAAGTGGTTATAGATGGTGAAACCTGTTTGTTGGACATACTGGATACAGCTGGAC

AAGAAGAGTACAGTGCCATGAGAGACCAATACATGAGGACAGGCGAAGGCTTCCTCTGT

GTATTTGCCATCAATAATAGCAAGTCATTTGCGGATATTAACCTCTACAGGGAGCAGATTAA

GCGAGTAAAAGACTCGGATGATGTACCTATGGTGCTAGTGGGAAACAAGTGTGATTTGCC

AACAAGGACAGTTGATACAAAACAAGCCCACGAACTGGCCAAGAGTTACGGGATTCCATT

CATTGAAACCTCAGCCAAGACCAGACAGGGTGTTGAAGATGCTTTTTACACACTGGTAAG
```

-continued

AGAAATACGCCAGTACCGAATGAAAAAACTCAACAGCAGTGATGATGGGACTCAGGGTTG

TATGGGATTGCCATGTGTGGTGATGTAA

Human Raf CDS (SEQ ID NO: 37)

ATGGCTAGCAAACGAAAATCTACAACTCCATGCATGGTTCGGACATCACAAGTAGTAGAA

CAAGATGTGCCCGAGGAAGTAGACAGGGCCAAAGAGAAAGGAATCGGCACACCACAGC

CTGACGTGGCCAAGGACAGTTGGGCAGCAGAACTTGAAAACTCTTCCAAAGAAAACGAA

GTGATAGAGGTGAAATCTATGGGGGAAAGCCAGTCCAAAAAACTCCAAGGTGGTTATGAG

TGCAAATACTGCCCCTACTCCACGCAAAACCTGAACGAGTTCACGGAGCATGTCGACATG

CAGCATCCCAACGTGATTCTCAACCCCCTCTACGTGTGTGCAGAATGTAACTTCACAACCA

AAAAGTACGACTCCCTATCCGACCACAACTCCAAGTTCCATCCCGGGGAGGCCAACTTCA

AGCTGAAGTTAATTAAACGCAATAATCAAACTGTCTTGGAACAGTCCATCGAAACCACCA

ACCATGTCGTGTCCATCACCACCAGTGGCCCTGGAACTGGTGACAGTGATTCTGGGATCTC

GGTGAGTAAAACCCCCATCATGAAGCCTGGAAAACCAAAAGCGGATGCCAAGAAGGTGC

CCAAGAAGCCCGAGGAGATCACCCCCGAGAACCACGTGGAAGGGACCGCCCGCCTGGTG

ACAGACACAGCTGAGATCCTCTCGAGACTCGGCGGGGTGGAGCTCCTCCAAGACACATTA

GGACACGTCATGCCTTCTGTACAGCTGCCACCAAATATCAACCTTGTGCCCAAGGTCCCTG

TCCCACTAAATACTACCAAATACAACTCTGCCCTGGATACAAATGCCACGATGATCAACTC

TTTCAACAAGTTTCCTTACCCGACCCAGGCTGAGTTGTCCTGGCTGACAGCTGCCTCCAA

ACACCCAGAGGAGCACATCAGAATCTGGTTTGCCACCCAGCGCTTAAAGCATGGCATCAG

CTGGTCCCCAGAAGAGGTGGAGGAGGCCCGGAAGAAGATGTTCAACGGCACCATCCAGT

CAGTACCCCCGACCATCACTGTGCTGCCCGCCCAGTTGGCCCCCACAAAGGTGACGCAGC

CCATCCTCCAGACGGCTCTACCGTGCCAGATCCTCGGCCAGACTAGCCTGGTGCTGACTCA

GGTGACCAGCGGGTCAACAACCGTCTCTTGCTCCCCCATCACACTTGCCGTGGCAGGAGT

CACCAACCATGGCCAGAAGAGACCCTTGGTGACTCCCCAAGCTGCCCCCGAACCCAAGC

GTCCACACATCGCTCAGGTGCCAGAGCCCCCACCCAAGGTGGCCAACCCCCCGCTCACAC

CAGCCAGTGACCGCAAGAAGACAAAGGAGCAGATAGCACATCTCAAGGCCAGCTTTCTC

CAGAGCCAGTTCCCTGACGATGCCGAGGTTTACCGGCTCATCGAGGTGACTGGCCTTGCC

AGGAGCGAGATCAAGAAGTGGTTCAGTGACCACCGATATCGGTGTCAAAGGGGCATCGTC

CACATCACCAGCGAATCCCTTGCCAAAGACCAGTTGGCCATCGCGGCCTCCCGACACGGT

CGCACGTATCATGCGTACCCAGACTTTGCCCCCCAGAAGTTCAAAGAGAAAACACAGGGT

CAGGTTAAAATCTTGGAAGACAGCTTTTTGAAAAGTTCTTTTCCTACCCAAGCAGAACTG

GATCGGCTAAGGGTGGAGACCAAGCTGAGCAGGAGAGAGATCGACTCCTGGTTCTCGGA

GAGGCGGAAGCTTCGAGACAGCATGGAACAAGCTGTCTTGGATTCCATGGGGTCTGGCAA

AAAAGGCCAAGATGTGGGAGCCCCCAATGGTGCTCTGTCTCGACTCGACCAGCTCTCCGG

TGCCCAGTTAACAAGTTCTCTGCCCAGCCCTTCGCCAGCAATTGCAAAAAGTCAAGAACA

GGTTCATCTCCTGAGGAGCACGTTTGCAAGAACCCAGTGGCCTACTCCCCAGGAGTACGA

CCAGTTAGCGGCCAAGACTGGCCTGGTCCGAACTGAGATTGTGCGTTGGTTCAAGGAGAA

CAGATGCTTGCTGAAAACGGGAACCGTGAAGTGGATGGAGCAGTACCAGCACCAGCCCA

TGGCAGATGATCACGGCTACGATGCCGTAGCAAGGAAAGCAACAAAACCCATGGCCGAG

AGCCCAAAGAACGGGGGTGATGTGGTTCCACAATATTACAAGGACCCCAAAAAGCTCTGC

```
GAAGAGGACTTGGAGAAGTTGGTGACCAGGGTAAAAGTAGGCAGCGAGCCAGCAAAAG

ACTGTTTGCCAGCAAAGCCCTCAGAGGCCACCTCAGACCGGTCAGAGGGCAGCAGCCGG

GACGGCCAGGGTAGCGACGAGAACGAGGAGTCGAGCGTTGTGGATTACGTGGAGGTGAC

GGTCGGGGAGGAGGATGCGATCTCAGATAGATCAGATAGCTGGAGTCAGGCTGCGGCAGA

AGGTGTGTCGGAACTGGCTGAATCAGACTCCGACTGCGTCCCTGCAGAGGCTGGCCAGG

CCTAG

Human MEK1 CDS
                                                       (SEQ ID NO: 38)
ATGCCCAAGAAGAAGCCGACGCCCATCCAGCTGAACCCGGCCCCCGACGGCTCTGCAGTT

AACGGGACCAGCTCTGCGGAGACCAACTTGGAGGCCTTGCAGAAGAAGCTGGAGGAGCT

AGAGCTTGATGAGCAGCAGCGAAAGCGCCTTGAGGCCTTTCTTACCCAGAAGCAGAAGG

TGGGAGAACTGAAGGATGACGACTTTGAGAAGATCAGTGAGCTGGGGGCTGGCAATGGC

GGTGTGGTGTTCAAGGTCTCCCACAAGCCTTCTGGCCTGGTCATGGCCAGAAAGCTAATT

CATCTGGAGATCAAACCCGCAATCCGGAACCAGATCATAAGGGAGCTGCAGGTTCTGCAT

GAGTGCAACTCTCCGTACATCGTGGGCTTCTATGGTGCGTTCTACAGCGATGGCGAGATCA

GTATCTGCATGGAGCACATGGATGGAGGTTCTCTGGATCAAGTCCTGAAGAAAGCTGGAA

GAATTCCTGAACAAATTTTAGGAAAAGTTAGCATTGCTGTAATAAAAGGCCTGACATATCT

GAGGGAGAAGCACAAGATCATGCACAGAGATGTCAAGCCCTCCAACATCCTAGTCAACTC

CCGTGGGGAGATCAAGCTCTGTGACTTTGGGGTCAGCGGGCAGCTCATCGACTCCATGGC

CAACTCCTTCGTGGGCACAAGGTCCTACATGTCGCCAGAAAGACTCCAGGGGACTCATTA

CTCTGTGCAGTCAGACATCTGGAGCATGGGACTGTCTCTGGTAGAGATGGCGGTTGGGAG

GTATCCCATCCCTCCTCCAGATGCCAAGGAGCTGGAGCTGATGTTTGGGTGCCAGGTGGA

AGGAGATGCGGCTGAGACCCCACCCAGGCCAAGGACCCCCGGGAGGCCCCTTAGCTCAT

ACGGAATGGACAGCCGACCTCCCATGGCAATTTTTGAGTTGTTGGATTACATAGTCAACGA

GCCTCCTCCAAAACTGCCCAGTGGAGTGTTCAGTCTGGAATTTCAAGATTTTGTGAATAAA

TGCTTAATAAAAAACCCCGCAGAGAGAGCAGATTTGAAGCAACTCATGGTTCATGCTTTTA

TCAAGAGATCTGATGCTGAGGAAGTGGATTTTGCAGGTTGGCTCTGCTCCACCATCGGCCT

TAACCAGCCCAGCACACCAACCCATGCTGCTGGCGTCTAA

Human MEK2 CDS
                                                       (SEQ ID NO: 39)
ATGCTGGCCCGGAGGAAGCCGGTGCTGCCGGCGCTCACCATCAACCCTACCATCGCCGAG

GGCCCATCCCCTACCAGCGAGGGCGCCTCCGAGGCAAACCTGGTGGACCTGCAGAAGAA

GCTGGAGGAGCTGGAACTTGACGAGCAGCAGAAGAAGCGGCTGGAAGCCTTTCTCACCC

AGAAAGCCAAGGTCGGCGAACTCAAAGACGATGACTTCGAAAGGATCTCAGAGCTGGGC

GCGGGCAACGGCGGGGTGGTCACCAAAGTCCAGCACAGACCCTCGGGCCTCATCATGGC

CAGGAAGCTGATCCACCTTGAGATCAAGCCGGCCATCCGGAACCAGATCATCCGCGAGCT

GCAGGTCCTGCACGAATGCAACTCGCCGTACATCGTGGGCTTCTACGGGGCCTTCTACAGT

GACGGGGAGATCAGCATTTGCATGGAACACATGGACGGCGGCTCCCTGGACCAGGTGCTG

AAAGAGGCCAAGAGGATTCCCGAGGAGATCCTGGGGAAAGTCAGCATCGCGGTTCTCCG

GGGCTTGGCGTACCTCCGAGAGAAGCACCAGATCATGCACCGAGATGTGAAGCCCTCCAA

CATCCTCGTGAACTCTAGAGGGGAGATCAAGCTGTGTGACTTCGGGGTGAGCGGCCAGCT

CATCGACTCCATGGCCAACTCCTTCGTGGGCACGCGCTCCTACATGGCTCCGGAGCGGTTG

CAGGGCACACATTACTCGGTGCAGTCGGACATCTGGAGCATGGGCCTGTCCCTGGTGGAG
```

-continued

```
CTGGCCGTCGGAAGGTACCCCATCCCCCCGCCCGACGCCAAAGAGCTGGAGGCCATCTTT
GGCCGGCCCGTGGTCGACGGGGAAGAAGGAGAGCCTCACAGCATCTCGCCTCGGCCGAG
GCCCCCGGGCGCCCCGTCAGCGGTCACGGGATGGATAGCCGGCCTGCCATGGCCATCTT
TGAACTCCTGGACTATATTGTGAACGAGCCACCTCCTAAGCTGCCCAACGGTGTGTTCACC
CCCGACTTCCAGGAGTTTGTCAATAAATGCCTCATCAAGAACCCAGCGGAGCGGGCGGAC
CTGAAGATGCTCACAAACCACACCTTCATCAAGCGGTCCGAGGTGGAAGAAGTGGATTTT
GCCGGCTGGTTGTGTAAAACCCTGCGGCTGAACCAGCCCGGCACACCCACGCGCACCGC
CGTGTGA
```

Human ERK1 CDS
(SEQ ID NO: 40)
```
ATGGCGGCGGCGGCGGCTCAGGGGGGCGGGGGCGGGGAGCCCCGTAGAACCGAGGGGG
TCGGCCCGGGGGTCCCGGGGGAGGTGGAGATGGTGAAGGGGCAGCCGTTCGACGTGGGC
CCGCGCTACACGCAGTTGCAGTACATCGGCGAGGGCGCGTACGGCATGGTCAGCTCGGCC
TATGACCACGTGCGCAAGACTCGCGTGGCCATCAAGAAGATCAGCCCCTTCGAACATCAG
ACCTACTGCCAGCGCACGCTCCGGGAGATCCAGATCCTGCTGCGCTTCCGCCATGAGAAT
GTCATCGGCATCCGAGACATTCTGCGGGCGTCCACCCTGGAAGCCATGAGAGATGTCTAC
ATTGTGCAGGACCTGATGGAGACTGACCTGTACAAGTTGCTGAAAAGCCAGCAGCTGAGC
AATGACCATATCTGCTACTTCCTCTACCAGATCCTGCGGGGCCTCAAGTACATCCACTCCGC
CAACGTGCTCCACCGAGATCTAAAGCCCTCCAACCTGCTCATCAACACCACCTGCGACCT
TAAGATTTGTGATTTCGGCCTGGCCCGGATTGCCGATCCTGAGCATGACCACACCGGCTTC
CTGACGGAGTATGTGGCTACGCGCTGGTACCGGGCCCCAGAGATCATGCTGAACTCCAAG
GGCTATACCAAGTCCATCGACATCTGGTCTGTGGGCTGCATTCTGGCTGAGATGCTCTCTA
ACCGGCCCATCTTCCCTGGCAAGCACTACCTGGATCAGCTCAACCACATTCTGGGCATCCT
GGGCTCCCCATCCCAGGAGGACCTGAATTGTATCATCAACATGAAGGCCCGAAACTACCTA
CAGTCTCTGCCCTCCAAGACCAAGGTGGCTTGGGCCAAGCTTTTCCCCAAGTCAGACTCC
AAAGCCCTTGACCTGCTGGACCGGATGTTAACCTTTAACCCCAATAAACGGATCACAGTG
GAGGAAGCGCTGGCTCACCCCTACCTGGAGCAGTACTATGACCCGACGGATGAGGTGGGC
CAGTCCCCAGCAGCAGTGGGGCTGGGGGCAGGGGAGCAGGGGGGCACGTAG
```

Human ERK2 CDS
(SEQ ID NO: 41)
```
ATGGCGGCGGCGGCGGCGGGGGCGCGGGCCCGGAGATGGTCCGCGGGCAGGTGTTCGA
CGTGGGGCCGCGCTACACCAACCTCTCGTACATCGGCGAGGGCGCCTACGGCATGGTGTG
CTCTGCTTATGATAATGTCAACAAAGTTCGAGTAGCTATCAAGAAAATCAGCCCCTTTGAG
CACCAGACCTACTGCCAGAGAACCCTGAGGGAGATAAAAATCTTACTGCGCTTCAGACAT
GAGAACATCATTGGAATCAATGACATTATTCGAGCACCAACCATCGAGCAAATGAAAGATG
TATATATAGTACAGGACCTCATGGAAACAGATCTTTACAAGCTCTTGAAGACACAACACCT
CAGCAATGACCATATCTGCTATTTTCTCTACCAGATCCTCAGAGGGTTAAAATATATCCATTC
AGCTAACGTTCTGCACCGTGACCTCAAGCCTTCCAACCTGCTGCTCAACACCACCTGTGA
TCTCAAGATCTGTGACTTTGGCCTGGCCCGTGTTGCAGATCCAGACCATGATCACACAGGG
TTCCTGACAGAATATGTGGCCACACGTTGGTACAGGGCTCCAGAAATTATGTTGAATTCCA
AGGGCTACACCAAGTCCATTGATATTTGGTCTGTAGGCTGCATTCTGGCAGAAATGCTTTC
TAACAGGCCCATCTTTCCAGGGAAGCATTATCTTGACCAGCTGAACCACATTTTGGGTATT
```

-continued

```
CTTGGATCCCCATCACAAGAAGACCTGAATTGTATAATAAATTTAAAAGCTAGGAACTATTT

GCTTTCTCTTCCACACAAAAATAAGGTGCCATGGAACAGGCTGTTCCCAAATGCTGACTCC

AAAGCTCTGGACTTATTGGACAAAATGTTGACATTCAACCCACACAAGAGGATTGAAGTA

GAACAGGCTCTGGCCCACCCATATCTGGAGCAGTATTACGACCCGAGTGACGAGCCCATC

GCCGAAGCACCATTCAAGTTCGACATGGAATTGGATGACTTGCCTAAGGAAAAGCTCAAA

GAACTAATTTTTGAAGAGACTGCTAGATTCCAGCCAGGATACAGATCTTAA
```

Human TκB CDS
(SEQ ID NO: 42)
```
ATGTTCCAGGCGGCCGAGCGCCCCCAGGAGTGGGCCATGGAGGGCCCCCGCGACGGGCT

GAAGAAGGAGCGGCTACTGGACGACCGCCACGACAGCGGCCTGGACTCCATGAAAGACG

AGGAGTACGAGCAGATGGTCAAGGAGCTGCAGGAGATCCGCCTCGAGCCGCAGGAGGTG

CCGCGCGGCTCGGAGCCCTGGAAGCAGCAGCTCACCGAGGACGGGGACTCGTTCCTGCA

CTTGGCCATCATCCATGAAGAAAGGCACTGACCATGGAAGTGATCCGCCAGGTGAAGGG

AGACCTGGCCTTCCTCAACTTCCAGAACAACCTGCAGCAGACTCCACTCCACTTGGCTGT

GATCACCAACCAGCCAGAAATTGCTGAGGCACTTCTGGGAGCTGGCTGTGATCCTGAGCT

CCGAGACTTTCGAGGAAATACCCCCCTACACCTTGCCTGTGAGCAGGGCTGCCTGGCCAG

CGTGGGAGTCCTGACTCAGTCCTGCACCACCCCGCACCTCCACTCCATCCTGAAGGCTAC

CAACTACAATGGCCACACGTGTCTACACTTAGCCTCTATCCATGGCTACCTGGGCATCGTG

GAGCTTTTGGTGTCCTTGGGTGCTGATGTCAATGCTCAGGAGCCCTGTAATGGCCGGACTG

CCCTTCACCTCGCAGTGGACCTGCAAAATCCTGACCTGGTGTCACTCCTGTTGAAGTGTG

GGGCTGATGTCAACAGAGTTACCTACCAGGGCTATTCTCCCTACCAGCTCACCTGGGGCCG

CCCAAGCACCCGGATACAGCAGCAGCTGGGCCAGCTGACACTAGAAAACCTTCAGATGCT

GCCAGAGAGTGAGGATGAGGAGAGCTATGACACAGAGTCAGAGTTCACGGAGTTCACAG

AGGACGAGCTGCCCTATGATGACTGTGTGTTTGGAGGCCAGCGTCTGACGTTATGA
```

Human Rac CDS
(SEQ ID NO: 43)
```
ATGAGCGACGTGGCTATTGTGAAGGAGGGTTGGCTGCACAAACGAGGGGAGTACATCAA

GACCTGGCGGCCACGCTACTTCCTCCTCAAGAATGATGGCACCTTCATTGGCTACAAGGA

GCGGCCGCAGGATGTGGACCAACGTGAGGCTCCCCTCAACAACTTCTCTGTGGCGCAGTG

CCAGCTGATGAAGACGGAGCGGCCCCGGCCCAACACCTTCATCATCCGCTGCCTGCAGTG

GACCACTGTCATCGAACGCACCTTCCATGTGGAGACTCCTGAGGAGCGGGAGGAGTGGA

CAACCGCCATCCAGACTGTGGCTGACGGCCTCAAGAAGCAGGAGGAGGAGGAGATGGAC

TTCCGGTCGGGCTCACCCAGTGACAACTCAGGGGCTGAAGAGATGGAGGTGTCCCTGGC

CAAGCCCAAGCACCGCGTGACCATGAACGAGTTTGAGTACCTGAAGCTGCTGGGCAAGG

GCACTTTCGGCAAGGTGATCCTGGTGAAGGAGAAGGCCACAGGCCGCTACTACGCCATGA

AGATCCTCAAGAAGGAAGTCATCGTGGCCAAGGACGAGGTGGCCCACACACTCACCGAG

AACCGCGTCCTGCAGAACTCCAGGCACCCCTTCCTCACAGCCCTGAAGTACTCTTTCCAG

ACCCACGACCGCCTCTGCTTTGTCATGGAGTACGCCAACGGGGGCGAGCTGTTCTTCCAC

CTGTCCCGGGAGCGTGTGTTCTCCGAGGACCGGGCCCGCTTCTATGGCGCTGAGATTGTG

TCAGCCCTGGACTACCTGCACTCGGAGAAGAACGTGGTGTACCGGGACCTCAAGCTGGA

GAACCTCATGCTGGACAAGGACGGGCACATTAAGATCACAGACTTCGGGCTGTGCAAGG

AGGGGATCAAGGACGGTGCCACCATGAAGACCTTTTGCGGCACACCTGAGTACCTGGCCC

CCGAGGTGCTGGAGGACAATGACTACGGCCGTGCAGTGGACTGGTGGGGCTGGCGTG
```

-continued

```
GTCATGTACGAGATGATGTGCGGTCGCCTGCCCTTCTACAACCAGGACCATGAGAAGCTTT

TTGAGCTCATCCTCATGGAGGAGATCCGCTTCCCGCGCACGCTTGGTCCCGAGGCCAAGT

CCTTGCTTTCAGGGCTGCTCAAGAAGGACCCCAAGCAGAGGCTTGGCGGGGCTCCGAG

GACGCCAAGGAGATCATGCAGCATCGCTTCTTTGCCGGTATCGTGTGGCAGCACGTGTACG

AGAAGAAGCTCAGCCCACCCTTCAAGCCCCAGGTCACGTCGGAGACTGACACCAGGTAT

TTTGATGAGGAGTTCACGGCCCAGATGATCACCATCACACCACCTGACCAAGATGACAGC

ATGGAGTGTGTGGACAGCGAGCGCAGGCCCCACTTCCCCCAGTTCTCCTACTCGGCCAGC

GGCACGGCCTGA
```

Human MEK3 CDS (SEQ ID NO: 44)
```
ATGTCCAAGCCACCCGCACCCAACCCCACACCCCCCCGGAACCTGGACTCCCGGACCTTC

ATCACCATTGGAGACAGAAACTTTGAGGTGGAGGCTGATGACTTGGTGACCATCTCAGAA

CTGGGCCGTGGAGCCTATGGGGTGGTAGAGAAGGTGCGGCACGCCCAGAGCGGCACCAT

CATGGCCGTGAAGCGGATCCGGGCCACCGTGAACTCACAGGAGCAGAAGCGGCTGCTCA

TGGACCTGGACATCAACATGCGCACGGTCGACTGTTTCTACACTGTCACCTTCTACGGGGC

ACTATTCAGAGAGGGAGACGTGTGGATCTGCATGGAGCTCATGGACACATCCTTGGACAA

GTTCTACCGGAAGGTGCTGGATAAAAACATGACAATTCCAGAGGACATCCTTGGGGAGAT

TGCTGTGTCTATCGTGCGGGCCCTGGAGCATCTGCACAGCAAGCTGTCGGTGATCCACAG

AGATGTGAAGCCCTCCAATGTCCTTATCAACAAGGAGGGCCATGTGAAGATGTGTGACTTT

GGCATCAGTGGCTACTTGGTGGACTCTGTGGCCAAGACGATGGATGCCGGCTGCAAGCCC

TACATGGCCCCTGAGAGGATCAACCCAGAGCTGAACCAGAAGGGCTACAATGTCAAGTCC

GACGTCTGGAGCCTGGGCATCACCATGATTGAGATGGCCATCCTGCGGTTCCCTTACGAGT

CCTGGGGACCCCGTTCCAGCAGCTGAAGCAGGTGGTGGAGGAGCCGTCCCCCCAGCTC

CCAGCCGACCGTTTCTCCCCCGAGTTTGTGGACTTCACTGCTCAGTGCCTGAGGAAGAAC

CCCGCAGAGCGTATGAGCTACCTGGAGCTGATGGAGCACCCCTTCTTCACCTTGCACAAA

ACCAAGAAGACGGACATTGCTGCCTTCGTGAAGGAGATCCTGGGAGAAGACTCATAG
```

Human MEK6 CDS (SEQ ID NO: 45)
```
ATGGAACTGGGACGAGGTGCGTACGGGGTGGTGGAGAAGATGCGGCACGTGCCCAGCGG

GCAGATCATGGCAGTGAAGCGGATCCGAGCCACAGTAAATAGCCAGGAACAGAAACGGC

TACTGATGGATTTGGATATTTCCATGAGGACGGTGGACTGTCCATTCACTGTCACCTTTTAT

GGCGCACTGTTTCGGGAGGGTGATGTGTGGATCTGCATGGAGCTCATGGATACATCACTAG

ATAAATTCTACAAACAAGTTATTGATAAAGGCCAGACAATTCCAGAGGACATCTTAGGGAA

AATAGCAGTTTCTATTGTAAAAGCATTAGAACATTTACATAGTAAGCTGTCTGTCATTCACA

GAGACGTCAAGCCTTCTAATGTACTCATCAATGCTCTCGGTCAAGTGAAGATGTGCGATTT

TGGAATCAGTGGCTACTTGGTGGACTCTGTTGCTAAAACAATTGATGCAGGTTGCAAACC

ATACATGGCCCCTGAAAGAATAAACCCAGAGCTCAACCAGAAGGGATACAGTGTGAAGTC

TGACATTTGGAGTCTGGGCATCACGATGATTGAGTTGGCCATCCTTCGATTTCCCTATGATT

CATGGGAACTCCATTTCAGCAGCTCAAACAGGTGGTAGAGGAGCCATCGCCACAACTCC

CAGCAGACAAGTTCTCTGCAGAGTTTGTTGACTTTACCTCACAGTGCTTAAAGAAGAATT

CCAAAGAACGGCCTACATACCCAGAGCTAATGCAACATCCATTTTTCACCCTACATGAATC

CAAAGGAACAGATGTGGCATCTTTTGTAAAACTGATTCTTGGAGACTAA
```

-continued

Human p38 CDS (SEQ ID NO: 46)
ATGTCTCAGGAGAGGCCCACGTTCTACCGGCAGGAGCTGAACAAGACAATCTGGGAGGT

GCCCGAGCGTTACCAGAACCTGTCTCCAGTGGGCTCTGGCGCCTATGGCTCTGTGTGCT

GCTTTTGACACAAAAACGGGGTTACGTGTGGCAGTGAAGAAGCTCTCCAGACCATTTCAG

TCCATCATTCATGCGAAAAGAACCTACAGAGAACTGCGGTTACTTAAACATATGAAACATG

AAAATGTGATTGGTCTGTTGGACGTTTTTACACCTGCAAGGTCTCTGGAGGAATTCAATGA

TGTGTATCTGGTGACCCATCTCATGGGGGCAGATCTGAACAACATTGTGAAATGTCAGAAG

CTTACAGATGACCATGTTCAGTTCCTTATCTACCAAATTCTCCGAGGTCTAAAGTATATACAT

TCAGCTGACATAATTCACAGGGACCTAAAACCTAGTAATCTAGCTGTGAATGAAGACTGTG

AGCTGAAGATTCTGGATTTTGGACTGGCTCGGCACACAGATGATGAAATGACAGGCTACG

TGGCCACTAGGTGGTACAGGGCTCCTGAGATCATGCTGAACTGGATGCATTACAACCAGA

CAGTTGATATTTGGTCAGTGGGATGCATAATGGCCGAGCTGTTGACTGGAAGAACATTGTT

TCCTGGTACAGACCATATTAACCAGCTTCAGCAGATTATGCGTCTGACAGGAACACCCCCC

GCTTATCTCATTAACAGGATGCCAAGCCATGAGGCAAGAAACTATATTCAGTCTTTGACTC

AGATGCCGAAGATGAACTTTGCGAATGTATTTATTGGTGCCAATCCCCTGGCTGTCGACTT

GCTGGAGAAGATGCTTGTATTGGACTCAGATAAGAGAATTACAGCGGCCCAAGCCCTTGC

ACATGCCTACTTTGCTCAGTACCACGATCCTGATGATGAACCAGTGGCCGATCCTTATGATC

AGTCCTTTGAAAGCAGGGACCTCCTTATAGATGAGTGGAAAAGCCTGACCTATGATGAAG

TCATCAGCTTTGTGCCACCACCCCTTGACCAAGAAGAGATGGAGTCCTGA

Human PKR CDS (SEQ ID NO: 47)
ATGGCTGGTGATCTTTCAGCAGGTTTCTTCATGGAGGAACTTAATACATACCGTCAGAAGC

AGGGAGTAGTACTTAAATATCAAGAACTGCCTAATTCAGGACCTCCACATGATAGGAGGTT

TACATTTCAAGTTATAATAGATGGAAGAGAATTTCCAGAAGGTGAAGGTAGATCAAAGAA

GGAAGCAAAAAATGCCGCAGCCAAATTAGCTGTTGAGATACTTAATAAGGAAAAGAAGGC

AGTTAGTCCTTTATTATTGACAACAACGAATTCTTCAGAAGGATTATCCATGGGGAATTACA

TAGGCCTTATCAATAGAATTGCCCAGAAGAAAAGACTAACTGTAAATTATGAACAGTGTGC

ATCGGGGGTGCATGGGCCAGAAGGATTTCATTATAAATGCAAATGGGACAGAAAGAATAT

AGTATTGGTACAGGTTCTACTAAACAGGAAGCAAAACAATTGGCCGCTAAACTTGCATATC

TTCAGATATTATCAGAAGAAACCTCAGTGAAATCTGACTACCTGTCCTCTGGTTCTTTTGCT

ACTACGTGTGAGTCCCAAAGCAACTCTTTAGTGACCAGCACACTCGCTTCTGAATCATCAT

CTGAAGGTGACTTCTCAGCAGATACATCAGAGATAAATTCTAACAGTGACAGTTTAAACAG

TTCTTCGTTGCTTATGAATGGTCTCAGAAATAATCAAAGGAAGGCAAAAAGATCTTTGGCA

CCCAGATTTGACCTTCCTGACATGAAAGAAACAAAGTATACTGTGGACAAGAGGTTTGGC

ATGGATTTTAAAGAAATAGAATTAATTGGCTCAGGTGGATTTGGCCAAGTTTTCAAAGCAA

AACACAGAATTGACGGAAAGACTTACGTTATTAAACGTGTTAAATATAATAACGAGAAGGC

GGAGCGTGAAGTAAAAGCATTGGCAAAACTTGATCATGTAAATATTGTTCACTACAATGGC

TGTTGGGATGGATTTGATTATGATCCTGAGACCAGTGATGATTCTCTTGAGAGCAGTGATTA

TGATCCTGAGAACAGCAAAAATAGTTCAAGGTCAAAGACTAAGTGCCTTTTCATCCAAAT

GGAATTCTGTGATAAAGGGACCTTGGAACAATGGATTGAAAAAGAAGAGGCGAGAAAC

TAGACAAAGTTTTGGCTTTGGAACTCTTTGAACAAATAACAAAAGGGGTGGATTATATACA

TTCAAAAAAATTAATTCATAGAGATCTTAAGCCAAGTAATATATTCTTAGTAGATACAAAAC

-continued

AAGTAAAGATTGGAGACTTTGGACTTGTAACATCTCTGAAAAATGATGGAAAGCGAACAA

GGAGTAAGGGAACTTTGCGATACATGAGCCCAGAACAGATTTCTTCGCAAGACTATGGAA

AGGAAGTGGACCTCTACGCTTTGGGGCTAATTCTTGCTGAACTTCTTCATGTATGTGACAC

TGCTTTTGAAACATCAAAGTTTTTCACAGACCTACGGGATGGCATCATCTCAGATATATTTG

ATAAAAAAGAAAAAACTCTTCTACAGAAATTACTCTCAAAGAAACCTGAGGATCGACCTA

ACACATCTGAAATACTAAGGACCTTGACTGTGTGGAAGAAAAGCCCAGAGAAAAATGAA

CGACACACATGTTAG

Human TTP CDS (SEQ ID NO: 48)

ATGGCGGCTCAGCGGATCCGAGCGGCCAACTCCAATGGCCTCCCTCGCTGCAAGTCAGAG

GGGACCCTGATTGACCTGAGCGAAGGGTTTTCAGAGACGAGCTTTAATGACATCAAAGTG

CCTTCTCCCAGTGCCTTGCTCGTAGACAACCCCACACCTTTCGGAAATGCAAAGGAAGTG

ATTGCGATCAAGGACTATTGCCCCACCAACTTCACCACACTGAAGTTCTCCAAGGGCGAC

CATCTCTACGTCTTGGACACATCTGGCGGTGAGTGGTGGTACGCACACAACACCACCGAA

ATGGGCTACATCCCCTCCTCCTATGTGCAGCCCTTGAACTACCGGAACTCAACACTGAGTG

ACAGCGGTATGATTGATAATCTTCCAGACAGCCCAGACGAGGTAGCCAAGGAGCTGGAGC

TGCTCGGGGATGGACAGATGACAAAAAAGTACCAGGCAGAATGTACAGTAATAACCCTT

TCTGGAATGGGGTCCAGACCAATCCATTTCTGAATGGGAACGTGCCCGTCATGCCCAGCCT

GGATGAGCTGAATCCCAAAAGTACTGTGGATTTGCTCCTTTTTGACGCAGGTACATCCTCC

TTCACCGAATCCAGCTCAGCCACCACGAATAGCACTGGCAACATCTTCGATGAGCTTCCA

GTCACAAACGGACTCCACGCAGAGCCGCCGGTCAGGCGGGACAACCCCTTCTTCAGAAG

CAAGCGCTCCTACAGTCTCTCGGAACTCTCCGTCCTCCAAGCCAAGTCCGATGCTCCCAC

ATCGTCGAGTTTCTTCACCGGCTTGAAATCACCTGCCCCGAGCAATTTCAGAGCCGGGA

GGATTTTCGAACTGCCTGGCTAAACCACAGGAAGCTGGCCCGGTCTTGCCACGACCTGGA

CTTGCTTGGCCAAAGCCCTGGTTGGGGCCAGACCCAAGCCGTGGAGACAAACATCGTGT

GCAAGCTGGATAGCTCCGGGGGTGCTGTCCAGCTTCCTGACACCAGCATCAGCATCCACG

TGCCCGAGGGCCACGTCGCCCCTGGGGAGACCCAGCAGATCTCCATGAAAGCCCTGCTGG

ACCCCCCGCTGGAGCTCAACAGTGACAGGTCCTGCAGCATCAGCCCTGTGCTGGAGGTCA

AGCTGAGCAACCTGGAGGTGAAAACCTCTATCATCTTGGAGATGAAAGTGTCAGCCGAGA

TAAAAAATGACCTTTTTAGCAAAAGCACAGTGGGCCTCCAGTGCCTGAGGAGCGACTCGA

AGGAAGGGCCATATGTCTCCGTCCCGCTCAACTGCAGCTGTGGGACACGGTCCAGGCAC

AGCTGCACAACCTGGAGCCCTGTATGTACGTGGCTGTCGTGGCCCATGGCCCAAGCATCCT

CTACCCTTCCACCGTGTGGGACTTCATCAATAAAAAAAGTCACAGTGGGTCTCTACGGCCCT

AAACACATCCACCCATCCTTCAAGACGGTAGTGACCATTTTTGGGCATGACTGTGCCCCAA

AGACGCTCCTGGTCAGCGAGGTCACACGCCAGGCACCCAACCCTGCCCCGGTGGCCCTG

CAGCTGTGGGGAAGCACCAGTTCGTTTTGTCCAGGCCCCAGGATCTCAAGGTCTGTATG

TTTTCCAATATGACGAATTACGAGGTCAAAGCCAGCGAGCAGGCCAAAGTGGTGCGAGGA

TTCCAGCTGAAGCTGGGCAAGGTGAGCCGCCTGATCTTCCCCATCACCTCCCAGAACCCC

AACGAGCTCTCTGACTTCACGCTGCGGGTTCAGGTGAAGGACGACCAGGAGGCCATCCTC

ACCCAGTTTTGTGTCCAGACTCCTCAGCCACCCCCTAAAAGTGCCATCAAGCCTTCCGGG

CAAAGGAGGTTTCTCAAGAAGAACGAAGTCGGGAAAATCATCCTGTCCCCGTTTGCCACC

-continued

ACTACAAAGTACCCGACTTTCCAGGACCGCCCGGTGTCCAGCCTCAAGTTTGGTAAGTTG

CTCAAGACTGTGGTGCGGCAGAACAAGAACCACTACCTGCTGGAGTACAAGAAGGGCGA

CGGGATCGCCCTGCTCAGCGAGGAGCGGGTCAGGCTCCGGGGCCAGCTGTGGACCAAGG

AGTGGTACATCGGCTACTACCAGGGCAGGGTGGGCCTCGTGCACACCAAGAACGTGCTGG

TGGTCGGCAGGGCCCGGCCCAGCCTGTGCTCGGGCCCCGAGCTGAGCACCTCGGTGCTG

CTGGAGCAGATCCTGCGGCCCTGCAAATTCCTCACGTACATCTATGCCTCCGTGAGGACCC

TGCTCATGGAGAACATCAGCAGCTGGCGCTCCTTCGCTGACGCCCTGGGCTACGTGAACC

TGCCGCTCACCTTTTTCTGCCGGGCAGAGCTGGATAGTGAGCCCGAGCGGGTGGCGTCCG

TCCTAGAAAAGCTGAAGGAGGACTGTAACAACACTGAGAACAAAGAACGGAAGTCCTTC

CAGAAGGAGCTTGTGATGGCCCTACTGAAGATGGACTGCCAGGGCCTGGTGGTCAGACTC

ATCCAGGACTTTGTGCTCCTGACCACGGCTGTAGAGGTGGCCCAGCGCTGGCGGGAGCTG

GCTGAGAAGCTGGCCAAGGTCTCCAAGCAGCAGATGGACGCCTACGAGTCTCCCCACCG

GGACAGGAACGGGGTTGTGGACAGCGAGGCCATGTGGAAGCCTGCGTATGACTTCTTACT

CACCTGGAGCCATCAGATCGGGGACAGCTACCGGGATGTCATCCAGGAGCTGCACCTGGG

CCTGGACAAGATGAAAAACCCCATCACCAAGCGCTGGAAGCACCTCACTGGGACTCTGAT

CTTGGTGAACTCCCTGGACGTTCTGAGAGCAGCCGCCTTCAGCCCTGCGGACCAGGACGA

CTTCGTGATTTGA

Human MK2 CDS (SEQ ID NO: 49)
ATGCTGTCCAACTCCCAGGGCCAGAGCCCGCCGGTGCCGTTCCCCGCCCCGGCCCCGCCG

CCGCAGCCCCCCACCCCTGCCCTGCCGCACCCCCGGCGCAGCCGCCGCCGCCGCCCCCG

CAGCAGTTCCCGCAGTTCCACGTCAAGTCCGGCCTGCAGATCAAGAAGAACGCCATCATC

GATGACTACAAGGTCACCAGCCAGGTCCTGGGGCTGGGCATCAACGGCAAAGTTTTGCAG

ATCTTCAACAAGAGGACCCAGGAGAAATTCGCCCTCAAAATGCTTCAGGACTGCCCCAAG

GCCCGCAGGGAGGTGGAGCTGCACTGGCGGGCCTCCCAGTGCCCGCACATCGTACGGATC

GTGGATGTGTACGAGAATCTGTACGCAGGGAGGAAGTGCCTGCTGATTGTCATGGAATGTT

TGGACGGTGGAGAACTCTTTAGCCGAATCCAGGATCGAGGAGACCAGGCATTCACAGAA

AGAGAAGCATCCGAAATCATGAAGAGCATCGGTGAGGCCATCCAGTATCTGCATTCAATCA

ACATTGCCCATCGGGATGTCAAGCCTGAGAATCTCTTATACACCTCCAAAAGGCCCAACGC

CATCCTGAAACTCACTGACTTTGGCTTTGCCAAGGAAACCACCAGCCACAACTCTTTGAC

CACTCCTTGTTATACACCGTACTATGTGGCTCCAGAAGTGCTGGGTCCAGAGAAGTATGAC

AAGTCCTGTGACATGTGGTCCCTGGGTGTCATCATGTACATCCTGCTGTGTGGGTATCCCCC

CTTCTACTCCAACCACGGCCTTGCCATCTCTCCGGGCATGAAGACTCGCATCCGAATGGGC

CAGTATGAATTTCCCAACCCAGAATGGTCAGAAGTATCAGAGGAAGTGAAGATGCTCATTC

GGAATCTGCTGAAAACAGAGCCCACCCAGAGAATGACCATCACCGAGTTTATGAACCACC

CTTGGATCATGCAATCAACAAAGGTCCCTCAAACCCCACTGCACACCAGCCGGGTCCTGA

AGGAGGACAAGGAGCGGTGGGAGGATGTCAAGGGGTGTCTTCATGACAAGAACAGCGAC

CAGGCCACTTGGCTGACCAGGTTGTGA

An antisense nucleic acid molecule can be complementary to all or part of a non-coding region of the coding strand of a nucleotide sequence encoding a TNFα, TNFR1, TNFR2, TRADD, TRAF2, MEKK1/4, MEKK4/7, JNK, AP-1, ASK1, RIP, MEKK 3/6, MAPK, NIK, IKK, NF-κB, CD14, MyD88, IRAK, lipopolysaccharide binding protein (LBP), TRAF6, ras, raf, MEK1/2, ERK1/2, NIK, IKK, IκB, NF-κB, rac, MEK4/7, JNK, c-jun, MEK3/6, p38, PKR, TTP, or MK2 protein. Non-coding regions (5' and 3' untranslated regions) are the 5' and 3' sequences that flank the coding region in a gene and are not translated into amino acids.

Based upon the sequences disclosed herein, one of skill in the art can easily choose and synthesize any of a number of appropriate antisense nucleic acids to target a nucleic acid encoding a TNFα, TNFR1, TNFR2, TRADD, TRAF2, MEKK1/4, MEKK4/7, JNK, AP-1, ASK1, RIP, MEKK 3/6, MAPK, NIK, IKK, NF-κB, CD14, MyD88, IRAK, lipopolysaccharide binding protein (LBP), TRAF6, ras, raf, MEK1/2, ERK1/2, NIK, IKK, IκB, NF-κB, rac, MEK4/7, JNK, c-jun, MEK3/6, p38, PKR, TTP, or MK2 protein described herein. Antisense nucleic acids targeting a nucleic acid encoding a TNFα, TNFR1, TNFR2, TRADD, TRAF2, MEKK1/4, MEKK4/7, JNK, AP-1, ASK1, RIP, MEKK 3/6, MAPK, NIK, IKK, NF-κB, CD14, MyD88, IRAK, lipopolysaccharide binding protein (LBP), TRAF6, ras, raf, MEK1/2, ERK1/2, NIK, IKK, IκB, NF-κB, rac, MEK4/7, JNK, c-jun, MEK3/6, p38, PKR, TTP, or MK2 protein can be designed using the software available at the Integrated DNA Technologies website.

An antisense nucleic acid can be, for example, about 5, 10, 15, 20, 25, 30, 35, 40, 45, or 50 nucleotides or more in length. An antisense oligonucleotide can be constructed using chemical synthesis and enzymatic ligation reactions using procedures known in the art. For example, an antisense nucleic acid can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used.

Examples of modified nucleotides which can be used to generate an antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3) w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest).

The antisense nucleic acid molecules described herein can be prepared in vitro and administered to a mammal, e.g., a human. Alternatively, they can be generated in situ such that they hybridize with or bind to cellular mRNA and/or genomic DNA encoding a TNFα, TNFR1, TNFR2, TRADD, TRAF2, MEKK1/4, MEKK4/7, JNK, AP-1, ASK1, RIP, MEKK 3/6, MAPK, NIK, IKK, NF-κB, CD14, MyD88, IRAK, LBP, TRAF6, ras, raf, MEK1/2, ERK1/2, NIK, IKK, IκB, NF-κB, rac, MEK4/7, JNK, c-jun, MEK3/6, p38, PKR, TTP, or MK2 protein to thereby inhibit expression, e.g., by inhibiting transcription and/or translation. The hybridization can be by conventional nucleotide complementarities to form a stable duplex, or, for example, in the case of an antisense nucleic acid molecule that binds to DNA duplexes, through specific interactions in the major groove of the double helix. The antisense nucleic acid molecules can be delivered to a mammalian cell using a vector (e.g., a lentivirus, a retrovirus, or an adenovirus vector).

An antisense nucleic acid can be an α-anomeric nucleic acid molecule. An α-anomeric nucleic acid molecule forms specific double-stranded hybrids with complementary RNA in which, contrary to the usual, β-units, the strands run parallel to each other (Gaultier et al., *Nucleic Acids Res.* 15:6625-6641, 1987). The antisense nucleic acid can also comprise a 2'-O-methylribonucleotide (Inoue et al., *Nucleic Acids Res.* 15:6131-6148, 1987) or a chimeric RNA-DNA analog (Inoue et al., *FEBS Lett.* 215:327-330, 1987).

Another example of an inhibitory nucleic acid is a ribozyme that has specificity for a nucleic acid encoding a TNFα, TNFR1, TNFR2, TRADD, TRAF2, MEKK1/4, MEKK4/7, JNK, AP-1, ASK1, RIP, MEKK 3/6, MAPK, NIK, IKK, NF-κB, CD14, MyD88, IRAK, lipopolysaccharide binding protein (LBP), TRAF6, ras, raf, MEK1/2, ERK1/2, NIK, IKK, IκB, NF-κB, rac, MEK4/7, JNK, c-jun, MEK3/6, p38, PKR, TTP, or MK2 protein (e.g., specificity for a TNFα, TNFR1, TNFR2, TRADD, TRAF2, MEKK1/4, MEKK4/7, JNK, AP-1, ASK1, RIP, MEKK 3/6, MAPK, NIK, IKK, NF-κB, CD14, MyD88, IRAK, lipopolysaccharide binding protein (LBP), TRAF6, ras, raf, MEK1/2, ERK1/2, NIK, IKK, IκB, NF-κB, rac, MEK4/7, JNK, c-jun, MEK3/6, p38, PKR, TTP, or MK2 mRNA, e.g., specificity for any one of SEQ ID NOs: 13-49). Ribozymes are catalytic RNA molecules with ribonuclease activity that are capable of cleaving a single-stranded nucleic acid, such as an mRNA, to which they have a complementary region. Thus, ribozymes (e.g., hammerhead ribozymes (described in Haselhoff and Gerlach, *Nature* 334:585-591, 1988)) can be used to catalytically cleave mRNA transcripts to thereby inhibit translation of the protein encoded by the mRNA. A ribozyme having specificity for a TNFα, TNFR1, TNFR2, TRADD, TRAF2, MEKK1/4, MEKK4/7, JNK, AP-1, ASK1, RIP, MEKK 3/6, MAPK, NIK, IKK, NF-κB, CD14, MyD88, IRAK, lipopolysaccharide binding protein (LBP), TRAF6, ras, raf, MEK1/2, ERK1/2, NIK, IKK, IκB, NF-κB, rac, MEK4/7, JNK, c-jun, MEK3/6, p38, PKR, TTP, or MK2 mRNA can be designed based upon the nucleotide sequence of any of the TNFα, TNFR1, TNFR2, TRADD, TRAF2, MEKK1/4, MEKK4/7, JNK, AP-1, ASK1, RIP, MEKK 3/6, MAPK, NIK, IKK, NF-κB, CD14, MyD88, IRAK, lipopolysaccharide binding protein (LBP), TRAF6, ras, raf, MEK1/2, ERK1/2, NIK, IKK, IκB, NF-κB, rac, MEK4/7, JNK, c-jun, MEK3/6, p38, PKR, TTP, or MK2 mRNA sequences disclosed herein. For example, a derivative of a Tetrahymena L-19 IVS RNA can be constructed in which the nucleotide sequence of the active site is complementary to the nucleotide sequence to be cleaved in a TNFα, TNFR1, TNFR2, TRADD, TRAF2, MEKK1/4, MEKK4/7, JNK, AP-1, ASK1, RIP, MEKK 3/6, MAPK, NIK, IKK, NF-κB, CD14, MyD88, IRAK, lipopolysaccharide binding protein (LBP), TRAF6, ras, raf, MEK1/2, ERK1/2, NIK, IKK, IκB, NF-κB, rac, MEK4/7, JNK, c-jun, MEK3/6, p38, PKR, TTP, or MK2 mRNA (see, e.g., U.S. Pat. Nos. 4,987,071 and 5,116,742). Alternatively, a TNFα, TNFR1, TNFR2, TRADD, TRAF2, MEKK1/4, MEKK4/7, JNK, AP-1, ASK1, RIP, MEKK 3/6, MAPK, NIK, IKK, NF-κB, CD14, MyD88, IRAK, lipopolysaccharide binding protein (LBP), TRAF6, ras, raf, MEK1/2, ERK1/2, NIK, IKK, IκB, NF-κB, rac, MEK4/7, JNK, c-jun, MEK3/6, p38, PKR, TTP, or MK2 mRNA can be used to select a catalytic RNA having a specific ribonuclease activity from a pool of RNA molecules. See, e.g., Bartel et al., Science 261:1411-1418, 1993.

An inhibitory nucleic acid can also be a nucleic acid molecule that forms triple helical structures. For example, expression of a TNFα, TNFR1, TNFR2, TRADD, TRAF2, MEKK1/4, MEKK4/7, JNK, AP-1, ASK1, RIP, MEKK 3/6, MAPK, NIK, IKK, NF-κB, CD14, MyD88, IRAK, lipopolysaccharide binding protein (LBP), TRAF6, ras, raf, MEK1/2, ERK1/2, NIK, IKK, IκB, NF-κB, rac, MEK4/7, JNK, c-jun, MEK3/6, p38, PKR, TTP, or MK2 polypeptide can be inhibited by targeting nucleotide sequences complementary to the regulatory region of the gene encoding the TNFα, TNFR1, TNFR2, TRADD, TRAF2, MEKK1/4, MEKK4/7, JNK, AP-1, ASK1, RIP, MEKK 3/6, MAPK, NIK, IKK, NF-κB, CD14, MyD88, IRAK, lipopolysaccharide binding protein (LBP), TRAF6, ras, raf, MEK1/2, ERK1/2, NIK, IKK, IκB, NF-κB, rac, MEK4/7, JNK, c-jun, MEK3/6, p38, PKR, TTP, or MK2 polypeptide (e.g., the promoter and/or enhancer, e.g., a sequence that is at least 1 kb, 2 kb, 3 kb, 4 kb, or 5 kb upstream of the transcription initiation start state) to form triple helical structures that prevent transcription of the gene in target cells. See generally Helene, Anticancer Drug Des. 6 (6): 569-84, 1991; Helene, Ann. N.Y. Acad. Sci. 660:27-36, 1992; and Maher, Bioassays 14 (12): 807-15, 1992.

In various embodiments, inhibitory nucleic acids can be modified at the base moiety, sugar moiety, or phosphate backbone to improve, e.g., the stability, hybridization, or solubility of the molecule. For example, the deoxyribose phosphate backbone of the nucleic acids can be modified to generate peptide nucleic acids (see, e.g., Hyrup et al., Bioorganic Medicinal Chem. 4 (1): 5-23, 1996). Peptide nucleic acids (PNAs) are nucleic acid mimics, e.g., DNA mimics, in which the deoxyribose phosphate backbone is replaced by a pseudopeptide backbone and only the four natural nucleobases are retained. The neutral backbone of PNAs allows for specific hybridization to DNA and RNA under conditions of low ionic strength. The synthesis of PNA oligomers can be performed using standard solid phase peptide synthesis protocols (see, e.g., Perry-O'Keefe et al., Proc. Natl. Acad. Sci. U.S.A. 93:14670-675, 1996). PNAs can be used as antisense or antigene agents for sequence-specific modulation of gene expression by, e.g., inducing transcription or translation arrest or inhibiting replication.

PNAs can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras can be generated which may combine the advantageous properties of PNA and DNA. Such chimeras allow DNA recognition enzymes, e.g., RNAse H and DNA polymerases, to interact with the DNA portion while the PNA portion would provide high binding affinity and specificity. PNA-DNA chimeras can be linked using linkers of appropriate lengths selected in terms of base stacking, number of bonds between the nucleobases, and orientation.

The synthesis of PNA-DNA chimeras can be performed as described in Finn et al., Nucleic Acids Res. 24:3357-63, 1996. For example, a DNA chain can be synthesized on a solid support using standard phosphoramidite coupling chemistry and modified nucleoside analogs. Compounds such as 5'-(4-methoxytrityl)amino-5'-deoxy-thymidine phosphoramidite can be used as a link between the PNA and the 5' end of DNA (Mag et al., Nucleic Acids Res. 17:5973-88, 1989). PNA monomers are then coupled in a stepwise manner to produce a chimeric molecule with a 5' PNA segment and a 3' DNA segment (Finn et al., Nucleic Acids Res. 24:3357-63, 1996). Alternatively, chimeric molecules can be synthesized with a 5' DNA segment and a 3' PNA segment (Peterser et al., Bioorganic Med. Chem. Lett. 5:1119-11124, 1975).

In some embodiments, the inhibitory nucleic acids can include other appended groups such as peptides, or agents facilitating transport across the cell membrane (see, Letsinger et al., Proc. Natl. Acad. Sci. U.S.A. 86:6553-6556, 1989; Lemaitre et al., Proc. Natl. Acad. Sci. U.S.A. 84:648-652, 1989; and WO 88/09810). In addition, the inhibitory nucleic acids can be modified with hybridization-triggered cleavage agents (see, e.g., Krol et al., Bio/Techniques 6:958-976, 1988) or intercalating agents (see, e.g., Zon, Pharm. Res., 5:539-549, 1988). To this end, the oligonucleotide may be conjugated to another molecule, e.g., a peptide, hybridization triggered cross-linking agent, transport agent, hybridization-triggered cleavage agent, etc.

Another means by which expression of a TNFα, TNFR1, TNFR2, TRADD, TRAF2, MEKK1/4, MEKK4/7, JNK, AP-1, ASK1, RIP, MEKK 3/6, MAPK, NIK, IKK, NF-κB, CD14, MyD88, IRAK, lipopolysaccharide binding protein (LBP), TRAF6, ras, raf, MEK1/2, ERK1/2, NIK, IKK, IκB, NF-κB, rac, MEK4/7, JNK, c-jun, MEK3/6, p38, PKR, TTP, or MK2 mRNA can be decreased in a mammalian cell is by RNA interference (RNAi). RNAi is a process in which mRNA is degraded in host cells. To inhibit an mRNA, double-stranded RNA (dsRNA) corresponding to a portion of the gene to be silenced (e.g., a gene encoding a TNFα, TNFR1, TNFR2, TRADD, TRAF2, MEKK1/4, MEKK4/7, JNK, AP-1, ASK1, RIP, MEKK 3/6, MAPK, NIK, IKK, NF-κB, CD14, MyD88, IRAK, lipopolysaccharide binding protein (LBP), TRAF6, ras, raf, MEK1/2, ERK1/2, NIK, IKK, IκB, NF-κB, rac, MEK4/7, JNK, c-jun, MEK3/6, p38, PKR, TTP, or MK2 polypeptide) is introduced into a mammalian cell. The dsRNA is digested into 21-23 nucleotide-long duplexes called short interfering RNAs (or siRNAs), which bind to a nuclease complex to form what is known as the RNA-induced silencing complex (or RISC). The RISC targets the homologous transcript by base pairing interactions between one of the siRNA strands and the endogenous mRNA. It then cleaves the mRNA about 12 nucleotides from the 3' terminus of the siRNA (see Sharp et al., Genes Dev. 15:485-490, 2001, and Hammond et al., Nature Rev. Gen. 2:110-119, 2001).

RNA-mediated gene silencing can be induced in a mammalian cell in many ways, e.g., by enforcing endogenous expression of RNA hairpins (see, Paddison et al., Proc. Natl. Acad. Sci. U.S.A. 99:1443-1448, 2002) or, as noted above, by transfection of small (21-23 nt) dsRNA (reviewed in Caplen, Trends Biotech. 20:49-51, 2002). Methods for modulating gene expression with RNAi are described, e.g., in U.S. Pat. No. 6,506,559 and US 2003/0056235, which are hereby incorporated by reference.

Standard molecular biology techniques can be used to generate siRNAs. Short interfering RNAs can be chemically synthesized, recombinantly produced, e.g., by expressing RNA from a template DNA, such as a plasmid, or obtained from commercial vendors, such as Dharmacon. The RNA used to mediate RNAi can include synthetic or modified nucleotides, such as phosphorothioate nucleotides. Methods of transfecting cells with siRNA or with plasmids engineered to make siRNA are routine in the art.

The siRNA molecules used to decrease expression of a TNFα, TNFR1, TNFR2, TRADD, TRAF2, MEKK1/4, MEKK4/7, JNK, AP-1, ASK1, RIP, MEKK 3/6, MAPK, NIK, IKK, NF-κB, CD14, MyD88, IRAK, lipopolysaccharide binding protein (LBP), TRAF6, ras, raf, MEK1/2, ERK1/2, NIK, IKK, IκB, NF-κB, rac, MEK4/7, JNK, c-jun, MEK3/6, p38, PKR, TTP, or MK2 mRNA can vary in a number of ways. For example, they can include a 3' hydroxyl group and strands of 21, 22, or 23 consecutive nucleotides. They can be blunt ended or include an overhanging end at either the 3' end, the 5' end, or both ends. For example, at least one strand of the RNA molecule can have a 3' overhang from about 1 to about 6 nucleotides (e.g., 1-5, 1-3, 2-4, or 3-5 nucleotides (whether pyrimidine or purine nucleotides) in length. Where both strands include an overhang, the length of the overhangs may be the same or different for each strand.

To further enhance the stability of the RNA duplexes, the 3' overhangs can be stabilized against degradation (by, e.g., including purine nucleotides, such as adenosine or guanosine nucleotides or replacing pyrimidine nucleotides by modified analogues (e.g., substitution of uridine 2-nucleotide 3' overhangs by 2'-deoxythymidine is tolerated and does not affect the efficiency of RNAi). Any siRNA can be used in the methods of decreasing a TNFα, TNFR1, TNFR2, TRADD, TRAF2, MEKK1/4, MEKK4/7, JNK, AP-1, ASK1, RIP, MEKK 3/6, MAPK, NIK, IKK, NF-κB, CD14, MyD88, IRAK, lipopolysaccharide binding protein (LBP), TRAF6, ras, raf, MEK1/2, ERK1/2, NIK, IKK, IκB, NF-κB, rac, MEK4/7, JNK, c-jun, MEK3/6, p38, PKR, TTP, or MK2 mRNA, provided it has sufficient homology to the target of interest (e.g., a sequence present in any one of SEQ ID NOs: 13-49, e.g., a target sequence encompassing the translation start site or the first exon of the mRNA). There is no upper limit on the length of the siRNA that can be used (e.g., the siRNA can range from about 21 base pairs of the gene to the full length of the gene or more (e.g., about 20 to about 30 base pairs, about 50 to about 60 base pairs, about 60 to about 70 base pairs, about 70 to about 80 base pairs, about 80 to about 90 base pairs, or about 90 to about 100 base pairs).

Exemplary TNFα inhibitors that are inhibitory nucleic acids targeting TNFα include, e.g., antisense DNA (e.g., Myers et al., *J Pharmacol Exp Ther.* 304 (1): 411-424, 2003; Wasmuth et al., *Invest. Opthalmol. Vis. Sci,* 2003; Dong et al., *J. Orthop. Res.* 26 (8): 1114-1120, 2008; U.S. Patent Application Ser. Nos. 2003/0083275, 2003/0022848, and 2004/0770970; ISIS 104838; U.S. Pat. Nos. 6,180,403, 6,080,580, and 6,228,642; Kobzik et al., Inhibition of TNF Synthesis by Antisense Oligonucleotides, in Manual of Antisense Methodology, Kluwer Academic Publishers, Vol. 4, pp. 107-123, 1999; Taylor et al., *Antisense Nucleic Acid Drug Develop.* 8 (3): 199-205, 1998; Mayne et al., *Stroke* 32:240-248, 2001; Mochizuki et al., *J. Controlled Release* 151 (2): 155-161, 2011; Dong et al., *J. Orthopaedic Res.* 26 (8): 1114-1120, 2008; Dong et al., *Pharm. Res.* 28 (6): 1349-1356, 2011; and Pampfer et al., *Biol. Reproduction* 52 (6): 1316-1326, 1995), antisense RNA, short interfering RNA (siRNA) (e.g., Taishi et al., *Brain Research* 1156:125-132, 2007; Presumey et al., *Eur. J. Pharm. Biopharm.* 82 (3): 457-467, 2012; Laroui et al., *J. Controlled Release* 186:41-53, 2014; D'Amore et al., *Int. J. Immunopathology Pharmacol.* 21:1045-1047, 2008; Choi et al., *J. Dermatol. Sci.* 52:87-97, 2008; Qin et al., *Artificial Organs* 35:706-714, 2011; McCarthy et al., *J. Controlled Release* 168:28-34, 2013; Khoury et al., *Current Opin. Mol. Therapeutics* 9 (5): 483-489, 2007; Lu et al., RNA Interference Technology From Basic Science to Drug Development 303, 2005; Xie et al., *PharmaGenomics* 4 (6): 28-34, 2004; Aldawsari et al., *Current Pharmaceutical Design* 21 (31): 4594-4605, 2015; Zheng et al., *Arch. Med. Sci.* 11:1296-1302, 2015; Peng et al., *Chinese J. Surgery* 47 (5): 377-380, 2009; Aldayel et al., *Molecular Therapy. Nucleic Acids* 5 (7): e340, 2016; Bai et al., *Current Drug Targets* 16:1531-1539, 2015; U.S. Patent Application Publications Nos. 2008/0097091, 2009/0306356, and 2005/0227935; and WO 14/168264), short hairpin RNA (shRNA) (e.g., Jakobsen et al., *Mol. Ther.* 17 (10): 1743-1753, 2009; Ogawa et al., *PLOS One* 9 (3): e92073, 2014; Ding et al., Bone Joint 94-6 (Suppl. 11): 44, 2014; and Hernandez-Alejandro et al., *J. Surgical Res.* 176 (2): 614-620, 2012), and microRNAs (see, e.g., WO 15/26249). In some embodiments, the inhibitory nucleic acid blocks pre-mRNA splicing of TNFα (e.g., Chiu et al., *Mol. Pharmacol.* 71 (6): 1640-1645, 2007).

In some embodiments, the inhibitory nucleic acid, e.g., an aptamer (e.g., Orava et al., *ACS Chem Biol.* 2013; 8 (1): 170-178, 2013), can block the binding of a TNFα protein with its receptor (TNFR1 and/or TNFR2).

In some embodiments, the inhibitory nucleic acid can down-regulate the expression of a TNFα-induced downstream mediator (e.g., TRADD, TRAF2, MEKK1/4, MEKK4/7, JNK, AP-1, ASK1, RIP, MEKK 3/6, MAPK, NIK, IKK, NF-κB, p38, JNK, IκB-α, or CCL2). Further teachings of downstream TNFα-induced mediators can be found in, e.g., Schwamborn et al., *BMC Genomics* 4:46, 2003; and Zhou et al., *Oncogene* 22:2034-2044, 2003, incorporated by reference herein. Additional aspects of inhibitory nucleic acids are described in Aagaard et al., *Adv. Drug Delivery Rev.* 59 (2): 75-86, 2007, and Burnett et al., *Biotechnol. J.* 6 (9): 1130-1146, 2011.

In certain embodiments, a therapeutically effective amount of an inhibitory nucleic acid targeting a nucleic acid encoding a TNFα, TNFR1, TNFR2, TRADD, TRAF2, MEKK1/4, MEKK4/7, JNK, AP-1, ASK1, RIP, MEKK 3/6, MAPK, NIK, IKK, NF-κB, CD14, MyD88, IRAK, lipopolysaccharide binding protein (LBP), TRAF6, ras, raf, MEK1/2, ERK1/2, NIK, IKK, IκB, NF-κB, rac, MEK4/7, JNK, c-jun, MEK3/6, p38, PKR, TTP, or MK2 protein can be administered to a subject (e.g., a human subject) in need thereof.

In some embodiments, the inhibitory nucleic acid can be about 10 nucleotides to about 40 nucleotides (e.g., about 10 to about 30 nucleotides, about 10 to about 25 nucleotides, about 10 to about 20 nucleotides, about 10 to about 15 nucleotides, 10 nucleotides, 11 nucleotides, 12 nucleotides, 13 nucleotides, 14 nucleotides, 15 nucleotides, 16 nucleotides, 17 nucleotides, 18 nucleotides, 19 nucleotides, 20 nucleotides, 21 nucleotides, 22 nucleotides, 23 nucleotides, 24 nucleotides, 25 nucleotides, 26 nucleotides, 27 nucleotides, 28 nucleotides, 29 nucleotides, 30 nucleotides, 31 nucleotides, 32 nucleotides, 33 nucleotides, 34 nucleotides, 35 nucleotides, 36 nucleotides, 37 nucleotides, 38 nucleotides, 39 nucleotides, or 40 nucleotides) in length. One skilled in the art will appreciate that inhibitory nucleic acids may comprise at least one modified nucleic acid at either the 5' or 3'end of DNA or RNA.

As is known in the art, the term "thermal melting point (Tm)" refers to the temperature, under defined ionic strength, pH, and inhibitory nucleic acid concentration, at which 50% of the inhibitory nucleic acids complementary to the target sequence hybridize to the target sequence at equilibrium. In some embodiments, an inhibitory nucleic acid can bind specifically to a target nucleic acid under stingent conditions, e.g., those in which the salt concentration is at least about 0.01 to 1.0 M Na ion concentration (or other salts) at pH 7.0 to 8.3 and the temperature is at least about 30° C. for short oligonucleotides (e.g., 10 to 50 nucleotide). Stringent conditions can also be achieved with the addition of destabilizing agents such as formamide.

In some embodiments of any of the inhibitory nucleic acids described herein, the inhibitory nucleic acid binds to a target nucleic acid (e.g., a nucleic acid encoding any one of TNFα, TNFR1, TNFR2, TRADD, TRAF2, MEKK1/4, MEKK4/7, JNK, AP-1, ASK1, RIP, MEKK 3/6, MAPK, NIK, IKK, NF-κB, CD14, MyD88, IRAK, lipopolysaccharide binding protein (LBP), TRAF6, ras, raf, MEK1/2, ERK1/2, NIK, IKK, IκB, NF-κB, rac, MEK4/7, JNK, c-jun, MEK3/6, p38, PKR, TTP, or MK2) with a Tm of greater than 20° C., greater than 22° C., greater than 24° C., greater than 26° C., greater than 28° C., greater than 30° C., greater than 32° C., greater than 34° C., greater than 36° C., greater than 38° C., greater than 40° C., greater than 42° C., greater than 44° C., greater than 46° C., greater than 48° C., greater than 50° C., greater than 52° C., greater than 54° C., greater than 56° C., greater than 58° C., greater than 60° C., greater than 62° C., greater than 64° C., greater than 66° C., greater than 68° C., greater than 70° C., greater than 72° C., greater than 74° C., greater than 76° C., greater than 78° C., or greater than 80° C., e.g., as measured in phosphate buffered saline using a UV spectrophotometer.

In some embodiments of any of the inhibitor nucleic acids described herein, the inhibitory nucleic acid binds to a target nucleic acid (e.g., a nucleic acid encoding any one of TNFα, TNFR1, TNFR2, TRADD, TRAF2, MEKK1/4, MEKK4/7, JNK, AP-1, ASK1, RIP, MEKK 3/6, MAPK, NIK, IKK, NF-κB, CD14, MyD88, IRAK, lipopolysaccharide binding protein (LBP), TRAF6, ras, raf, MEK 1/2, ERK1/2, NIK, IKK, IκB, NF-κB, rac, MEK4/7, JNK, c-jun, MEK3/6, p38, PKR, TTP, or MK2) with a Tm of about 20° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., about 30° C., about 28° C., about 26° C., about 24° C., or about 22° C. (inclusive); about 22° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., about 30° C., about 28° C., about 26° C., or about 24° C. (inclusive); about 24° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., about 30° C., about 28° C., or about 26° C. (inclusive); about 26° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., about 30° C., or about 28° C. (inclusive); about 28° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., or about 30° C. (inclusive); about 30° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., or about 32° C. (inclusive); about 32° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., or about 34° C. (inclusive); about 34° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., or about 36° C. (inclusive); about 36° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., or about 38° C. (inclusive); about 38° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., or about 40° C. (inclusive); about 40° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., or about 42° C. (inclusive); about 42° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., or about 44° C. (inclusive); about 44° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., or about 46° C. (inclusive); about 46° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., or about 48° C. (inclusive); about 48° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., or about 50° C. (inclusive); about 50° C. to about 80° C., about 78° C., about 76° C., about 74° C., about 72° C., about 70° C., about 68° C., about 66° C., about 64° C., about 62° C., about 60° C., about 58° C., about 56° C., about 54° C., or about 52° C. (inclusive); about 52° C. to about 80° C., about 78° C., about 76° C., about 74° C., about 72° C., about 70° C., about 68° C., about 66° C., about 64° C., about 62° C., about 60° C., about 58° C., about 56°

C., or about 54° C. (inclusive); about 54° C. to about 80° C., about 78° C., about 76° C., about 74° C., about 72° C., about 70° C., about 68° C., about 66° C., about 64° C., about 62° C., about 60° C., about 58° C., or about 56° C. (inclusive); about 56° C. to about 80° C., about 78° C., about 76° C., about 74° C., about 72° C., about 70° C., about 68° C., about 66° C., about 64° C., about 62° C., about 60° C., or about 58° C. (inclusive); about 58° C. to about 80° C., about 78° C., about 76° C., about 74° C., about 72° C., about 70° C., about 68° C., about 66° C., about 64° C., about 62° C., or about 60° C. (inclusive); about 60° C. to about 80° C., about 78° C., about 76° C., about 74° C., about 72° C., about 70° C., about 68° C., about 66° C., about 64° C., or about 62° C. (inclusive); about 62° C. to about 80° C., about 78° C., about 76° C., about 74° C., about 72° C., about 70° C., about 68° C., about 66° C., or about 64° C. (inclusive); about 64° C. to about 80° C., about 78° C., about 76° C., about 74° C., about 72° C., about 70° C., about 68° C., or about 66° C. (inclusive); about 66° C. to about 80° C., about 78° C., about 76° C., about 74° C., about 72° C., about 70° C., or about 68° C. (inclusive); about 68° C. to about 80° C., about 78° C., about 76° C., about 74° C., about 72° C., or about 70° C. (inclusive); about 70° C. to about 80° C., about 78° C., about 76° C., about 74° C., or about 72° C. (inclusive); about 72° C. to about 80° C., about 78° C., about 76° C., or about 74° C. (inclusive); about 74° C. to about 80° C., about 78° C., or about 76° C. (inclusive); about 76° C. to about 80° C. or about 78° C. (inclusive); or about 78° C. to about 80° C. (inclusive).

In some embodiments, the inhibitory nucleic acid can be formulated in a nanoparticle (e.g., a nanoparticle including one or more synthetic polymers, e.g., Patil et al., *Pharmaceutical Nanotechnol.* 367:195-203, 2009; Yang et al., *ACS Appl. Mater. Interfaces*, doi: 10.1021/acsami.6b16556, 2017; Perepelyuk et al., *Mol. Ther. Nucleic Acids* 6:259-268, 2017). In some embodiments, the nanoparticle can be a mucoadhesive particle (e.g., nanoparticles having a positively-charged exterior surface) (Andersen et al., *Methods Mol. Biol.* 555:77-86, 2009). In some embodiments, the nanoparticle can have a neutrally-charged exterior surface.

In some embodiments, the inhibitory nucleic acid can be formulated, e.g., as a liposome (Buyens et al., *J. Control Release* 158 (3): 362-370, 2012; Scarabel et al., *Expert Opin. Drug Deliv.* 17:1-14, 2017), a micelle (e.g., a mixed micelle) (Tangsangasaksri et al., *BioMacromolecules* 17:246-255, 2016; Wu et al., *Nanotechnology*, doi: 10.1088/1361-6528/aa6519, 2017), a microemulsion (WO 11/004395), a nanoemulsion, or a solid lipid nanoparticle (Sahay et al., *Nature Biotechnol.* 31:653-658, 2013; and Lin et al., *Nanomedicine* 9 (1): 105-120, 2014). Additional exemplary structural features of inhibitory nucleic acids and formulations of inhibitory nucleic acids are described in US 2016/0090598.

In some embodiments, a pharmaceutical composition can include a sterile saline solution and one or more inhibitory nucleic acid (e.g., any of the inhibitory nucleic acids described herein). In some examples, a pharmaceutical composition consists of a sterile saline solution and one or more inhibitory nucleic acid (e.g., any of the inhibitory nucleic acids described herein). In certain embodiments, the sterile saline is a pharmaceutical grade saline. In certain embodiments, a pharmaceutical composition can include one or more inhibitory nucleic acid (e.g., any of the inhibitory nucleic acids described herein) and sterile water. In certain embodiments, a pharmaceutical composition consists of one or more inhibitory nucleic acid (e.g., any of the inhibitory nucleic acids described herein) and sterile water.

In certain embodiments, a pharmaceutical composition includes one or more inhibitory nucleic acid (e.g., any of the inhibitory nucleic acids described herein) and phosphate-buffered saline (PBS). In certain embodiments, a pharmaceutical composition consists of one or more inhibitory nucleic acids (e.g., any of the inhibitory nucleic acids described herein) and sterile phosphate-buffered saline (PBS). In some examples, the sterile saline is a pharmaceutical grade PBS.

In certain embodiments, one or more inhibitory nucleic acids (e.g., any of the inhibitory nucleic acids described herein) may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

Pharmaceutical compositions including one or more inhibitory nucleic acids encompass any pharmaceutically acceptable salts, esters, or salts of such esters. Non-limiting examples of pharmaceutical compositions include pharmaceutically acceptable salts of inhibitory nucleic acids. Suitable pharmaceutically acceptable salts include, but are not limited to, sodium and potassium salts.

Also provided herein are prodrugs that can include additional nucleosides at one or both ends of an inhibitory nucleic acid which are cleaved by endogenous nucleases within the body, to form the active inhibitory nucleic acid.

Lipid moieties can be used to formulate an inhibitory nucleic acid. In certain such methods, the inhibitory nucleic acid is introduced into preformed liposomes or lipoplexes made of mixtures of cationic lipids and neutral lipids. In certain methods, inhibitory nucleic acid complexes with mono- or poly-cationic lipids are formed without the presence of a neutral lipid. In certain embodiments, a lipid moiety is selected to increase distribution of an inhibitory nucleic acid to a particular cell or tissue in a mammal. In some examples, a lipid moiety is selected to increase distribution of an inhibitory nucleic acid to fat tissue in a mammal. In certain embodiments, a lipid moiety is selected to increase distribution of an inhibitory nucleic acid to muscle tissue.

In certain embodiments, pharmaceutical compositions provided herein comprise one or more inhibitory nucleic acid and one or more excipients. In certain such embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In some examples, a pharmaceutical composition provided herein includes liposomes and emulsions. Liposomes and emulsions can be used to formulate hydrophobic compounds. In some examples, certain organic solvents such as dimethylsulfoxide are used.

In some examples, a pharmaceutical composition provided herein includes one or more tissue-specific delivery molecules designed to deliver one or more inhibitory nucleic acids to specific tissues or cell types in a mammal. For example, a pharmaceutical composition can include liposomes coated with a tissue-specific antibody.

In some embodiments, a pharmaceutical composition provided herein can include a co-solvent system. Examples of such co-solvent systems include benzyl alcohol, a non-polar surfactant, a water-miscible organic polymer, and an aqueous phase. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. As can be appreciated, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In some examples, a pharmaceutical composition can be formulated for oral administration. In some examples, pharmaceutical compositions are formulated for buccal administration.

In some examples, a pharmaceutical composition is formulated for administration by injection (e.g., intravenous, subcutaneous, intramuscular, etc.). In some of these embodiments, a pharmaceutical composition includes a carrier and is formulated in aqueous solution, such as water or physiologically compatible buffers such as Hanks's solution, Ringer's solution, or physiological saline buffer. In some examples, other ingredients are included (e.g., ingredients that aid in solubility or serve as preservatives). In some examples, injectable suspensions are prepared using appropriate liquid carriers, suspending agents, and the like. Some pharmaceutical compositions for injection are formulated in unit dosage form, e.g., in ampoules or in multi-dose containers. Some pharmaceutical compositions for injection are suspensions, solutions, or emulsions in oily or aqueous vehicles, and may contain formulatory agents such as suspending, stabilizing, and/or dispersing agents. Solvents suitable for use in pharmaceutical compositions for injection include, but are not limited to, lipophilic solvents and fatty oils, such as sesame oil, synthetic fatty acid esters, such as ethyl oleate or triglycerides, and liposomes.

Antibodies

In some embodiments, the TNFα inhibitor is an antibody or an antigen-binding fragment thereof (e.g., a Fab or a scFv). In some embodiments, an antibody or antigen-binding fragment described herein binds specifically to any one of TNFα, TNFR1, or TNFR2. In some embodiments, an antibody or antigen-binding fragment of an antibody described herein can bind specifically to TNFα. In some embodiments, an antibody or antigen-binding fragment of an antibody described herein can bind specifically to an TNFα receptor (TNFR1 or TNFR2). Identification of TNF-R1 binding moieties identified by affinity maturation are described in in PCT International Patent Publication No. WO2017174586 the disclosure of which is incorporated herein by reference in its entirety. An example of a humanized anti-TNFR1 monoclonal antibody is described in PCT International Patent Publication No. WO2008113515, and an improved anti-TNFR1 monoclonal antibody, ATROSIMAB, with a modified Fc region is described in PCT International Patent Publication No. WO2012035141; and Richter, Fabian, et al. "Improved monovalent TNF receptor 1-selective inhibitor with novel heterodimerizing Fc." mAbs. Taylor & Francis, 2019, the disclosures of each of which are incorporated herein by reference in their entirety.

In some embodiments, the antibody can be a humanized antibody, a chimeric antibody, a multivalent antibody, or a fragment thereof. In some embodiments, an antibody can be a scFv-Fc, a VHH domain, a VNAR domain, a (scFv) 2, a minibody, or a BiTE. In some embodiments, an antibody can be a DVD-Ig, and a dual-affinity re-targeting antibody (DART), a triomab, kih IgG with a common LC, a crossmab, an ortho-Fab IgG, a 2-in-1-IgG, IgG-ScFv, scFv2-Fc, a bi-nanobody, tanden antibody, a DART-Fc, a scFv-HAS-scFv, DNL-Fab3, DAF (two-in-one or four-in-one), Duta-Mab, DT-IgG, knobs-in-holes common LC, knobs-in-holes assembly, charge pair antibody, Fab-arm exchange antibody, SEEDbody, Triomab, LUZ-Y, Fcab, kλ-body, orthogonal Fab, DVD-IgG, IgG (H)-scFv, scFv-(H) IgG, IgG (L)-scFv, scFv-(L)-IgG, IgG (L,H)-Fc, IgG (H)-V, V (H)-IgG, IgG (L)-V, V (L)-IgG, KIH IgG-scFab, 2scFv-IgG, IgG-2scFv, scFv4-Ig, Zybody, DVI-IgG, nanobody, nanobody-HSA, a diabody, a TandAb, scDiabody, scDiabody-CH3, Diabody-CH3, Triple Body, miniantibody, minibody, TriBi minibody, scFv-CH3 KIH, Fab-scFv, scFv-CH-CL-scFv, F(ab')2-scFV2, scFv-KIH, Fab-scFv-Fc, tetravalent HCAb, scDiabody-Fc, diabody-Fc, tandem scFv-Fc, intrabody, dock and lock bispecific antibody, ImmTAC, HSAbody, scDiabody-HAS, tandem scFv, IgG-IgG, Cov-X-Body, and scFv1-PEG-scFv2.

Non-limiting examples of an antigen-binding fragment of an antibody include an Fv fragment, a Fab fragment, a F(ab')2 fragment, and a Fab' fragment. Additional examples of an antigen-binding fragment of an antibody is an antigen-binding fragment of an IgG (e.g., an antigen-binding fragment of IgG1, IgG2, IgG3, or IgG4) (e.g., an antigen-binding fragment of a human or humanized IgG, e.g., human or humanized IgG1, IgG2, IgG3, or IgG4); an antigen-binding fragment of an IgA (e.g., an antigen-binding fragment of IgA1 or IgA2) (e.g., an antigen-binding fragment of a human or humanized IgA, e.g., a human or humanized IgA1 or IgA2); an antigen-binding fragment of an IgD (e.g., an antigen-binding fragment of a human or humanized IgD); an antigen-binding fragment of an IgE (e.g., an antigen-binding fragment of a human or humanized IgE); or an antigen-binding fragment of an IgM (e.g., an antigen-binding fragment of a human or humanized IgM).

Non-limiting examples of TNF inhibitors that are antibodies that specifically bind to TNFα are described in Elliott et al., *Lancet* 1994; 344:1125-1127, 1994; Rankin et al., *Br. J. Rheumatol.* 2:334-342, 1995; Butler et al., *Eur. Cytokine Network* 6 (4): 225-230, 1994; Lorenz et al., *J. Immunol.* 156 (4): 1646-1653, 1996; Hinshaw et al., *Circulatory Shock* 30 (3): 279-292, 1990; Wanner et al., *Shock* 11 (6): 391-395, 1999; Bongartz et al., *JAMA* 295 (19): 2275-2285, 2006; Knight et al., *Molecular Immunol.* 30 (16): 1443-1453, 1993; *Feldman, Nature Reviews Immunol.* 2 (5): 364-371, 2002; Taylor et al., *Nature Reviews Rheumatol.* 5 (10): 578-582, 2009; Garces et al., *Annals Rheumatic Dis.* 72 (12): 1947-1955, 2013; Palladino et al., *Nature Rev. Drug Discovery* 2 (9): 736-746, 2003; Sandborn et al., *Inflammatory Bowel Diseases* 5 (2): 119-133, 1999; Atzeni et al., *Autoimmunity Reviews* 12 (7): 703-708, 2013; Maini et al., *Immunol. Rev.* 144 (1): 195-223, 1995; Ordas et al., *Clin. Pharmacol. Therapeutics* 91 (4): 635-646, 2012; Cohen et al., *Canadian J. Gastroenterol. Hepatol.* 15 (6): 376-384, 2001; Feldmann et al., *Ann. Rev. Immunol.* 19 (1): 163-196, 2001; Ben-Horin et al., *Autoimmunity Rev.* 13 (1): 24-30, 2014; and U.S. Pat. Nos. 6,090,382; 6,258,562; and 6,509, 015).

In certain embodiments, the TNFα inhibitor can include or is infliximab (Remicade™), CDP571, CDP 870, golimumab (Glimumab™), adalimumab (Humira™), or certolizumab pegol (Cimzia™). In certain embodiments, the TNFα inhibitor can be a TNFα inhibitor biosimilar. Examples of approved and late-phase TNFα inhibitor biosimilars include, but are not limited to, infliximab biosimilars such as Remsima™ and Inflectra® (CT-P13) from Celltrion/Pfizer, GS071 from Aprogen, Flixabi™ (SB2) from Samsung Bioepis, PF-06438179 from Pfizer/Sandoz, NI-071 from Nichi-Iko Pharmaceutical Co., and ABP 710 from Amgen; adalimumab biosimilars such as Exemptia™ (ZRC3197) from Zydus Cadila, India, Solymbic® and Amgevita® (ABP 501) from Amgen, Imraldi (SB5) from Samsung Bioepis, GP-2017 from Sandoz, Switzerland, ONS-3010 from Oncobiologics/Viropro, U.S.A., M923 from Momenta Pharmaceuticals/Baxalta (Baxter spinoff USA), PF-06410293 from Pfizer, BMO-2 or MYL-1401-A from Biocon/Mylan, CHS-1420 from Coherus, FKB327 from Fujifilm/Kyowa Hakko Kirin (Fujifilm Kyowa Kirin Biologics), Cyltezo (BI 695501) from Boehringer Ingelheim, CT-P17 from Celltrion, BAX 923 from Baxalta (now a part of Shire), MSB11022 from Fresenius Kabi (bought from Merck kGaA (Merck Group) in 2017), LBAL from LG Life Sciences/Mochida Pharmaceutical, South Korea/Japan, PBP1502 from Prestige Biopharma, Adfrar from Torrent Pharmaceuticals, India, a biosimilar of adalimumab in development by Adello Biologics, a biosimilar of adalimumab in development by AET Biotech/BioXpress Therapeutics, Germany/Switzerland, a biosimilar of adalimumab from mAbxience, Spain, a biosimilar of adalimumab in development by Plant-Form, Canada; and etanercept biosimilars such as Erelzi™ from Sandoz/Novartis, Brenzys™ (SB4) from Samsung Bioepis, GP2015 from Sandoz, TuNEX® from Mycenax, LBEC0101 from LG Life, and CHS-0214 from Coherus.

In some embodiments, a biosimilar is an antibody or antigen-binding fragment thereof that has a light chain that has the same primary amino acid sequence as compared to a reference antibody (e.g., adalimumab) and a heavy chain that has the same primary amino acid sequence as compared to the reference antibody. In some examples, a biosimilar is an antibody or antigen-binding fragment thereof that has a light chain that includes the same light chain variable domain sequence as a reference antibody (e.g., adalimumab) and a heavy chain that includes the same heavy chain variable domain sequence as a reference antibody. In some embodiments, a biosimilar can have a similar glycosylation pattern as compared to the reference antibody (e.g., adalimumab). In other embodiments, a biosimilar can have a different glycosylation pattern as compared to the reference antibody (e.g., adalimumab).

Changes in the N-linked glycosylation profile of a biosimilar as compared to a reference antibody (e.g., adalimumab) can be detected using 2-anthranilic acid (AA)-derivatization and normal phase liquid chromatography with fluorescence detection, as generally described in Kamoda et al., *J. Chromatography J.* 1133:332-339, 2006. For example, a biosimilar can have changes in one or more (e.g., two, three, four, five, six, seven, eight, nine, ten, or eleven) of the following types of N-glycosylation as compared to the reference antibody (e.g., adalimumab): neutrally-charged oligosaccharides; monosialylated fucose-containing oligosaccharides; monosialylated oligosaccharides; bisialylated fucose-containing oligosaccharide; bisialylated oligosaccharides; triantennary, trisiaylated oligosaccharides of form 1; triantennary, trisialylated oligosaccharides of form 2; mannose-6-phosphate oligosaccharides; monophosphorylated oligosaccharides; tetrasialylated oligosaccharides; monosialylated and monophosphorylated oligosaccharides; and bis-mannose-6-phosphate oligosaccharides.

In some embodiments, the biosimilar can have a change in one, two, or three of: the percentage of species having one C-terminal lysine, the percentage of species having two C-terminal lysines, and the percentage of species having three C-terminal lysines as compared to the reference antibody (e.g., adalimumab).

In some embodiments, the biosimilar can have a change in the level of one, two, or three of acidic species, neutral species, and basic species in the composition as compared to the reference antibody (e.g., adalimumab).

In some embodiments, the biosimilar can have a change in the level of sulfation as compared to the reference antibody.

In some embodiments, the TNFα inhibitor can be SAR252067 (e.g., a monoclonal antibody that specifically binds to TNFSF14, described in U.S. Patent Application Publication No. 2013/0315913) or MDGN-002 (described in U.S. Patent Application Publication No. 2015/0337046). In some embodiments, the TNFα inhibitor can be PF-06480605, which binds specifically to TNFSF15 (e.g., described in U.S. Patent Application Publication No. 2015/0132311). Additional examples of TNFα inhibitors include DLCX105 (described in Tsianakas et al., *Exp. Dermatol.* 25:428-433, 2016) and PF-06480605, which binds specifically to TNFSF15 (described in U.S. Patent Application Publication No. 2015/0132311). Further examples of TNFα inhibitors that are antibodies or antigen-binding antibody fragments are described in, e.g., WO 17/158097, EP 3219727, WO 16/156465, and WO 17/167997.

In some embodiments, any of the antibodies or antigen-binding fragments described herein has a dissociation constant ($K_D$) of less than $1 \times 10^{-5}$ M (e.g., less than $0.5 \times 10^{-5}$ M, less than $1 \times 10^{-6}$ M, less than $0.5 \times 10^{-6}$ M, less than $1 \times 10^{-7}$ M, less than $0.5 \times 10^{-7}$ M, less than $1 \times 10^{-8}$ M, less than $0.5 \times 10^{-8}$ M, less than $1 \times 10^{-9}$ M, less than $0.5 \times 10^{-9}$ M, less than $1 \times 10^{-10}$ M, less than $0.5 \times 10^{-10}$ M, less than $1 \times 10^{-11}$ M, less than $0.5 \times 10^{-11}$ M, or less than $1 \times 10^{-12}$ M), e.g., as measured in phosphate buffered saline using surface plasmon resonance (SPR).

In some embodiments, any of the antibodies or antigen-binding fragments described herein has a $K_D$ of about $1 \times 10^{-12}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$ M, about $0.5 \times 10^{-9}$ M, about $1 \times 10^{-10}$ M, about $0.5 \times 10^{-10}$ M, about $1 \times 10^{-11}$ M, or about $0.5 \times 10^{-1}$ M (inclusive); about $0.5 \times 10^{-11}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$ M, about $0.5 \times 10^{-9}$ M, about $1 \times 10^{-10}$ M, about $0.5 \times 10^{-10}$ M, or about $1 \times 10^{-11}$ M (inclusive); about $1 \times 10^{-11}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$ M, about $0.5 \times 10^{-9}$ M, about $1 \times 10^{-10}$ M, or about $0.5 \times 10^{-10}$ M (inclusive); about $0.5 \times 10^{-10}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$ M, about $0.5 \times 10^{-9}$ M, or about $1 \times 10^{-10}$ M (inclusive); about $1 \times 10^{-10}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$ M, or about $0.5 \times 10^{-9}$ M (inclusive); about $0.5 \times 10^{-9}$ M to about $1 \times 10^{5}$ M, about $0.5 \times 10^{5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, or about $1 \times 10^{-9}$ M (inclusive); about $1 \times 10^{-9}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, or about $0.5 \times 10^{-8}$ M (inclusive); about $0.5 \times 10^{-8}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, or about $1 \times 10^{-8}$ M (inclusive); about $1 \times 10^{-8}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, or about $0.5 \times 10^{-7}$ M (inclusive); about $0.5 \times 10^{-7}$ M to about 1×10$^{-5}$ M, about 0.5×10$^{-5}$ M, about 1×10$^{-6}$ M, about 0.5×10$^{-6}$ M, or about 1×10$^{-7}$M (inclusive); about 1×10$^{-7}$ M to about 1×10$^{-5}$ M, about 0.5×10$^{-5}$ M, about 1×10$^{-6}$ M, or about 0.5×10$^{-6}$ M (inclusive); about 0.5×10$^{-6}$ M to about 1×10$^{-5}$ M, about 0.5×10$^5$ M, or about 1×10$^{-6}$ M (inclusive); about 1×10$^{-6}$ M to about 1×10$^{-5}$ M or about 0.5×10$^{-5}$ M (inclusive); or about 0.5×10$^{-5}$ M to about 1×10$^{-5}$ M (inclusive), e.g., as measured in phosphate buffered saline using surface plasmon resonance (SPR).

In some embodiments, any of the antibodies or antigen-binding fragments described herein has a K$_{off}$ of about 1×10$^{-6}$ s$^{-1}$ to about 1×10$^{-3}$ s$^{-1}$, about 0.5×10$^{-3}$ s$^{-1}$, about 1×10$^{-4}$ s 1, about 0.5×10$^{-4}$ s$^{-1}$, about 1×10$^{-5}$ s$^{-1}$, or about 0.5×10$^{-5}$ s$^{-1}$ (inclusive); about 0.5×10$^{-5}$ s$^{-1}$ to about 1×10$^{-3}$ s$^{-1}$, about 0.5×10$^{-3}$ s$^{-1}$, about 1×10$^{-4}$ s$^{-1}$, about 0.5×10$^{-4}$ s$^{-1}$, or about 1×10$^{-5}$ s$^{-1}$ (inclusive); about 1×10$^{-5}$ s$^1$ to about 1×10$^{-3}$ s$^{-1}$, about 0.5×10$^{-3}$ s$^{-1}$, about 1×10$^{-4}$ s$^{-1}$, or about 0.5×10$^{-4}$ s$^{-1}$ (inclusive); about 0.5×10$^{-4}$ s$^{-1}$ to about 1×10$^{-3}$ s$^{-1}$, about 0.5×10$^{-3}$ s$^{-1}$, or about 1×10$^{-4}$ s$^{-1}$ (inclusive); about 1×10$^{-4}$ s$^{-1}$ to about 1×10$^{-3}$ s$^{-1}$, or about 0.5×10$^{-3}$ s$^{-1}$ (inclusive); or about 0.5×10$^{-5}$ s$^{-1}$ to about 1×10$^{-3}$ s$^{-1}$ (inclusive), e.g., as measured in phosphate buffered saline using surface plasmon resonance (SPR).

In some embodiments, any of the antibodies or antigen-binding fragments described herein has a K$_{on}$ of about 1×10$^2$ M$^{-1}$s$^{-1}$ to about 1×10$^6$ M$^{-1}$s$^{-1}$, about 0.5×10$^6$ M$^{-1}$s$^{-1}$, about 1×10$^5$ M$^{-1}$s$^{-1}$, about 0.5×10$^5$ M$^1$s$^{-1}$, about 1×10$^4$ M$^{-1}$s$^{-1}$, about 0.5×10$^4$ M$^{-1}$s$^{-1}$, about 1×10$^3$ M$^{-1}$s$^{-1}$, or about 0.5×10$^3$ M$^{-1}$s$^{-1}$ (inclusive); about 0.5×10$^3$ M$^{-1}$s$^{-1}$ to about 1×10$^6$ M$^{-1}$s$^{-1}$, about 0.5×10$^6$ M$^{-1}$s$^{-1}$, about 1×10$^5$ M$^1$s$^{-1}$, about 0.5×10$^5$ M$^{-1}$s$^{-1}$, about 1×10$^4$ M$^{-1}$s$^{-1}$, about 0.5×10$^4$ M$^{-1}$s$^{-1}$, or about 1×10$^3$ M$^{-1}$s$^{-1}$ (inclusive); about 1×10$^3$ M$^{-1}$s$^{-1}$ to about 1×10$^6$ M$^{-1}$s$^{-1}$, about 0.5×10$^6$ M$^{-1}$s$^{-1}$, about 1×10$^5$ M$^{-1}$s$^{-1}$, about 0.5×10$^5$ M$^{-1}$s$^{-1}$, about 1×10$^4$ M$^{-1}$s$^{-1}$, or about 0.5×10$^4$ M$^{-1}$s$^{-1}$ (inclusive); about 0.5×10$^4$ M$^{-1}$s$^{-1}$ to about 1×10$^6$ M$^{-1}$s$^{-1}$, about 0.5×10$^6$ M$^{-1}$s$^{-1}$, about 1×10$^5$ M$^{-1}$s$^{-1}$, about 0.5×10$^5$ M$^{-1}$s$^{-1}$, or about 1×10$^4$ M$^{-1}$s$^{-1}$ (inclusive); about 1×10$^4$ M$^{-1}$s$^{-1}$ to about 1×10$^6$ M$^{-1}$s$^{-1}$, about 0.5×10$^6$ M$^{-1}$s$^{-1}$, about 1×10$^5$ M$^{-1}$s$^{-1}$, or about 0.5×10$^5$ M$^{-1}$s$^{-1}$ (inclusive); about 0.5×10$^5$ M$^{-1}$s$^{-1}$ to about 1×10$^6$ M$^{-1}$s$^{-1}$, about 0.5×10$^6$ M$^{-1}$s$^{-1}$, or about 1×10$^5$ M$^{-1}$s$^{-1}$ (inclusive); about 1×10$^5$ M$^{-1}$s$^{-1}$ to about 1×10$^6$ M$^{-1}$s$^{-1}$, or about 0.5×10$^6$ M$^{-1}$s$^{-1}$ (inclusive); or about 0.5×10$^6$ M$^{-1}$s$^{-1}$ to about 1×10$^6$ M$^{-1}$s$^{-1}$ (inclusive), e.g., as measured in phosphate buffered saline using surface plasmon resonance (SPR).

Fusion Protein Inhibitors of TNFα

In some embodiments, the TNFα inhibitory agent is a fusion protein (e.g., an extracellular domain of a TNFR fused to a partner peptide, e.g., an Fc region of an immunoglobulin, e.g., human IgG) (see, e.g., Peppel et al., *J. Exp. Med.* 174 (6): 1483-1489, 1991; Deeg et al., *Leukemia* 16 (2): 162, 2002) or a soluble TNFR (e.g., TNFR1 or TNFR2) that binds specifically to TNFα. In some embodiments, the TNFα inhibitor includes or is etanercept (Enbrel™) (see, e.g., WO 91/03553 and WO 09/406,476, incorporated by reference herein). In some embodiments, the TNFα inhibitor includes or is r-TBP-I (e.g., Gradstein et al., *J. Acquir. Immune Defic. Syndr.* 26 (2): 111-117, 2001). In some embodiments, the TNFα inhibitor includes or is a soluble TNFα receptor (e.g., Watt et al., *J Leukoc Biol.* 66 (6): 1005-1013, 1999; Tsao et al., *Eur Respir J.* 14 (3): 490-495, 1999; Kozak et al., *Am. J. Physiol. Reg. Integrative Comparative Physiol.* 269 (1): R23-R29, 1995; Mohler et al., *J. Immunol.* 151 (3): 1548-1561, 1993; Nophar et al., *EMBO J.* 9 (10): 3269, 1990; Bjornberg et al., *Lymphokine Cytokine Res.* 13 (3): 203-211, 1994; Piguet et al., *Eur. Respiratory J.* 7 (3): 515-518, 1994; and Gray et al., *Proc. Natl. Acad. Sci. U.S.A.* 87 (19): 7380-7384, 1990).

Small Molecules

In some embodiments, the TNFα inhibitor is a small molecule. In some embodiments, the TNFα inhibitor is C87 (Ma et al., *J. Biol. Chem.* 289 (18): 12457-66, 2014). In some embodiments, the small molecule is LMP-420 (e.g., Haraguchi et al., *AIDS Res. Ther.* 3:8, 2006). In some embodiments, the small molecule is a tumor necrosis factor-converting enzyme (TACE) inhibitor (e.g., Moss et al., *Nature Clinical Practice Rheumatology* 4:300-309, 2008). In some embodiments, the TACE inhibitor is TMI-005 and BMS-561392. Additional examples of small molecule inhibitors are described in, e.g., He et al., *Science* 310 (5750): 1022-1025, 2005.

In some examples, the TNFα inhibitor is a small molecule that inhibits the activity of one of TRADD, TRAF2, MEKK1/4, MEKK4/7, JNK, AP-1, ASK1, RIP, MEKK 3/6, MAPK, NIK, IKK, and NF-κB, in a mammalian cell.

In some examples, the TNFα inhibitor is a small molecule that inhibits the activity of one of CD14, MyD88 (see, e.g., Olson et al., *Scientific Reports* 5:14246, 2015), IRAK (Chaudhary et al., *J. Med. Chem.* 58 (1): 96-110, 2015), lipopolysaccharide binding protein (LBP) (see, e.g., U.S. Pat. No. 5,705,398), TRAF6 (e.g., 3-[(2,5-Dimethylphenyl) amino]-1-phenyl-2-propen-1-one), ras (e.g., Baker et al., *Nature* 497:577-578, 2013), raf (e.g., vemurafenib (PLX4032, RG7204), sorafenib tosylate, PLX-4720, dabrafenib (GSK2118436), GDC-0879, RAF265 (CHIR-265), AZ 628, NVP-BHG712, SB590885, ZM 336372, sorafenib, GW5074, TAK-632, CEP-32496, encorafenib (LGX818), CCT196969, LY3009120, RO5126766 (CH5126766), PLX7904, and MLN2480), MEK1/2 (e.g., Facciorusso et al., *Expert Review Gastroentrol. Hepatol.* 9:993-1003, 2015), ERK1/2 (e.g., Mandal et al., *Oncogene* 35:2547-2561, 2016), NIK (e.g., Mortier et al., *Bioorg. Med. Chem. Lett.* 20:4515-4520, 2010), IKK (e.g., Reilly et al., *Nature Med.* 19:313-321, 2013), IκB (e.g., Suzuki et al., *Expert. Opin. Invest. Drugs* 20:395-405, 2011), NF-κB (e.g., Gupta et al., *Biochim. Biophys. Acta* 1799 (10-12): 775-787, 2010), rac (e.g., U.S. Pat. No. 9,278,956), MEK4/7, JNK (e.g., AEG 3482, BI 78D3, CEP 1347, c-JUN peptide, IQ 1S, JIP-1 (153-163), SP600125, SU 3327, and TCS JNK60), c-jun (e.g., AEG 3482, BI 78D3, CEP 1347, c-JUN peptide, IQ 1S, JIP-1 (153-163), SP600125, SU 3327, and TCS JNK60), MEK3/6 (e.g., Akinleye et al., *J. Hematol. Oncol.* 6:27, 2013), p38 (e.g., AL 8697, AMG 548, BIRB 796, CMPD-1, DBM 1285 dihydrochloride, EO 1428, JX 401, ML 3403, Org 48762-0, PH 797804, RWJ 67657, SB 202190, SB 203580, SB 239063, SB 706504, SCIO 469, SKF 86002, SX 011, TA 01, TA 02, TAK 715, VX 702, and VX 745), PKR (e.g., 2-aminopurine or CAS 608512-97-6), TTP (e.g., CAS 329907-28-0), and MK2 (PF 3644022 and PHA 767491).

IL-1 Inhibitors

The term "IL-1 inhibitor" refers to an agent that decreases the expression of an IL-1 cytokine or an IL-1 receptor and/or decreases the ability of an IL-1 cytokine to bind specifically to an IL-1 receptor. Non-limiting examples of IL-1 cytokines include IL-1α, IL-1β, IL-18, IL-36α, IL-36β, IL-36γ, IL-38, and IL-33. In some examples, an IL-1 cytokine is IL-1α. In some examples, an IL-1 cytokine is IL-1β.

As is known in the art, IL-1α and IL-1B each binds to a complex of IL-1R1 and IL1RAP proteins; IL-18 binds to IL-18Rα; IL-36α, IL-36β, and IL-36γ each binds to a complex of IL-1RL2 and IL-1RAP proteins; and IL-33 binds to a complex of IL1RL1 and IL1RAP proteins. IL-1Ra is an endogenous soluble protein that decreases the ability of IL-1α and IL-1β to bind to their receptor (e.g., a complex of IL-1R1 and IL1RAP proteins). IL-36Ra is an endogenous soluble protein that decreases the ability of IL-36α, IL-36β, and IL-36γ to bind to their receptor (e.g., a complex of IL-1RL2 and IL-1RAP proteins).

In some embodiments, the IL-1 inhibitor mimicks native human interleukin 1 receptor antagonist (IL1-Ra).

In some embodiments, the IL-1 inhibitor targets IL-1α. In some embodiments, the IL-1 inhibitor targets IL-1β. In some embodiments, the IL-1 inhibitor targets one or both of IL-1R1 and IL1RAP. For example, an IL-1 inhibitor can decrease the expression of IL-1α and/or decrease the ability of IL-1α to bind to its receptor (e.g., a complex of IL-1R1 and IL1RAP proteins). In another example, an IL-1 inhibitor can decrease the expression of IL-1B and/or decrease the ability of IL-1B to binds to its receptor (e.g., a complex of IL-1R1 and IL1RAP proteins). In some embodiments, an IL-1 inhibitor can decrease the expression of one or both of IL-1R1 and IL1RAP.

In some embodiments, the IL-1 inhibitor targets IL-18. In some embodiments, the IL-1 inhibitor targets IL-18Rα. In some embodiments, the IL-1 inhibitor decreases the ability of IL-18 to bind to its receptor (e.g., IL-18Rα). In some embodiments, the IL-1 inhibitor decreases the expression of IL-18. In some embodiments, the IL-1 inhibitor decreases the expression of IL-18Rα.

In some embodiments, the IL-1 inhibitor targets one or more (e.g., two or three) of IL-36a, IL-36β, and IL-36γ. In some embodiments, the IL-1 inhibitor targets one or both of IL-1RL2 and IL-1RAP. In some embodiments, the IL-1 inhibitor decreases the expression of one or more (e.g., two or three) of IL-36α, IL-36β, and IL-36γ. In some embodiments, the IL-1 inhibitor decreases the expression of one or both of IL-1RL2 and IL-1RAP proteins. In some embodiments, the IL-1 inhibitor decreases the ability of IL-36a to bind to its receptor (e.g., a complex including IL-1RL2 and IL-1RAP). In some examples, the IL-1 inhibitor decreases the ability of IL-36B to bind to its receptor (e.g., a complex including IL-1RL2 and IL-1RAP). In some examples, the IL-1 inhibitor decreases the ability of IL-36γ to bind to its receptor (e.g., a complex including IL-1RL2 and IL-1RAP).

In some embodiments, the IL-1 inhibitor targets IL-33. In some embodiments, the IL-1 inhibitor targets one or both of IL1RL1 and IL1RAP. In some embodiments, the IL-1 inhibitor decreases the expression of IL-33. In some embodiments, the IL-1 inhibitor decreases the expression of one or both of IL1RL1 and IL1RAP. In some embodiments, the IL-1 inhibitor decreases the ability of IL-33 to bind to its receptor (e.g., a complex of IL1RL1 and IL1RAP proteins).

In some embodiments, an IL-1 inhibitory agent is an inhibitory nucleic acid, an antibody or fragment thereof, or a fusion protein. In some embodiments, the inhibitory nucleic acid is an antisense nucleic acid, a ribozyme, or a small interfering RNA.

IL-1 Inhibitory Nucleic Acids

Inhibitory nucleic acids that can decrease the expression of IL-1α, IL-1β, IL-18, IL-36α, IL-36β, IL-36γ, IL-38, IL-33, IL-1R1, IL1RAP, IL-18Rα, IL-1RL2, or IL1RL1 mRNA expression in a mammalian cell include antisense nucleic acid molecules, i.e., nucleic acid molecules whose nucleotide sequence is complementary to all or part of an IL-1α, IL-1β, IL-18, IL-36α, IL-36β, IL-36γ, IL-38, IL-33, IL-1R1, IL1RAP, IL-18Rα, IL-1RL2, or IL1RL1 mRNA (e.g., complementary to all or a part of any one of SEQ ID NOs: 85-125).

Human IL-1α mRNA (SEQ ID NO: 85)

```
   1 agtaaccagg caacaccatt gaaggctcat atgtaaaaat ccatgccttc ctttctccca 61 atctccattc ccaaacttag ccactggctt ctggctgagg ccttacgcat acctcccggg 121 gcttgcacac accttcttct acagaagaca caccttgggc atatcctaca gaagaccagg 181 cttctctctg gtccttggta gagggctact ttactgtaac agggccaggg tggagagttc 241 tctcctgaag ctccatcccc tctataggaa atgtgttgac aatattcaga agagtaagag 301 gatcaagact tctttgtgct caaataccac tgttctcttc tctaccctgc cctaaccagg 361 agcttgtcac cccaaactct gaggtgattt atgccttaat caagcaaact tccctcttca 421 gaaaagatgg ctcattttcc ctcaaaagtt gccaggagct gccaagtatt ctgccaattc 481 accctggagc acaatcaaca aattcagcca gaacacaact acagctacta ttagaactat 541 tattattaat aaattcctct ccaaatctag ccccttgact tcggatttca cgatttctcc 601 cttcctccta gaaacttgat aagtttcccg cgcttccctt tttctaagac tacatgtttg 661 tcatcttata aagcaaaggg gtgaataaat gaaccaaatc aataacttct ggaatatctg 721 caaacaacaa taatatcagc tatgccatct ttcactattt tagccagtat cgagttgaat 781 gaacatagaa aaatacaaaa ctgaattctt ccctgtaaat tccccgtttt gacgacgcac 841 ttgtagccac gtagccacgc ctacttaaga caattacaaa aggcgaagaa gactgactca 901 ggcttaagct gccagccaga gagggagtca tttcattggc gtttgagtca gcaaagaagt 961 caagatggcc aaagttccag acatgtttga agacctgaag aactgttaca gtgaaaatga 1021 agaagacagt tcctccattg atcatctgtc tctgaatcag aaatccttct atcatgtaag 1081 ctatggccca ctccatgaag gctgcatgga tcaatctgtg tctctgagta tctctgaaac
```

-continued

```
1141 ctctaaaaca tccaagctta ccttcaagga gagcatggtg gtagtagcaa ccaacgggaa
1201 ggttctgaag aagagacggt tgagtttaag ccaatccatc actgatgatg acctggaggc
1261 catcgccaat gactcagagg aagaaatcat caagcctagg tcagcacctt ttagcttcct
1321 gagcaatgtg aaatacaact ttatgaggat catcaaatac gaattcatcc tgaatgacgc
1381 cctcaatcaa agtataattc gagccaatga tcagtacctc acggctgctg cattacataa
1441 tctggatgaa gcagtgaaat ttgacatggg tgcttataag tcatcaaagg atgatgctaa
1501 aattaccgtg attctaagaa tctcaaaaac tcaattgtat gtgactgccc aagatgaaga
1561 ccaaccagtg ctgctgaagg agatgcctga gatacccaaa accatcacag gtagtgagac
1621 caacctcctc ttcttctggg aaactcacgg cactaagaac tatttcacat cagttgccca
1681 tccaaacttg tttattgcca caaagcaaga ctactgggtg tgcttggcag gggggccacc
1741 ctctatcact gactttcaga tactggaaaa ccaggcgtag gtctggagtc tcacttgtct
1801 cacttgtgca gtgttgacag ttcatatgta ccatgtacat gaagaagcta aatcctttac
1861 tgttagtcat ttgctgagca tgtactgagc cttgtaattc taaatgaatg tttacactct
1921 ttgtaagagt ggaaccaaca ctaacatata atgttgttat ttaaagaaca ccctatattt
1981 tgcatagtac caatcatttt aattattatt cttcataaca attttaggag gaccagagct
2041 actgactatg gctaccaaaa agactctacc catattacag atgggcaaat taaggcataa
2101 gaaaactaag aaatatgcac aatagcagtt gaaacaagaa gccacagacc taggatttca
2161 tgatttcatt tcaactgttt gccttctact tttaagttgc tgatgaactc ttaatcaaat
2221 agcataagtt tctgggacct cagtttatc attttcaaaa tggagggaat aatacctaag
2281 ccttcctgcc gcaacagttt tttatgctaa tcagggaggt catttggta aaatacttct
2341 tgaagccgag cctcaagatg aaggcaaagc acgaaatgtt attttttaat tattatttat
2401 atatgtattt ataaatatat ttaagataat tataatatac tatatttatg ggaaccccctt
2461 catcctctga gtgtgaccag gcatcctcca caatagcaga cagtgttttc tgggataagt
2521 aagtttgatt tcattaatac agggcatttt ggtccaagtt gtgcttatcc catagccagg
2581 aaactctgca ttctagtact tgggagacct gtaatcatat aataaatgta cattaattac
2641 cttgagccag taattggtcc gatctttgac tcttttgcca ttaaacttac ctgggcattc
2701 ttgtttcaat tccacctgca atcaagtcct acaagctaaa attagatgaa ctcaactttg
2761 acaaccatga gaccactgtt atcaaaactt tcttttctgg aatgtaatca atgtttcttc
2821 taggttctaa aaattgtgat cagaccataa tgttacatta ttatcaacaa tagtgattga
2881 tagagtgtta tcagtcataa ctaaataaag cttgcaacaa aattctctga caaaaaaaaa
2941 aaaaaaa
```

Human IL-1β mRNA (SEQ ID NO: 86)
```
  1 accaaacctc ttcgaggcac aaggcacaac aggctgctct gggattctct tcagccaatc
 61 ttcattgctc aagtgtctga agcagccatg gcagaagtac ctgagctcgc cagtgaaatg
121 atggcttatt acagtggcaa tgaggatgac ttgttctttg aagctgatgg ccctaaacag
181 atgaagtgct ccttccagga cctggacctc tgccctctgg atggcggcat ccagctacga
241 atctccgacc accactacag caagggcttc aggcaggccg cgtcagttgt tgtggccatg
301 gacaagctga ggaagatgct ggttccctgc ccacagacct ccaggagaa tgacctgagc
361 accttctttc ccttcatctt tgaagaagaa cctatcttct tcgacacatg ggataacgag
421 gcttatgtgc acgatgcacc tgtacgatca ctgaactgca cgctccggga ctcacagcaa
```

-continued

```
 481 aaaagcttgg tgatgtctgg tccatatgaa ctgaaagctc tccacctcca gggacaggat
 541 atggagcaac aagtggtgtt ctccatgtcc tttgtacaag gagaagaaag taatgacaaa
 601 atacctgtgg ccttgggcct caaggaaaag aatctgtacc tgtcctgcgt gttgaaagat
 661 gataagccca ctctacagct ggagagtgta gatcccaaaa attacccaaa gaagaagatg
 721 gaaaagcgat tgtcttcaa caagatagaa atcaataaca agctggaatt tgagtctgcc
 781 cagttcccca actggtacat cagcacctct caagcagaaa acatgcccgt cttcctggga
 841 gggaccaaag gcggccagga tataactgac ttcaccatgc aatttgtgtc ttcctaaaga
 901 gagctgtacc cagagagtcc tgtgctgaat gtggactcaa tccctagggc tggcagaaag
 961 ggaacagaaa ggttttgag tacggctata gcctggactt tcctgttgtc tacaccaatg
1021 cccaactgcc tgccttaggg tagtgctaag aggatctcct gtccatcagc caggacagtc
1081 agctctctcc tttcagggcc aatccccagc ccttttgttg agccaggcct ctctcacctc
1141 tcctactcac ttaaagcccg cctgacagaa accacggcca catttggttc taagaaaccc
1201 tctgtcattc gctcccacat tctgatgagc aaccgcttcc ctatttattt atttatttgt
1261 ttgtttgttt tattcattgg tctaatttat tcaaggggg caagaagtag cagtgtctgt
1321 aaaagagcct agttttaat agctatggaa tcaattcaat ttggactggt gtgctctctt
1381 taaatcaagt cctttaatta agactgaaaa tatataagct cagattattt aaatgggaat
1441 atttataaat gagcaaatat catactgttc aatggttctg aaataaactt cactgaag
```

Human IL-18 mRNA Variant 1

(SEQ ID NO: 87)

```
   1 attctctccc cagcttgctg agcccttgc tccctggcg actgcctgga cagtcagcaa
  61 ggaattgtct cccagtgcat tttgccctcc tggctgccaa ctctggctgc taaagcggct
 121 gccacctgct gcagtctaca cagcttcggg aagaggaaag gaacctcaga ccttccagat
 181 cgcttcctct cgcaacaaac tatttgtcgc aggaataaag atggctgctg aaccagtaga
 241 agacaattgc atcaactttg tggcaatgaa atttattgac aatacgcttt actttatagc
 301 tgaagatgat gaaaacctgg aatcagatta ctttggcaag cttgaatcta aattatcagt
 361 cataagaaat ttgaatgacc aagttctctt cattgaccaa ggaaatcggc ctctatttga
 421 agatatgact gattctgact gtagagataa tgcacccggg accatattta ttataagtat
 481 gtataaagat agccagccta gaggtatggc tgtaactatc tctgtgaagt gtgagaaat
 541 ttcaactctc tcctgtgaga acaaaattat ttcctttaag gaaatgaatc ctcctgataa
 601 catcaaggat acaaaaagtg acatcatatt ctttcagaga gtgtcccag acatgataa
 661 taagatgcaa tttgaatctt catcatacga aggatacttt ctagcttgtg aaaaagagag
 721 agacctttt aaactcattt tgaaaaaga ggatgaattg ggggatagat ctataatgtt
 781 cactgttcaa aacgaagact agctattaaa atttcatgcc gggcgcagtg gctcacgcct
 841 gtaatcccag ccctttggga ggctgaggcg ggcagatcac cagaggtcag gtgttcaaga
 901 ccagcctgac caacatggtg aaacctcatc tctactaaaa atacaaaaaa ttagctgagt
 961 gtagtgacgc atgccctcaa tcccagctac tcaagaggct gaggcaggag aatcacttgc
1021 actccggagg tagaggttgt ggtgagccga gattgcacca ttgcgctcta gcctgggcaa
1081 caacagcaaa actccatctc aaaaaataaa ataaataaat aaacaaataa aaaattcata
1141 atgtgaaaaa aaaaaaaaaa aaa
```

Human IL-18 mRNA Variant 2

(SEQ ID NO: 88)

```
   1 attctctccc cagcttgctg agcccttgc tccctggcg actgcctgga cagtcagcaa
  61 ggaattgtct cccagtgcat tttgccctcc tggctgccaa ctctggctgc taaagcggct
```

-continued

```
 121 gccacctgct gcagtctaca cagcttcggg aagaggaaag gaacctcaga ccttccagat
 181 cgcttcctct cgcaacaaac tatttgtcgc aggaataaag atggctgctg aaccagtaga
 241 agacaattgc atcaactttg tggcaatgaa atttattgac aatacgcttt actttataga
 301 aaacctggaa tcagattact ttggcaagct tgaatctaaa ttatcagtca taagaaattt
 361 gaatgaccaa gttctcttca ttgaccaagg aaatcggcct ctatttgaag atatgactga
 421 ttctgactgt agagataatg cacccccggac catatttatt ataagtatgt ataaagatag
 481 ccagcctaga ggtatggctg taactatctc tgtgaagtgt gagaaaattt caactctctc
 541 ctgtgagaac aaaattattt cctttaagga aatgaatcct cctgataaca tcaaggatac
 601 aaaaagtgac atcatattct ttcagagaag tgtcccagga catgataata agatgcaatt
 661 tgaatcttca tcatacgaag gatactttct agcttgtgaa aaagagagag acctttttaa
 721 actcattttg aaaaagagg atgaattggg ggatagatct ataatgttca ctgttcaaaa
 781 cgaagactag ctattaaaat ttcatgccgg gcgcagtggc tcacgcctgt aatcccagcc
 841 ctttgggagg ctgaggcggg cagatcacca gaggtcaggt gttcaagacc agcctgacca
 901 acatggtgaa acctcatctc tactaaaaat acaaaaaatt agctgagtgt agtgacgcat
 961 gccctcaatc ccagctactc aagaggctga ggcaggagaa tcacttgcac tccggaggta
1021 gaggttgtgg tgagccgaga ttgcaccatt gcgctctagc ctgggcaaca acagcaaaac
1081 tccatctcaa aaataaaat aaataaataa acaaataaaa aattcataat gtgaaaaaaa
1141 aaaaaaaaaa a
```

Human IL-36α mRNA (SEQ ID NO: 89)

```
  1 aaaacccaag tgcagtagaa gccattgttc ataatggtag ggatacaggg tccttcgtaa
 61 cagattatca gtgtggccta tgctggaaag tctggtgacc tctgattttt tttgcttcca
121 ggtctttggc cttggcactc tttgtcatat tagagttcct gggtctaggc ctgggcagga
181 ttcataggtg cagctgcttc tgctggaggt agactgcatc caacaaagta agggtgctgg
241 gtgagttctg ggagtataga ttctgactgg ggtcactgct gggctggccg ccagtctttc
301 atctgaccca gggttaaact gtggcttggg actgactcag gtcctctctt ggggtcggtc
361 tgcacataaa aggactccta tccttggcag ttctgaaaca acaccaccac aatggaaaaa
421 gcattgaaaa ttgacacacc tcagcagggg agcattcagg atatcaatca tcgggtgtgg
481 gttcttcagg accagacgct catagcagtc ccgaggaagg accgtatgtc tccagtcact
541 attgccttaa tctcatgccg acatgtggag acccttgaga aagacagagg gaacccatc
601 tacctgggcc tgaatggact caatctctgc ctgatgtgtg ctaaagtcgg ggaccagccc
661 acactgcagc tgaaggaaaa ggatataatg gatttgtaca accaacccga gcctgtgaag
721 tcctttctct ctctaccacag ccagagtggc aggaactcca ccttcgagtc tgtggctttc
781 cctggctggt tcatcgctgt cagctctgaa ggaggctgtc ctctcatcct tacccaagaa
841 ctggggaaag ccaacactac tgactttggg ttaactatgc tgttttaa
```

Human IL-36β mRNA Variant 1

(SEQ ID NO: 90)

```
  1 cacgggttcc tccccactct gtctttctca cctctccttc acttttccta gcctcctcac
 61 caccatctga tctatcttgt tctcttcaca aaaggctctg aagacatcat gaacccacaa
121 cgggaggcag cacccaaatc ctatgctatt cgtgattctc gacagatggt gtgggtcctg
181 agtggaaatt ctttaatagc agctcctctt agccgcagca ttaagcctgt cactcttcat
241 ttaatagcct gtagagacac agaattcagt gacaaggaaa agggtaatat ggtttacctg
```

```
 301 ggaatcaagg gaaaagatct ctgtctcttc tgtgcagaaa ttcagggcaa gcctactttg 361 cagcttaagc ttcagggctc ccaagataac atagggaagg acacttgctg gaaactagtt 421 ggaattcaca catgcataaa cctggatgtg agagagagct gcttcatggg aacccttgac 481 caatggggaa taggagtggg tagaaagaag tggaagagtt cctttcaaca tcaccatctc 541 aggaagaagg acaaagattt ctcatccatg cggaccaaca taggaatgcc aggaaggatg 601 tagaaataag gggaggaaga ttcccatctc tacaatcttt gagtgggttt gctatcaatg 661 aaatgctaca aatggaataa gttgcagaaa tttttctctt ttcttgggtt ctggagagtt 721 tgtaaaacaa ggacactatg tattttaaa gagttggtaa atcttacctg taaagctaga 781 gaaggtcgga gtcttttag gagtagattt ggactacata acctgtaaat gtgttttgtc 841 cagtccttag agtgtttttt aaaaaattgt aaagtcaagg ttttcatgaa aaatgggaag 901 atcagacaac attgctcctg aattcccaca gagcagcaag ctactagagc tcaatctgtt 961 atttcttttc ctgatgtaca ggggttaagt cctatggaag aaacagcaga attattcaaa 1021 attatttaca taatgtgcaa ttattcacta gagcatgagg agtgaaacgc tctgtttagt 1081 atgtataact taaaaggaac acatacaatt aaaagtaatt gaaagacatt tcttcttaaa 1141 aattctataa tcttacactg gtaaaataaa ctagttttc ccatgt
```

Human IL-36β mRNA Variant 2

(SEQ ID NO: 91)

```
   1 cacggggtcc tccccactct gtctttctca cctctccttc acttttccta gcctcctcac 61 caccatctga tctatcttgt tctcttcaca aaaggctctg aagacatcat gaacccacaa 121 cgggaggcag cacccaaatc ctatgctatt cgtgattctc gacagatggt gtgggtcctg 181 agtggaaatt ctttaatagc agctcctctt agccgcagca ttaagcctgt cactcttcat 241 ttaatagcct gtagagacac agaattcagt gacaaggaaa agggtaatat ggtttacctg 301 ggaatcaagg gaaaagatct ctgtctcttc tgtgcagaaa ttcagggcaa gcctactttg 361 cagcttaagg aaaaaaatat catggacctg tatgtggaga agaaagcaca gaagcccttt 421 ctcttttttcc acaataaaga aggctccact tctgtctttc agtcagtctc ttaccctggc 481 tggttcatag ccacctccac cacatcagga cagcccatct ttctcaccaa ggagagaggc 541 ataactaata cactaactt ctacttagat tctgtggaat aaatccagcc taggctgtgg 601 gtggctggtt ccaggataga gaatcaagct gtcagagtca tcttaacaga tcattatgcg 661 actgagttca ctagcagttc agcccatcca tagcttacct cattcttact atccaaaagc 721 cacctcctcc tccaaacatc catttctgta ccaagaccct cactcgaatg tcactatccc 781 aagatgaaac ctaaaaatca ctttccattc tttcttgatc ttaccccacc atccactcag 841 ctgccatgcc cagtttagtc aaccccccaa atgctgcttc atgcaacctc ccattcctat 901 tccttttgcc aacccatgat gtagagatgt ggattcatga cattttgttc atacaacttc 961 ttcaataaaa cattataata tgtgccccaa agataaagct gaagaatgag atgaatgtga 1021 aattaaaggt ttgcatgtct ttctaatcct aaaaaaaaaa aaaaaaa
```

Human IL-36γ mRNA Variant 1

(SEQ ID NO: 92)

```
   1 gaagctgctg gagccacgat tcagtcccct ggactgtaga taaagacccct ttcttgccag 61 gtgctgagac aaccacacta tgagaggcac tccaggagac gctgatggtg gaggaagggc 121 cgtctatcaa tcaatgtgta aacctattac tgggactatt aatgattgaa tcagcaagt 181 gtggacccctt cagggtcaga accttgtggc agttccacga agtgacagtg tgaccccagt 241 cactgttgct gttatcacat gcaagtatcc agaggctctt gagcaaggca gagggggatcc 301 catttatttg ggaatccaga atccagaaat gtgtttgtat tgtgagaagg ttggagaaca
```

-continued

```
 361 gcccacattg cagctaaaag agcagaagat catggatctg tatggccaac ccgagcccgt
 421 gaaacccttc cttttctacc gtgccaagac tggtaggacc tccacccttg agtctgtggc
 481 cttcccggac tggttcattg cctcctccaa gagagaccag cccatcattc tgacttcaga
 541 acttgggaag tcatacaaca ctgcctttga attaaatata aatgactgaa ctcagcctag
 601 aggtggcagc ttggtctttg tcttaaagtt tctggttccc aatgtgtttt cgtctacatt
 661 ttcttagtgt cattttcacg ctggtgctga cagggggca aggctgctgt tatcatctca
 721 ttttataatg aagaagaagc aattacttca tagcaactga gaacaggat gtggcctcag
 781 aagcaggaga gctgggtggt ataaggctgt cctctcaagc tggtgctgtg taggccacaa
 841 ggcatctgca tgagtgactt taagactcaa agaccaaaca ctgagctttc ttctaggggt
 901 gggtatgaag atgcttcaga gctcatgcgc gttacccacg atggcatgac tagcacagag
 961 ctgatctctg tttctgtttt gctttattcc ctcttgggat gatatcatcc agtctttata
1021 tgttgccaat atacctcatt gtgtgtaata aaccttctt agcattaaga ccttgtaaac
1081 aaaaataatt cttgtgttaa gttaaatcat ttttgtccta attgtaatgt gtaatcttaa
1141 agttaaataa actttgtgta tttatataat aataaagcta aaactgatat aaaataaaga
1201 aagagtaaac tg
```

Human IL-36γ mRNA Variant 2

(SEQ ID NO: 93)

```
   1 gaagctgctg gagccacgat tcagtcccct ggactgtaga taaagaccct ttcttgccag
  61 gtgctgagac aaccacacta tgagaggcac tccaggagac gctgatggtg gaggaagggc
 121 cgtctatcaa tcaatcactg ttgctgttat cacatgcaag tatccagagg ctcttgagca
 181 aggcagaggg gatcccattt atttgggaat ccagaatcca gaaatgtgtt tgtattgtga
 241 gaaggttgga gaacagccca cattgcagct aaaagagcag aagatcatgg atctgtatgg
 301 ccaacccgag cccgtgaaac ccttcctttt ctaccgtgcc aagactggta ggacctccac
 361 ccttgagtct gtggccttcc cggactggtt cattgcctcc tccaagagag accagcccat
 421 cattctgact tcagaacttg gaagtcata caacactgcc tttgaattaa atataaatga
 481 ctgaactcag cctagaggtg gcagcttggt ctttgtctta aagtttctgg ttcccaatgt
 541 gttttcgtct acattttctt agtgtcattt tcacgctggt gctgagacag gggcaaggct
 601 gctgttatca tctcatttta taatgaagaa gaagcaatta cttcatagca actgaagaac
 661 aggatgtggc ctcagaagca ggagagctgg gtggtataag gctgtcctct caagctggtg
 721 ctgtgtaggc cacaaggcat ctgcatgagt gactttaaga ctcaaagacc aaacactgag
 781 ctttcttcta ggggtgggta tgaagatgct tcagagctca tgcgcgttac ccacgatggc
 841 atgactagca cagagctgat ctctgtttct gttttgcttt attccctctt gggatgatat
 901 catccagtct ttatatgttg ccaatatacc tcattgtgtg taatagaacc ttcttagcat
 961 taagaccttg taaacaaaaa taattcttgt gttaagttaa atcattttg tcctaattgt
1021 aatgtgtaat cttaaagtta aataaacttt gtgtatttat ataataataa agctaaaact
1081 gatataaaat aaagaaagag taaactg
```

Human IL-38 mRNA Variant 1

(SEQ ID NO: 94)

```
   1 ggcagtggga ctgggtttga gctgggctta tcctccaact gtgagggagg ctacagcaca
  61 ctccacccca ctctcagggc tgggaattgt tgtggctcag ctatttgggg gaatctgttt
 121 tccagtttct cagaaccagc gcaagcacac acatcccagg ctcacacccc tggtggctgg
 181 acttgctccc ggatagcctc agtcagggag aggcagagct gcctggagcc tgctgggctg
```

-continued

```
 241 gtggaagcct tggtggattc tggcaggcca attatagacg aatggcctgg ggaacccgtg 301 cagcccttgg ctgagtggtt ctaagcccca gcacgtctgc ctctggcttc acccagcctc 361 cttttctaac tgcccttctc tcctccccat cagtgaggac cagacaccac tgattgcagg 421 aatgtgttcc ctccccatgg caagatacta cataattaaa tatgcagacc agaaggctct 481 atacacaaga gatggccagc tgctggtggg agatcctgtt gcagacaact gctgtgcaga 541 gaagatctgc atacttccta acagaggctt ggcccgcacc aaggtcccca ttttcctggg 601 gatccaggga gggagccgct gcctggcatg tgtggagaca aagaggggc cttccctaca 661 gctggaggat gtgaacattg aggaactgta caaaggtggt gaagaggcca cacgcttcac 721 cttcttccag agcagctcag gctccgcctt caggcttgag gctgctgcct ggcctggctg 781 gttcctgtgt ggcccggcag agccccagca gccagtacag ctcaccaagg agagtgagcc 841 ctcagcccgt accaagtttt actttgaaca gagctggtag ggagacagga aactgcgttt 901 tagccttgtg cccccaaacc aagctcatcc tgctcagggt ctatggtagg cagaataatg 961 tcccccgaaa tatgtccaca tcctaatccc aagatctgtg catatgttac catacatgtc 1021 caaagaggtt ttgcaaatgt gattatgtta aggatcttga atgaggaga caatcctggg 1081 ttatccttgt gggctcagtt taatcacaag aaggaggcag aagggagag tcagagagag 1141 aatggaagat accatgcttc taattttgaa gatggagtga ggggccttga gccaacaaat 1201 gcaggtgttt ttagaaggtg aaaagccaa gggaacggat tctcctctag agtctccgga 1261 aggaacacag ctcttgacac atggatttca gctcagtgac acccatttca gacttctgac 1321 ctccacaact ataaaataat aaacttgtgt tattgtaaac ctctaa
```

Human IL-38 mRNA Variant 2
(SEQ ID NO: 95)

```
   1 agttggagtc tccagggatc agggttccag gaactcagga tctgcagtga ggaccagaca 61 ccactgattg caggaatgtg ttccctcccc atggcaagat actacataat taaatatgca 121 gaccagaagg ctctatacac aagagatggc cagctgctgg tgggagatcc tgttgcagac 181 aactgctgtg cagagaagat ctgcatactt cctaacagag gcttggcccg caccaaggtc 241 cccattttcc tggggatcca gggaggagc cgctgcctgg catgtgtgga gacagaagag 301 gggccttccc tacagctgga ggatgtgaac attgaggaac tgtacaaagg tggtgaagag 361 gccacacgct tcaccttctt ccagagcagc tcaggctccg ccttcaggct tgaggctgct 421 gcctggcctg gctggttcct gtgtggcccg gcagagcccc agcagccagt acagctcacc 481 aaggagagtg agccctcagc ccgtaccaag ttttactttg aacagagctg gtagggagac 541 aggaaactgc gttttagcct tgtgccccca aaccaagctc atcctgctca gggtctatgg 601 taggcagaat aatgtccccc gaaatatgtc acatcctaa tcccaagatc tgtgcatatg 661 ttaccataca tgtccaaaga ggttttgcaa atgtgattat gttaaggatc ttgaaatgag 721 gagacaatcc tgggttatcc ttgtgggctc agtttaatca agaaggag gcaggaaggg 781 agagtcagag agagaatgga agataccatg cttctaattt tgaagatgga gtgaggggcc 841 ttgagccaac aaatgcaggt gttttttagaa ggtggaaaag ccaagggaac ggattctcct 901 ctagagtctc cggaaggaac acagctcttg acacatggat ttcagctcag tgacacccat 961 ttcagacttc tgacctccac aactataaaa taataaactt gtgttattgt aaacctctaa 1021 aaaaaaa
```

Human IL-33 mRNA Variant 1
(SEQ ID NO: 96)

```
   1 agtctacaga ctcctccgaa cacagagctg cagctcttca gggaagaaat caaaacaaga 61 tcacaagaat actgaaaaat gaagcctaaa atgaagtatt caaccaacaa aatttccaca
```

-continued

```
 121 gcaaagtgga agaacacagc aagcaaagcc ttgtgtttca agctgggaaa atcccaacag
 181 aaggccaaag aagtttgccc catgtacttt atgaagctcc gctctggcct tatgataaaa
 241 aaggaggcct gttactttag gagagaaacc accaaaaggc cttcactgaa aacaggtaga
 301 aagcacaaaa gacatctggt actcgctgcc tgtcaacagc agtctactgt ggagtgcttt
 361 gcctttggta tatcagggggt ccagaaatat actagagcac ttcatgattc aagtatcaca
 421 ggaatttcac ctattacaga gtatcttgct tctctaagca catacaatga tcaatccatt
 481 acttttgctt tggaggatga agttatgag atatatgttg aagacttgaa aaaagatgaa
 541 aagaaagata aggtgttact gagttactat gagtctcaac accoctcaaa tgaatcaggt
 601 gacggtgttg atggtaagat gttaatggta accctgagtc ctacaaaaga cttctggttg
 661 catgccaaca acaaggaaca ctctgtggag ctccataagt gtgaaaaacc actgccagac
 721 caggccttct ttgtccttca taatatgcac tccaactgtg tttcatttga atgcaagact
 781 gatcctggag tgtttatagg tgtaaaggat aatcatcttg ctctgattaa agtagactct
 841 tctgagaatt tgtgtactga aaatatcttg tttaagctct ctgaaactta gttgatggaa
 901 acctgtgagt cttgggttga gtacccaaat gctaccactg gagaaggaat gagagataaa
 961 gaaagagaca ggtgacatct aagggaaatg aagagtgctt agcatgtgtg gaatgttttc
1021 catattatgt ataaaaatat tttttctaat cctccagtta ttcttttatt tccctctgta
1081 taactgcatc ttcaatacaa gtatcagtat attaaatagg gtattggtaa agaaacggtc
1141 aacattctaa agagatacag tctgaccttt acttttctct agtttcagtc cagaaagaac
1201 ttcatattta gagctaaggc cactgaggaa agagccatag cttaagtctc tatgtagaca
1261 gggatccatt ttaaagagct acttagagaa ataattttcc acagttccaa acgataggct
1321 caaacactag agctgctagt aaaaagaaga ccagatgctt cacagaatta tcattttttc
1381 aactggaata aaacaccagg tttgtttgta gatgtcttag gcaacactca gagcagatct
1441 cccttactgt caggggatat ggaacttcaa aggcccacat ggcaagccag gtaacataaa
1501 tgtgtgaaaa agtaaagata actaaaaaat ttagaaaaat aaatccagta tttgtaaagt
1561 gaataacttc atttctaatt gtttaatttt taaaattctg attttatat attgagttta
1621 agcaaggcat tcttacacga ggaagtgaag taaattttag ttcagacata aaatttcact
1681 tattaggaat atgtaacatg ctaaaacttt tttttttta aagagtactg agtcacaaca
1741 tgttttagag catccaagta ccatataatc caactatcat ggtaaggcca gaaatcttct
1801 aacctaccag agcctagatg agacaccgaa ttaacattaa aatttcagta actgactgtc
1861 cctcatgtcc atggcctacc atcccttctg accctggctt ccagggacct atgtctttta
1921 atactcactg tcacattggg caaagttgct tctaatcctt atttcccatg tgcacaagtc
1981 ttttttgtatt ccagcttcct gataacactg cttactgtgg aatattcatt tgacatctgt
2041 ctcttttcat ttcttttaac taccatgccc ttgatatatc ttttgcacct gctgaacttc
2101 atttctgtat cacctgacct ctggatgcca aaacgtttat tctgctttgt ctgttgtaga
2161 attttagata aagctattaa tggcaatatt ttttttgctaa acgtttttgt tttttactgt
2221 cactagggca ataaaattta tactcaacca tataataaca tttttttaact actaaaggag
2281 tagtttttat tttaaagtct tagcaatttc tattacaact tttcttagac ttaacactta
2341 tgataaatga ctaacatagt aacagaatct ttatgaaata tgacctttc tgaaaataca
2401 tacttttaca tttctacttt attgagacct attagatgta agtgctagta gaatataaga
2461 taaagaggc tgagaattac catacaaggg tattacaact gtaaaacaat ttatctttgt
```

-continued

```
2521 ttcattgttc tgtcaataat tgttaccaaa gagataaaaa taaaagcaga atgtatatca 2581 tcccatctga aaaacactaa ttattgacat gtgcatctgt acaataaact taaaatgatt 2641 attaaataat caaatatatc tactacattg tttatattat tgaataaagt atattttcca 2701 aatgtaaaaa aaaaaaaa
```

Human IL-33 mRNA Variant 2

(SEQ ID NO: 97)

```
   1 agtctacaga ctcctccgaa cacagagctg cagctcttca gggaagaaat caaaacaaga 61 tcacaagaat actgaaaaat gaagcctaaa atgaagtatt caaccaacaa aatttccaca 121 gcaaagtgga agaacacagc aagcaaagcc ttgtgtttca agctgggaaa atcccaacag 181 aaggccaaag aagtttgccc catgtacttt atgaagctcc gctctggcct tatgataaaa 241 aaggaggcct gttactttag gagagaaacc accaaaaggc cttcactgaa acaggtagaa 301 aagcacaaaa gacatctggt actcgctgcc tgtcaacagc agtctactgt ggagtgcttt 361 gcctttggta tatcaggggt ccagaaatat actagagcac ttcatgattc aagtatcaca 421 gataaggtgt tactgagtta ctatgagtct caacacccct caaatgaatc aggtgacggt 481 gttgatggta agatgttaat ggtaaccctg agtcctacaa aagacttctg gttgcatgcc 541 aacaacaagg aacactctgt ggagctccat aagtgtgaaa accactgcca gaccaggcc 601 ttctttgtcc ttcataatat gcactccaac tgtgtttcat ttgaatgcaa gactgatcct 661 ggagtgttta taggtgtaaa ggataatcat cttgctctga ttaaagtaga ctcttctgag 721 aatttgtgta ctgaaaatat cttgtttaag ctctctgaaa cttagttgat ggaaacctgt 781 gagtcttggg ttgagtaccc aaatgctacc actggagaag gaatgagaga taaagaaaga 841 gacaggtgac atctaaggga aatgaagagt gcttagcatg tgtggaatgt tttccatatt 901 atgtataaaa atatttttc taatcctcca gttattcttt tatttccctc tgtataactg 961 catcttcaat acaagtatca gtatattaaa tagggtattg gtaaagaaac ggtcaacatt 1021 ctaaagagat acagtctgac ctttactttt ctctagtttc agtccagaaa gaacttcata 1081 tttagagcta aggccactga ggaaagagcc atagcttaag tctctatgta gacagggatc 1141 cattttaaag agctacttag agaaataatt ttccacagtt ccaaacgata ggctcaaaca 1201 ctagagctgc tagtaaaaag aagaccagat gcttcacaga attatcattt tttcaactgg 1261 aataaaacac caggtttgtt tgtagatgtc ttaggcaaca ctcagagcag atctccctta 1321 ctgtcagggg atatggaact tcaaaggccc acatggcaag ccaggtaaca taaatgtgtg 1381 aaaaagtaaa gataactaaa aaatttagaa aaataaatcc agtatttgta aagtgaataa 1441 cttcatttct aattgtttaa ttttttaaaat tctgattttt atatattgag tttaagcaag 1501 gcattcttac acgaggaagt gaagtaaatt ttagttcaga cataaaattt cacttattag 1561 gaatatgtaa catgctaaaa cttttttttt tttaaagagt actgagtcac aacatgtttt 1621 agagcatcca agtaccatat aatccaacta tcatggtaag gccagaaatc ttctaaccta 1681 ccagagccta gatgagacac cgaattaaca ttaaaatttc agtaactgac tgtccctcat 1741 gtccatggcc taccatccct tctgaccctg gcttccaggg acctatgtct tttaatactc 1801 actgtcacat tgggcaaagt tgcttctaat ccttatttcc catgtgcaca agtcttttg 1861 tattccagct tcctgataac actgcttact gtggaatatt catttgacat ctgtctcttt 1921 tcatttcttt taactaccat gcccttgata tatcttttgc acctgctgaa cttcatttct 1981 gtatcacctg acctctggat gccaaaacgt ttattctgct tgtctgttg tagaaattta 2041 gataaagcta ttaatggcaa tattttttg ctaaacgttt ttgttttta ctgtcactag 2101 ggcaataaaa tttatactca accatataat aacattttt aactactaaa ggagtagttt
```

-continued

```
2161 ttattttaaa gtcttagcaa tttctattac aacttttctt agacttaaca cttatgataa
2221 atgactaaca tagtaacaga atctttatga aatatgacct tttctgaaaa tacatacttt
2281 tacatttcta ctttattgag acctattaga tgtaagtgct agtagaatat aagataaaag
2341 aggctgagaa ttaccataca agggtattac aactgtaaaa caatttatct ttgtttcatt
2401 gttctgtcaa taattgttac caaagagata aaaataaaag cagaatgtat atcatcccat
2461 ctgaaaaaca ctaattattg acatgtgcat ctgtacaata aacttaaaat gattattaaa
2521 taatcaaata tatctactac attgtttata ttattgaata agtatatttt tccaaatgta
2581 aaaaaaaaaa aa
```

Human IL-33 mRNA Variant 3

(SEQ ID NO: 98)
```
   1 agtctacaga ctcctccgaa cacagagctg cagctcttca gggaagaaat caaaacaaga
  61 tcacaagaat actgaaaaat gaagcctaaa atgaagtatt caaccaacaa aatttccaca
 121 gcaaagtgga agaacacagc aagcaaagcc ttgtgtttca agctgggaaa taaggtgtta
 181 ctgagttact atgagtctca acacccctca aatgaatcag gtgacggtgt tgatggtaag
 241 atgttaatgg taaccctgag tcctacaaaa gacttctggt tgcatgccaa caacaaggaa
 301 cactctgtgg agctccataa gtgtgaaaaa ccactgccag accaggcctt ctttgtcctt
 361 cataatatgc actccaactg tgtttcattt gaatgcaaga ctgatcctgg agtgtttata
 421 ggtgtaaagg ataatcatct tgctctgatt aaagtagact cttctgagaa tttgtgtact
 481 gaaaatatct tgtttaagct ctctgaaact tagttgatgg aaacctgtga gtcttgggtt
 541 gagtacccaa atgctaccac tggagaagga atgagagata agaaagaga caggtgacat
 601 ctaagggaaa tgaagagtgc ttagcatgtg tggaatgttt tccatattat gtataaaaat
 661 attttttcta atcctccagt tattctttta tttccctctg tataactgca tcttcaatac
 721 aagtatcagt atattaaata gggtattggt aaagaaacgg tcaacattct aaagagatac
 781 agtctgacct ttacttttct ctagtttcag tccagaaaga acttcatatt tagagctaag
 841 gccactgagg aaagagccat agcttaagtc tctatgtaga cagggatcca ttttaaagag
 901 ctacttagag aaataatttt ccacagttcc aaacgatagg ctcaaacact agagctgcta
 961 gtaaaagaa gaccagatgc ttcacagaat tatcattttt tcaactggaa taaaacacca
1021 ggtttgtttg tagatgtctt aggcaacact cagagcagat ctcccttact gtcaggggat
1081 atggaacttc aaaggcccac atggcaagcc aggtaacata aatgtgtgaa aaagtaaaga
1141 taactaaaaa atttagaaaa ataaatccag tatttgtaaa gtgaataact tcatttctaa
1201 ttgtttaatt tttaaaattc tgatttttat atattgagtt taagcaaggc attcttacac
1261 gaggaagtga agtaaatttt agttcagaca taaaatttca cttattagga atatgtaaca
1321 tgctaaaact ttttttttt taaagagtac tgagtcacaa catgttttag agcatccaag
1381 taccatataa tccaactatc atggtaaggc cagaaatctt ctaacctacc agagcctaga
1441 tgagacaccg aattaacatt aaaatttcag taactgactg tccctcatgt ccatggccta
1501 ccatcccttc tgaccctggc ttcagggac ctatgtcttt taatactcac tgtcacattg
1561 ggcaaagttg cttctaatcc ttatttccca tgtgcacaag tcttttttgta ttccagcttc
1621 ctgataacac tgcttactgt ggaatattca tttgacatct gtctcttttc atttctttta
1681 actaccatgc ccttgatata tcttttgcac ctgctgaact tcattctgt atcacctgac
1741 ctctggatgc caaaacgttt attctgcttt gtctgttgta gaatttttaga taaagctatt
1801 aatggcaata tttttttgct aaacgttttt gttttttact gtcactaggg caataaaatt
```

-continued

```
1861 tatactcaac catataataa cattttttaa ctactaaagg agtagttttt attttaaagt
1921 cttagcaatt tctattacaa cttttcttag acttaacact tatgataaat gactaacata
1981 gtaacagaat ctttatgaaa tatgaccttt tctgaaaata catacttttta catttctact
2041 ttattgagac ctattagatg taagtgctag tagaatataa gataaaagag gctgagaatt
2101 accatacaag ggtattacaa ctgtaaaaca atttatcttt gtttcattgt tctgtcaata
2161 attgttacca aagagataaa aataaaagca gaatgtatat catcccatct gaaaaacact
2221 aattattgac atgtgcatct gtacaataaa cttaaaatga ttattaaata atcaaatata
2281 tctactacat tgtttatatt attgaataaa gtatattttc caaatgtaaa aaaaaaaaaa
```

Human IL-33 mRNA Variant 4

(SEQ ID NO: 99)
```
   1 acagatgcca aacgagatgg agagagggtg agtaggagca aaatttctca tgagaatact
  61 gaaaaatgaa gcctaaaatg aagtattcaa ccaacaaaat ttccacagca aagtggaaga
 121 acacagcaag caaagccttg tgtttcaagc tgggaaaatc ccaacagaag gccaaagaag
 181 tttgccccat gtactttatg aagctccgct ctggccttat gataaaaaag gaggcctgtt
 241 actttaggag agaaaccacc aaaaggcctt cactgaaaac aggtagaaag cacaaaagac
 301 atctggtact cgctgcctgt caacagcagt ctactgtgga gtgctttgcc tttggtatat
 361 caggggtcca gaaatatact agagcacttc atgattcaag tatcacagga atttcaccta
 421 ttacagagta tcttgcttct ctaagcacat acaatgatca atccattact tttgctttgg
 481 aggatgaaag ttatgagata tatgttgaag acttgaaaaa agatgaaaag aaagataagg
 541 tgttactgag ttactatgag tctcaacacc cctcaaatga atcaggtgac ggtgttgatg
 601 gtaagatgtt aatggtaacc ctgagtccta caaaagactt ctggttgcat gccaacaaca
 661 aggaacactc tgtggagctc cataagtgtg aaaaaccact gccagaccag gccttctttg
 721 tccttcataa tatgcactcc aactgtgttt catttgaatg caagactgat cctggagtgt
 781 ttataggtgt aaaggataat catcttgctc tgattaaagt agactcttct gagaatttgt
 841 gtactgaaaa tatcttgttt aagctctctg aaacttagtt gatggaaacc tgtgagtctt
 901 gggttgagta cccaaatgct accactggag aaggaatgag agataaagaa agagacaggt
 961 gacatctaag ggaaatgaag agtgcttagc atgtgtggaa tgttttccat attatgtata
1021 aaaatatttt ttctaatcct ccagttattc tttatttcc ctctgtataa ctgcatcttc
1081 aatacaagta tcagtatatt aaatagggta ttggtaaaga aacggtcaac attctaaaga
1141 gatacagtct gacctttact tttctctagt ttcagtccag aaagaacttc atatttagag
1201 ctaaggccac tgaggaaaga gccatagctt aagtctctat gtagacaggg atccatttta
1261 aagagctact tagagaaata attttccaca gttccaaacg ataggctcaa acactagagc
1321 tgctagtaaa aagaagacca gatgcttcac agaattatca ttttttcaac tggaataaaa
1381 caccaggttt gtttgtagat gtcttaggca acactcagag cagatctccc ttactgtcag
1441 gggatatgga acttcaaagg cccacatggc aagccaggta acataaatgt gtgaaaaagt
1501 aaagataaact aaaaaattta gaaaaataaa tccagtattt gtaaagtgaa taacttcatt
1561 tctaattgtt taattttttaa aattctgatt tttatatatt gagtttaagc aaggcattct
1621 tacacgagga agtgaagtaa attttagttc agacataaaa tttcacttat taggaatatg
1681 taacatgcta aaactttttt tttttaaag agtactgagt cacaacatgt tttagagcat
1741 ccaagtacca tataatccaa ctatcatggt aaggccagaa atcttctaac ctaccagagc
1801 ctagatgaga caccgaatta acattaaaat ttcagtaact gactgtccct catgtccatg
1861 gcctaccatc ccttctgacc ctggcttcca gggacctatg tcttttaata ctcactgtca
```

-continued

```
1921 cattgggcaa agttgcttct aatccttatt tcccatgtgc acaagtcttt ttgtattcca
1981 gcttcctgat aacactgctt actgtggaat attcatttga catctgtctc ttttcatttc
2041 ttttaactac catgcccttg atatatcttt tgcacctgct gaacttcatt tctgtatcac
2101 ctgacctctg gatgccaaaa cgtttattct gctttgtctg ttgtagaatt ttagataaag
2161 ctattaatgg caatattttt ttgctaaacg ttttgttttt ttactgtcac tagggcaata
2221 aaatttatac tcaaccatat aataacattt tttaactact aaaggagtag ttttttatttt
2281 aaagtcttag caatttctat tacaactttt cttagactta acacttatga taaatgacta
2341 acatagtaac agaatcttta tgaaatatga cctttctga aaatacatac ttttacattt
2401 ctactttatt gagacctatt agatgtaagt gctagtagaa tataagataa aagaggctga
2461 gaattaccat acaagggtat tacaactgta aaacaattta tctttgtttc attgttctgt
2521 caataattgt taccaaagag ataaaaataa aagcagaatg tatatcatcc catctgaaaa
2581 acactaatta ttgacatgtg catctgtaca ataaacttaa aatgattatt aaataatcaa
2641 atatatctac tacattgttt atattattga ataaagtata ttttccaaat gtaaaaaaaa
2701 aaaaa
```

Human IL-33 mRNA Variant 5

(SEQ ID NO: 100)

```
   1 aaatactaca attgctgact acaggaaacc tcatcatctg agaccagcac tttataaatt
  61 agaatactga aaaatgaagc ctaaaatgaa gtattcaacc aacaaaattt ccacagcaaa
 121 gtggaagaac acagcaagca aagccttgtg tttcaagctg ggaaaatccc aacagaaggc
 181 caaagaagtt tgccccatgt actttatgaa gctccgctct ggccttatga taaaaaagga
 241 ggcctgttac tttaggagag aaaccaccaa aaggccttca ctgaaaacag gtagaaagca
 301 caaaagacat ctggtactcg ctgcctgtca acagcagtct actgtggagt gctttgcctt
 361 tggtatatca ggggtccaga aatatactag agcacttcat gattcaagta tcacaggaat
 421 ttcacctatt acagagtatc ttgcttctct aagcacatac aatgatcaat ccattacttt
 481 tgctttggag gatgaaagtt atgagatata tgttgaagac ttgaaaaaag atgaaaagaa
 541 agataaggtg ttactgagtt actatgagtc tcaacacccc tcaaatgaat caggtgacgg
 601 tgttgatggt aagatgttaa tggtaaccct gagtcctaca aaagacttct ggttgcatgc
 661 caacaacaag gaacactctg tggagctcca taagtgtgaa aaaccactgc cagaccaggc
 721 cttctttgtc cttcataata tgcactccaa ctgtgtttca tttgaatgca agactgatcc
 781 tggagtgttt ataggtgtaa aggataatca tcttgctctg attaaagtag actcttctga
 841 gaatttgtgt actgaaaata tcttgtttaa gctctctgaa acttagttga tggaaacctg
 901 tgagtcttgg gttgagtacc caaatgctac cactggagaa ggaatgagag ataaagaaag
 961 agacaggtga catctaaggg aaatgaagag tgcttagcat gtgtggaatg ttttccatat
1021 tatgtataaa atattttttt ctaatcctcc agttattctt ttatttccct ctgtataact
1081 gcatcttcaa tacaagtatc agtatattaa atagggtatt ggtaaagaaa cggtcaacat
1141 tctaaagaga tacagtctga cctttacttt tctctagttt cagtccagaa agaacttcat
1201 atttagagct aaggccactg aggaaagagc catagcttaa gtctctatgt agacagggat
1261 ccattttaaa gagctactta gagaaataat tttccacagt tccaaacgat aggctcaaac
1321 actagagctg ctagtaaaaa gaagaccaga tgcttcacag aattatcatt ttttcaactg
1381 gaataaaaca ccaggttttgt ttgtagatgt cttaggcaac actcagagca gatctccctt
1441 actgtcaggg gatatggaac ttcaaaggcc cacatggcaa gccaggtaac ataaatgtgt
```

-continued

```
1501 gaaaaagtaa agataaactaa aaaatttaga aaaataaaatc cagtatttgt aaagtgaata
1561 acttcatttc taattgttta attttttaaaa ttctgatttt tatatattga gtttaagcaa
1621 ggcattctta cacgaggaag tgaagtaaat tttagttcag acataaaatt tcacttatta
1681 ggaatatgta acatgctaaa acttttttttt ttttaaagag tactgagtca caacatgttt
1741 tagagcatcc aagtaccata taatccaact atcatggtaa ggccagaaat cttctaacct
1801 accagagcct agatgagaca ccgaattaac attaaaattt cagtaactga ctgtccctca
1861 tgtccatggc ctaccatccc ttctgaccct ggcttccagg gacctatgtc ttttaatact
1921 cactgtcaca ttgggcaaag ttgcttctaa tccttatttc ccatgtgcac aagtcttttt
1981 gtattccagc ttcctgataa cactgcttac tgtggaatat tcatttgaca tctgtctctt
2041 ttcatttctt ttaactacca tgcccttgat atatcttttg cacctgctga acttcatttc
2101 tgtatcacct gacctctgga tgccaaaacg tttattctgc tttgtctgtt gtagaatttt
2161 agataaagct attaatggca atatttttttt gctaaacgtt tttgtttttt actgtcacta
2221 gggcaataaa atttatactc aaccatataa taacattttt taactactaa aggagtagtt
2281 tttattttaa agtcttagca atttctatta caactttttct tagacttaac acttatgata
2341 aatgactaac atagtaacag aatctttatg aaatatgacc ttttctgaaa atacatactt
2401 ttacatttct actttattga gacctattag atgtaagtgc tagtagaata taagataaaa
2461 gaggctgaga attaccatac aagggtatta caactgtaaa acaatttatc tttgtttcat
2521 tgttctgtca ataattgtta ccaaagagat aaaaataaaa gcagaatgta tatcatccca
2581 tctgaaaaac actaattatt gacatgtgca tctgtacaat aaacttaaaa tgattattaa
2641 ataatcaaat atatctacta cattgtttat attattgaat aaagtatatt ttccaaatgt
2701 aaaaaaaaaa aaa
```

Human IL-33 mRNA Variant 6

(SEQ ID NO: 101)

```
   1 agtctacaga ctcctccgaa cacagagctg cagctcttca gggaagaaat caaaacaaga
  61 tcacaagaat actgaaaaat gaagcctaaa atgaagtatt caaccaacaa aatttccaca
 121 gcaaagtgga agaacacagc aagcaaagcc ttgtgtttca agctgggaaa atcccaacag
 181 aaggccaaag aagtttgccc catgtacttt atgaagctcc gctctggcct tatgataaaa
 241 aaggaggcct gttactttag gagagaaacc accaaaaggc cttcactgaa acaggtagaa
 301 aagcacaaaa gacatctggt actcgctgcc tgtcaacagc agtctactgt ggagtgcttt
 361 gcctttggta tatcaggggt ccagaaatat actagagcac ttcatgattc aagtatcaca
 421 gagtatcttg cttctctaag cacatacaat gatcaatcca ttacttttgc tttggaggat
 481 gaaagttatg agatatatgt tgaagacttg aaaaaagatg aaaagaaaga taaggtgtta
 541 ctgagttact atgagtctca acacccctca aatgaatcag gtgacggtgt tgatggtaag
 601 atgttaatgg taaccctgag tcctacaaaa gacttctggt tgcatgccaa caacaaggaa
 661 cactctgtgg agctccataa gtgtgaaaaa ccactgccag accaggcctt ctttgtcctt
 721 cataatatgc actccaactg tgtttcattt gaatgcaaga ctgatcctgg agtgtttata
 781 ggtgtaaagg ataatcatct tgctctgatt aaagtagact cttctgagaa tttgtgtact
 841 gaaaatatct tgtttaagct ctctgaaact tagttgatgg aaacctgtga gtcttgggtt
 901 gagtacccaa atgctaccac tggagaagga atgagagata agaaagaga caggtgacat
 961 ctaagggaaa tgaagagtgc ttagcatgtg tggaatgttt tccatattat gtataaaaat
1021 atttttttcta atcctccagt tatttctttta tttccctctg tataactgca tcttcaatac
1081 aagtatcagt atattaaata gggtattggt aaagaaacgg tcaacattct aaagagatac
```

-continued

```
1141 agtctgacct ttactttct ctagtttcag tccagaaaga acttcatatt tagagctaag 1201 gccactgagg aaagagccat agcttaagtc tctatgtaga cagggatcca ttttaaagag 1261 ctacttagag aaataatttt ccacagttcc aaacgatagg ctcaaacact agagctgcta 1321 gtaaaagaa gaccagatgc ttcacagaat tatcattttt tcaactggaa taaaacacca 1381 ggtttgtttg tagatgtctt aggcaacact cagagcagat ctcccttact gtcagggat 1441 atggaacttc aaaggcccac atggcaagcc aggtaacata aatgtgtgaa aaagtaaaga 1501 taactaaaaa atttagaaaa ataaatccag tatttgtaaa gtgaataact tcatttctaa 1561 ttgtttaatt tttaaaattc tgattttat atattgagtt taagcaaggc attcttacac 1621 gaggaagtga agtaaatttt agttcagaca taaaatttca cttattagga atatgtaaca 1681 tgctaaaact ttttttttt taaagagtac tgagtcacaa catgttttag agcatccaag 1741 taccatataa tccaactatc atggtaaggc cagaaatctt ctaacctacc agagcctaga 1801 tgagacaccg aattaacatt aaaatttcag taactgactg tccctcatgt ccatggccta 1861 ccatcccttc tgaccctggc ttccagggac ctatgtcttt taatactcac tgtcacattg 1921 ggcaaagttg cttctaatcc ttatttccca tgtgcacaag tcttttttgta ttccagcttc 1981 ctgataacac tgcttactgt ggaatattca tttgacatct gtctcttttc atttctttta 2041 actaccatgc ccttgatata tcttttgcac ctgctgaact tcatttctgt atcacctgac 2101 ctctggatgc caaaacgttt attctgcttt gtctgttgta gaattttaga taaagctatt 2161 aatggcaata ttttttttgct aaacgttttt gttttttact gtcactaggg caataaaatt 2221 tatactcaac catataataa cattttttaa ctactaaagg agtagttttt attttaaagt 2281 cttagcaatt tctattacaa cttttcttag acttaacact tatgataaat gactaacata 2341 gtaacagaat ctttatgaaa tatgaccttt tctgaaaata catacttta catttctact 2401 ttattgagac ctattagatg taagtgctag tagaatataa gataaaagag gctgagaatt 2461 accatacaag ggtattacaa ctgtaaaaca atttatcttt gtttcattgt tctgtcaata 2521 attgttacca aagagataaa aataaaagca gaatgtatat catcccatct gaaaaacact 2581 aattattgac atgtgcatct gtacaataaa cttaaaatga ttattaaata atcaaatata 2641 tctactacat tgttttatatt attgaataaa gtatattttc caaatgtaaa aaaaaaaaa
```

Human IL-33 mRNA Variant 7

(SEQ ID NO: 102)

```
  1 acagatgcca aacgagatgg agagagggtg agtaggagca aaatttctca tgagaatact 61 gaaaaatgaa gcctaaaatg aagtattcaa ccaacaaaat ttccacagca aagtggaaga 121 acacagcaag caaagccttg tgtttcaagc tgggaaaatc ccaacagaag gccaaagaag 181 tttgccccat gtactttatg aagctccgct ctggcctat gataaaaaag gaggcctgtt 241 actttaggag agaaaccacc aaaaggcctt cactgaaaac aggtagaaag cacaaaagac 301 atctggtact cgctgcctgt caacagcagt ctactgtgga gtgctttgcc tttggtatat 361 cagggtcca gaaatatact agagcacttc atgattcaag tatcacagag tatcttgctt 421 ctctaagcac atacaatgat caatccatta cttttgcttt ggaggatgaa agttatgaga 481 tatatgttga agacttgaaa aaagatgaaa agaaagataa ggtgttactg agttactatg 541 agtctcaaca cccctcaaat gaatcaggtg acggtgttga tggtaagatg ttaatggtaa 601 ccctgagtcc tacaaaagac ttctggttgc atgccaacaa caaggaacac tctgtggagc 661 tccataagtg tgaaaaacca ctgccagacc aggccttctt tgtccttcat aatatgcact 721 ccaactgtgt ttcatttgaa tgcaagactg atcctggagt gtttataggt gtaaaggata
```

-continued

```
 781 atcatcttgc tctgattaaa gtagactctt ctgagaattt gtgtactgaa aatatcttgt
 841 ttaagctctc tgaaacttag ttgatggaaa cctgtgagtc ttgggttgag tacccaaatg
 901 ctaccactgg agaaggaatg agagataaag aaagagacag gtgacatcta agggaaatga
 961 agagtgctta gcatgtgtgg aatgttttcc atattatgta taaaaatatt ttttctaatc
1021 ctccagttat tcttttattt ccctctgtat aactgcatct tcaatacaag tatcagtata
1081 ttaaataggg tattggtaaa gaaacggtca acattctaaa gagatacagt ctgacccttta
1141 cttttctcta gtttcagtcc agaaagaact tcatatttag agctaaggcc actgaggaaa
1201 gagccatagc ttaagtctct atgtagacag ggatccattt taaagagcta cttagagaaa
1261 taattttcca cagttccaaa cgataggctc aaacactaga gctgctagta aaaagaagac
1321 cagatgcttc acagaattat catttttca actggaataa acaccaggt ttgtttgtag
1381 atgtcttagg caacactcag agcagatctc ccttactgtc agggatatg gaacttcaaa
1441 ggcccacatg gcaagccagg taacataaat gtgtgaaaaa gtaaagataa ctaaaaaatt
1501 tagaaaaata aatccagtat ttgtaaagtg aataacttca tttctaattg tttaattttt
1561 aaaattctga tttttatata ttgagtttaa gcaaggcatt cttacacgag gaagtgaagt
1621 aaatttagt tcagacataa aatttcactt attaggaata tgtaacatgc taaaacttt
1681 tttttttaa agagtactga gtcacaacat gttttagagc atccaagtac catataatcc
1741 aactatcatg gtaaggccag aaatcttcta acctaccaga gcctagatga gacaccgaat
1801 taacattaaa atttcagtaa ctgactgtcc ctcatgtcca tggcctacca tcccttctga
1861 ccctggcttc cagggaccta tgtctttaa tactcactgt cacattgggc aaagttgctt
1921 ctaatcctta tttcccatgt gcacaagtct ttttgtattc cagcttcctg ataacactgc
1981 ttactgtgga atattcattt gacatctgtc tcttttcatt tcttttaact accatgccct
2041 tgatatatct tttgcacctg ctgaacttca tttctgtatc acctgacctc tggatgccaa
2101 aacgtttatt ctgctttgtc tgttgtagaa tttagataaa agctattaat ggcaatattt
2161 ttttgctaaa cgttttgtt ttttactgtc actagggcaa taaaatttat actcaaccat
2221 ataataacat ttttaacta ctaaaggagt agttttttatt ttaaagtctt agcaatttct
2281 attacaactt ttcttagact taacacttat gataaatgac taacatagta acagaatctt
2341 tatgaaaatat gacctttct gaaaatacat acttttacat ttctactta ttgagaccta
2401 ttagatgtaa gtgctagtag aatataagat aaaagaggct gagaattacc atacaagggt
2461 attacaactg taaaacaatt tatctttgtt tcattgttct gtcaataatt gttaccaaag
2521 agataaaaat aaaagcagaa tgtatatcat cccatctgaa aaacactaat tattgacatg
2581 tgcatctgta caataaactt aaaatgatta ttaaataatc aaatatatct actacattgt
2641 ttatattatt gaataaagta tattttccaa atgtaaaaaa aaaaaaa
```

Human IL-33 mRNA Variant 8

(SEQ ID NO: 103)
```
   1 agtctacaga ctcctccgaa cacagagctg cagctcttca gggaagaaat caaaacaaga
  61 tcacaagaat actgaaaaat gaagcctaaa atgaagtatt caaccaacaa aatttccaca
 121 gcaaagtgga agaacacagc aagcaaagcc ttgtgtttca gctgggaaa atcccaacag
 181 aaggccaaag aagtttgccc catgtacttt atgaagctcc gctctggcct tatgataaaa
 241 aaggaggcct gttactttag gagagaaacc accaaaaggc cttcactgaa acaggaatt
 301 tcacctatta cagagtatct tgcttctcta agcacataca atgatcaatc cattactttt
 361 gctttggagg atgaaagtta tgagatatat gttgaagact tgaaaaagaga tgaaaagaaa
 421 gataaggtgt tactgagtta ctatgagtct caacacccct caaatgaatc aggtgacggt
```

```
481 gttgatggta agatgttaat ggtaaccctg agtcctacaa aagacttctg gttgcatgcc 541 aacaacaagg aacactctgt ggagctccat aagtgtgaaa aaccactgcc agaccaggcc 601 ttctttgtcc ttcataatat gcactccaac tgtgtttcat ttgaatgcaa gactgatcct 661 ggagtgttta taggtgtaaa ggataatcat cttgctctga ttaaagtaga ctcttctgag 721 aatttgtgta ctgaaaatat cttgtttaag ctctctgaaa cttagttgat ggaaacctgt 781 gagtcttggg ttgagtaccc aaatgctacc actggagaag gaatgagaga taaagaaaga 841 gacaggtgac atctaaggga aatgaagagt gcttagcatg tgtggaatgt tttccatatt 901 atgtataaaa atattttttc taatcctcca gttattcttt tatttccctc tgtataactg 961 catcttcaat acaagtatca gtatattaaa tagggtattg gtaaagaaac ggtcaacatt 1021 ctaaagagat acagtctgac ctttactttt ctctagtttc agtccagaaa gaacttcata 1081 tttagagcta aggccactga ggaaagagcc atagcttaag tctctatgta gacagggatc 1141 cattttaaag agctacttag agaaataatt tcccacagtt ccaaacgata ggctcaaaca 1201 ctagagctgc tagtaaaaag aagaccagat gcttcacaga attatcattt tttcaactgg 1261 aataaaacac caggtttgtt tgtagatgtc ttaggcaaca ctcagagcag atctcccta 1321 ctgtcagggg atatggaact tcaaaggccc acatggcaag ccaggtaaca taaatgtgtg 1381 aaaaagtaaa gataactaaa aaatttagaa aaataaatcc agtatttgta aagtgaataa 1441 cttcatttct aattgtttaa ttttaaaat tctgattttt atatattgag tttaagcaag 1501 gcattcttac acgaggaagt gaagtaaatt ttagttcaga cataaaattt cacttattag 1561 gaatatgtaa catgctaaaa cttttttttt tttaaagagt actgagtcac aacatgtttt 1621 agagcatcca agtaccatat aatccaacta tcatggtaag gccagaaatc ttctaaccta 1681 ccagagccta gatgagacac cgaattaaca ttaaaatttc agtaactgac tgtccctcat 1741 gtccatggcc taccatccct tctgaccctg gcttccaggg acctatgtct tttaatactc 1801 actgtcacat tgggcaaagt tgcttctaat ccttatttcc catgtgcaca agtctttttg 1861 tattccagct tcctgataac actgcttact gtggaatatt catttgacat ctgtctcttt 1921 tcatttcttt taactaccat gcccttgata tatctttgc acctgctgaa cttcatttct 1981 gtatcacctg acctctggat gccaaaacgt ttattctgct ttgtctgttg tagaatttta 2041 gataaagcta ttaatggcaa tattttttg ctaaacgttt ttgttttta ctgtcactag 2101 ggcaataaaa tttatactca accatataat aacattttt aactactaaa ggagtagttt 2161 ttattttaaa gtcttagcaa tttctattac aacttttctt agacttaaca cttatgataa 2221 atgactaaca tagtaacaga atctttatga aatatgacct tttctgaaaa tacatacttt 2281 tacatttcta ctttattgag acctattaga tgtaagtgct agtagaatat aagataaaag 2341 aggctgagaa ttaccataca agggtattac aactgtaaaa caatttatct ttgtttcatt 2401 gttctgtcaa taattgttac caaagagata aaaataaaag cagaatgtat atcatcccat 2461 ctgaaaaaca ctaattattg acatgtgcat ctgtacaata aacttaaaat gattattaaa 2521 taatcaaata tatctactac attgtttata ttattgaata aagtatattt tccaaatgta 2581 aaaaaaaaa aa Human IL-1R1 mRNA Variant 1
                                                                            (SEQ ID NO: 104)
   1 gtggccggcg gccggagccg actcggagcg cgcggcgccg gcggggagga gccggagagc 61 ggccgggccg ggcggtgggg gcgccggcct gccccgcgcg ccccagggag cggcaggaat 121 gtgacaatcg cgcgcccgcg caccgaagca ctcctcgctc ggctcctagg gctctcgccc
```

```
 181 ctctgagctg agccgggttc cgcccggggc tgggatccca tcaccctcca cggccgtccg 241 tccaggtaga cgcaccctct gaagatggtg actccctcct gagaagctgg accccttggt 301 aaaagacaag gccttctcca agaagaatat gaaagtgtta ctcagactta tttgtttcat 361 agctctactg atttcttctc tggaggctga taaatgcaag gaacgtgaag aaaaaataat 421 tttagtgtca tctgcaaatg aaattgatgt tcgtccctgt cctcttaacc caaatgaaca 481 caaaggcact ataacttggt ataaagatga cagcaagaca cctgtatcta cagaacaagc 541 ctccaggatt catcaacaca aagagaaact ttggtttgtt cctgctaagg tggaggattc 601 aggacattac tattgcgtgg taagaaattc atcttactgc ctcagaatta aaataagtgc 661 aaaatttgtg gagaatgagc ctaacttatg ttataatgca caagccatat ttaagcagaa 721 actacccgtt gcaggagacg gaggacttgt gtgcccttat atggagtttt taaaaatga 781 aaataatgag ttacctaaat tacagtggta taaggattgc aaacctctac ttcttgacaa 841 tatacacttt agtggagtca agataggct catcgtgatg aatgtggctg aaaagcatag 901 agggaactat acttgtcatg catcctacac atacttgggc aagcaatatc ctattacccg 961 ggtaatagaa tttattactc tagaggaaaa caaacccaca aggcctgtga ttgtgagccc 1021 agctaatgag acaatggaag tagacttggg atcccagata caattgatct gtaatgtcac 1081 cggccagttg agtgacattg cttactggaa gtggaatggg tcagtaattg atgaagatga 1141 cccagtgcta ggggaagact attacagtgt ggaaaatcct gcaaacaaaa gaaggagtac 1201 cctcatcaca gtgcttaata tatcggaaat tgaaagtaga ttttataaac atccatttac 1261 ctgttttgcc aagaatacac atggtataga tgcagcatat atccagttaa tatatccagt 1321 cactaatttc cagaagcaca tgattggtat atgtgtcacg ttgacagtca taattgtgtg 1381 ttctgttttc atctataaaa tcttcaagat tgacattgtg ctttggtaca gggattcctg 1441 ctatgatttt ctcccaataa aagcttcaga tggaaagacc tatgacgcat atatactgta 1501 tccaaagact gttggggaag gtctacctc tgactgtgat attttttgtgt ttaaagtctt 1561 gcctgaggtc ttggaaaaac agtgtggata taagctgttc atttatggaa gggatgacta 1621 cgttgggaa gacattgttg aggtcattaa tgaaacgta aagaaagca gaagactgat 1681 tatcatttta gtcagagaaa catcaggctt cagctggctg ggtggttcat ctgaagagca 1741 aatagccatg tataatgctc ttgttcagga tggaattaaa gttgtcctgc ttgagctgga 1801 gaaaatccaa gactatgaga aaatgccaga atcgattaaa ttcattaagc agaaacatgg 1861 ggctatccgc tggtcagggg actttacaca gggaccacag tctgcaaaga caaggttctg 1921 gaagaatgtc aggtaccaca tgccagtcca gcgacggtca ccttcatcta aacaccagtt 1981 actgtcacca gccactaagg agaaactgca aagagaggct cacgtgcctc tcgggtagca 2041 tggagaagtt gccaagagtt ctttaggtgc ctcctgtctt atggcgttgc aggccaggtt 2101 atgcctcatg ctgacttgca gagttcatgg aatgtaacta tatcatcctt tatccctgag 2161 gtcacctgga atcagattat aagggaata agccatgacg tcaatagcag cccagggcac 2221 ttcagagtag agggcttggg aagatctttt aaaaaggcag taggcccggt gtggtggctc 2281 acgcctataa tcccagcact ttgggaggct gaagtgggtg gatcaccaga ggtcaggagt 2341 tcgagaccag cccagccaac atggcaaaac cccatctcta ctaaaaatac aaaaatgagc 2401 taggcatggt ggcacacgcc tgtaatccca gctacacctg aggctgaggc aggagaattg 2461 cttgaaccgg ggagacggag gttgcagtga gccgagtttg ggccactgca ctctagcctg 2521 gcaacagagc aagactccgt ctcaaaaaaa gggcaataaa tgccctctct gaatgtttga 2581 actgccaaga aaaggcatgg agacagcgaa ctagaagaaa gggcaagaag gaaatagcca
```

-continued

```
2641 ccgtctacag atggcttagt taagtcatcc acagcccaag ggcggggcta tgccttgtct
2701 ggggaccctg tagagtcact gaccctggag cggctctcct gagaggtgct gcaggcaaag
2761 tgagactgac acctcactga ggaagggaga catattcttg gagaactttc catctgcttg
2821 tattttccat acacatcccc agccagaagt tagtgtccga agaccgaatt ttattttaca
2881 gagcttgaaa actcacttca atgaacaaag ggattctcca ggattccaaa gttttgaagt
2941 catcttagct ttccacagga gggagagaac ttaaaaaagc aacagtagca gggaattgat
3001 ccacttctta atgctttcct ccctggcatg accatcctgt cctttgttat tatcctgcat
3061 tttacgtctt tggaggaaca gctccctagt ggcttcctcc gtctgcaatg tcccttgcac
3121 agcccacaca tgaaccatcc ttcccatgat gccgctcttc tgtcatcccg ctcctgctga
3181 aacacctccc aggggctcca cctgttcagg agctgaagcc catgctttcc caccagcatg
3241 tcactcccag accacctccc tgccctgtcc tccagcttcc cctcgctgtc ctgctgtgtg
3301 aattcccagg ttggcctggt ggccatgtcg cctgcccccca gcactcctct gtctctgctc
3361 ttgcctgcac ccttcctcct cctttgccta ggaggccttc tcgcattttc tctagctgat
3421 cagaatttta ccaaaattca gaacatcctc caattccaca gtctctggga gactttccct
3481 aagaggcgac ttcctctcca gccttctctc tctggtcagg cccactgcag agatggtggt
3541 gagcacatct gggaggctgg tctccctcca gctggaattg ctgctctctg agggagaggc
3601 tgtggtggct gtctctgtcc ctcactgcct tccaggagca atttgcacat gtaacataga
3661 tttatgtaat gctttatgtt taaaaacatt ccccaattat cttatttaat ttttgcaatt
3721 attctaattt tatatataga gaaagtgacc tatttttttaa aaaaatcaca ctctaagttc
3781 tattgaacct aggacttgag cctccatttc tggcttctag tctggtgttc tgagtacttg
3841 atttcaggtc aataacggtc cccctcact ccacactggc acgtttgtga gaagaaatga
3901 cattttgcta ggaagtgacc gagtctagga atgcttttat tcaagacacc aaattccaaa
3961 cttctaaatg ttggaatttt caaaaattgt gtttagattt tatgaaaaac tcttctactt
4021 tcatctattc tttccctaga ggcaaacatt tcttaaaatg tttcattttc attaaaaatg
4081 aaagccaaat ttatatgcca ccgattgcag gacacaagca cagttttaag agttgtatga
4141 acatggagag gacttttggt ttttatattt ctcgtattta atatgggtga acaccaactt
4201 ttatttggaa taataatttt cctcctaaac aaaaacacat tgagtttaag tctctgactc
4261 ttgcctttcc acctgctttc tcctgggccc gctttgcctg cttgaaggaa cagtgctgtt
4321 ctggagctgc tgttccaaca gacagggcct agctttcatt tgacacacag actacagcca
4381 gaagcccatg gagcagggat gtcacgtctt gaaaagccta ttagatgttt tacaaattta
4441 attttgcaga ttattttagt ctgtcatcca gaaaatgtgt cagcatgcat agtgctaaga
4501 aagcaagcca atttggaaac ttaggttagt gacaaaattg gccagagagt gggggtgatg
4561 atgaccaaga attacaagta gaatggcagc tggaatttaa ggagggacaa gaatcaatgg
4621 ataagcgtgg gtggaggaag atccaaacag aaaagtgcaa agttattccc catcttccaa
4681 gggttgaatt ctggaggaag aagacacatt cctagttccc cgtgaacttc ctttgactta
4741 ttgtccccac taaaacaaaa caaaaaactt ttaatgcctt ccacattaat tagattttct
4801 tgcagttttt ttatggcatt ttttttaaaga tgccctaagt gttgaagaag agtttgcaaa
4861 tgcaacaaaa tatttaatta ccggttgtta aaactggttt agcacaattt atattttccc
4921 tctcttgcct ttcttatttg caataaaagg tattgagcca tttttttaaat gacattttg
4981 ataaattatg tttgtactag ttgatgaagg agttttttttt aacctgttta tataattttg
```

-continued

```
5041 cagcagaagc caaattttt gtatattaaa gcaccaaatt catgtacagc atgcatcacg 5101 gatcaataga ctgtacttat tttccaataa aattttcaaa ctttgtactg ttaaaaaaaa 5161 aaaaaaaaaa
```

Human IL-1R1 mRNA Variant 2

(SEQ ID NO: 105)

```
   1 attggcagct cttcacttgt atcttttcat atcaaaaatg ggaggtgaca cccagtttaa 61 ggaaaattcc aaggcatttg tctcgactaa tgtgaaagat gattacagtg ccagaggac 121 tgccaaggct ccttctcaag ctgcttgagt caatgagggt agacgcaccc tctgaagatg 181 gtgactccct cctgagaagc tggaccccctt ggtaaaagac aaggccttct ccaagaagaa 241 tatgaaagtg ttactcagac ttatttgttt catagctcta ctgatttctt ctctggaggc 301 tgataaatgc aaggaacgtg aagaaaaaat aattttagtg tcatctgcaa atgaaattga 361 tgttcgtccc tgtcctctta acccaaatga acacaaaggc actataactt ggtataaaga 421 tgacagcaag acacctgtat ctacagaaca agcctccagg attcatcaac acaaagaaa 481 actttggttt gttcctgcta aggtggagga ttcaggacat tactattgcg tggtaagaaa 541 ttcatcttac tgcctcagaa ttaaaataag tgcaaaattt gtggagaatg agcctaactt 601 atgttataat gcacaagcca tatttaagca gaaactaccc gttgcaggag acggaggact 661 tgtgtgccct tatatggagt tttttaaaaa tgaaaataat gagttaccta aattacagtg 721 gtataaggat tgcaaacctc tacttcttga caatatacac tttagtggag tcaaagatag 781 gctcatcgtg atgaatgtgg ctgaaaagca tagagggaac tatacttgtc atgcatccta 841 cacatacttg ggcaagcaat atcctattac ccgggtaata gaatttatta ctctagagga 901 aaacaaaccc acaaggcctg tgattgtgag cccagctaat gagacaatgg aagtagactt 961 gggatcccag atacaattga tctgtaatgt caccggccag ttgagtgaca ttgcttactg 1021 gaagtggaat gggtcagtaa ttgatgaaga tgacccagtg ctaggggaag actattacag 1081 tgtggaaaat cctgcaaaca aagaaggag taccctcatc acagtgctta atatatcgga 1141 aattgaaagt agattttata acatccatt tacctgtttt gccaagaata cacatggtat 1201 agatgcagca tatatccagt taatatatcc agtcactaat ttccagaagc acatgattgg 1261 tatatgtgtc acgttgacag tcataattgt gtgttctgtt ttcatctata aaatcttcaa 1321 gattgacatt gtgctttggt acagggattc ctgctatgat tttctcccaa taaagtctct 1381 gcctgaggtc ttggaaaaac agtgtggata taagctgttc atttatggaa gggatgacta 1441 cgttgggaa gacattgttg aggtcattaa tgaaaacgta aagaaaagca gaagactgat 1501 tatcattta gtcagagaaa catcaggctt cagctggctg ggtggttcat ctgaagagca 1561 aatagccatg tataatgctc ttgttcagga tggaattaaa gttgtcctgc ttgagctgga 1621 gaaaatccaa gactatgaga aaatgccaga atcgattaaa ttcattaagc agaaacatgg 1681 ggctatccgc tggtcagggg actttacaca gggaccacag tctgcaaaga caaggttctg 1741 gaagaatgtc aggtaccaca tgccagtcca gcgacggtca ccttcatcta acaccagtt 1801 actgtcacca gccactaagg agaaactgca agagaggct cacgtgcctc tcgggtagca 1861 tggagaagtt gccaagagtt ctttaggtgc ctcctgtctt atggcgttgc aggccaggtt 1921 atgcctcatg ctgacttgca gagttcatgg aatgtaacta tcatccttt tatccctgag 1981 gtcacctgga atcagattat aagggaata agccatgacg tcaatagcag cccagggcac 2041 ttcagagtag agggcttggg aagatctttt aaaaaggcag taggcccggt gtggtggctc 2101 acgcctataa tcccagcact ttgggaggct gaagtgggtg gatcaccaga ggtcaggagt 2161 tcgagaccag cccagccaac atggcaaaac cccatctcta ctaaaaatac aaaaatgagc
```

-continued

```
2221 taggcatggt ggcacacgcc tgtaatccca gctacacctg aggctgaggc aggagaattg
2281 cttgaaccgg ggagacggag gttgcagtga gccgagtttg gccactgca ctctagcctg
2341 gcaacagagc aagactccgt ctcaaaaaaa gggcaataaa tgccctctct gaatgtttga
2401 actgccaaga aaaggcatgg agacagcgaa ctagaagaaa gggcaagaag gaaatagcca
2461 ccgtctacag atggcttagt taagtcatcc acagcccaag ggcggggcta tgccttgtct
2521 ggggaccctg tagagtcact gaccctggag cggctctcct gagaggtgct gcaggcaaag
2581 tgagactgac acctcactga ggaagggaga catattcttg gagaactttc catctgcttg
2641 tattttccat acacatcccc agccagaagt tagtgtccga agaccgaatt ttattttaca
2701 gagcttgaaa actcacttca atgaacaaag ggattctcca ggattccaaa gttttgaagt
2761 catcttagct ttccacagga gggagagaac ttaaaaaagc aacagtagca gggaattgat
2821 ccacttctta atgctttcct ccctggcatg accatcctgt cctttgttat tatcctgcat
2881 tttacgtctt tggaggaaca gctccctagt ggcttcctcc gtctgcaatg tcccttgcac
2941 agcccacaca tgaaccatcc ttcccatgat gccgctcttc tgtcatcccg ctcctgctga
3001 aacacctccc aggggctcca cctgttcagg agctgaagcc catgcttttcc caccagcatg
3061 tcactcccag accacctccc tgccctgtcc tccagcttcc cctcgctgtc ctgctgtgtg
3121 aattcccagg ttggcctggt ggccatgtcg cctgccccca gcactcctct gtctctgctc
3181 ttgcctgcac ccttcctcct cctttgccta ggaggccttc tcgcattttc tctagctgat
3241 cagaatttta ccaaaattca gaacatcctc caattccaca gtctctggga gactttccct
3301 aagaggcgac ttcctctcca gccttctctc tctggtcagg cccactgcag agatggtggt
3361 gagcacatct gggaggctgg tctccctcca gctggaattg ctgctctctg agggagaggc
3421 tgtggtggct gtctctgtcc ctcactgcct tccaggagca atttgcacat gtaacataga
3481 tttatgtaat gctttatgtt taaaaacatt ccccaattat cttatttaat ttttgcaatt
3541 attctaattt tatatataga gaaagtgacc tattttttaa aaaaatcaca ctctaagttc
3601 tattgaacct aggacttgag cctccatttc tggcttctag tctggtgttc tgagtacttg
3661 atttcaggtc aataacggtc ccccctcact ccacactggc acgtttgtga gaagaaatga
3721 cattttgcta ggaagtgacc gagtctagga atgcttttat tcaagacacc aaattccaaa
3781 cttctaaatg ttggaatttt caaaaattgt gtttagattt tatgaaaaac tcttctactt
3841 tcatctattc tttccctaga ggcaaacatt tcttaaaatg tttcattttc attaaaaatg
3901 aaagccaaat ttatatgcca ccgattgcag gacacaagca cagttttaag agttgtatga
3961 acatggagag gacttttggt ttttatattt ctcgtattta atatgggtga acaccaactt
4021 ttatttggaa taataatttt cctcctaaac aaaaacacat tgagtttaag tctctgactc
4081 ttgcctttcc acctgctttc tcctgggccc gctttgcctg cttgaaggaa cagtgctgtt
4141 ctggagctgc tgttccaaca gacagggcct agcttcatt tgacacacag actacagcca
4201 gaagcccatg gagcagggat gtcacgtctt gaaaagccta ttagatgttt tacaaattta
4261 attttgcaga ttattttagt ctgtcatcca gaaaatgtgt cagcatgcat agtgctaaga
4321 aagcaagcca atttggaaac ttaggttagt gacaaaattg gccagagagt gggggtgatg
4381 atgaccaaga attacaagta gaatggcagc tggaatttaa ggagggacaa gaatcaatgg
4441 ataagcgtgg gtggaggaag atccaaacag aaaagtgcaa agttattccc catcttccaa
4501 gggttgaatt ctggaggaag aagacacatt cctagttccc cgtgaacttc ctttgactta
4561 ttgtccccac taaaacaaaa caaaaaactt ttaatgcctt ccacattaat tagatttct
```

-continued

```
4621 tgcagttttt ttatggcatt tttttaaaga tgccctaagt gttgaagaag agtttgcaaa 4681 tgcaacaaaa tatttaatta ccggttgtta aaactggttt agcacaattt atattttccc 4741 tctcttgcct ttcttatttg caataaaagg tattgagcca ttttttaaat gacattttg 4801 ataaattatg tttgtactag ttgatgaagg agttttttt aacctgttta tataattttg 4861 cagcagaagc caaatttttt gtatattaaa gcaccaaatt catgtacagc atgcatcacg 4921 gatcaataga ctgtacttat ttccaataa aattttcaaa ctttgtactg ttaaaaaaaa 4981 aaaaaaaaa
```

Human IL-1R1 mRNA Variant 3

(SEQ ID NO: 106)

```
   1 attggcagct cttcacttgt atctttcat atcaaaatg ggaggtgaca cccagtttaa 61 ggaaaattcc aaggcatttg tctcgactaa tgtgaaagat gattacagtg ccagaggac 121 tgccaaggct ccttctcaag ctgcttgagt caatgagggt agacgcaccc tctgaagatg 181 gtgactccct cctgagaagc tggaccccctt ggtaaaagac aaggccttct ccaagaagaa 241 tatgaaagtg ttactcagac ttatttgttt catagctcta ctgatttctt ctctggaggc 301 tgataaatgc aaggaacgtg aagaaaaaat aatttagtg tcatctgcaa atgaaattga 361 tgttcgtccc tgtcctctta acccaaatga acacaaaggc actataactt ggtataaaga 421 tgacagcaag acacctgtat ctacagaaca agcctccagg attcatcaac acaaagagaa 481 actttggttt gttcctgcta aggtggagga ttcaggacat tactattgcg tggtaagaaa 541 ttcatcttac tgcctcagaa ttaaaataag tgcaaaattt gtggagaatg agcctaactt 601 atgttataat gcacaagcca tatttaagca gaaactaccc gttgcaggag acggaggact 661 tgtgtgccct tatatggagt tttttaaaaa tgaaaataat gagttaccta aattacagtg 721 gtataaggat tgcaaacctc tacttcttga caatatacac tttagtggag tcaaagatag 781 gctcatcgtg atgaatgtgg ctgaaaagca tagagggaac tatacttgtc atgcatccta 841 cacatacttg ggcaagcaat atcctattac ccgggtaata gaatttatta ctctagagga 901 aaacaaaccc acaaggcctg tgattgtgag cccagctaat gagacaatgg aagtagactt 961 gggatcccag atacaattga tctgtaatgt caccggccag ttgagtgaca ttgcttactg 1021 gaagtggaat gggtcagtaa ttgatgaaga tgacccagtg ctaggggaag actattacag 1081 tgtggaaaat cctgcaaaca aagaaggag taccctcatc acagtgctta atatatcgga 1141 aattgaaagt agattttata acatccatt tacctgttt gccaagaata cacatggtat 1201 agatgcagca tatatccagt taatatatcc agtcactaat ttccagaagc acatgattgg 1261 tatatgtgtc acgttgacag tcataattgt gtgttctgtt ttcatctata aaatcttcaa 1321 gattgacatt gtgctttggt acagggattc ctgctatgat tttctcccaa taaaagcttc 1381 agatggaaag acctatgacg catatatact gtatccaaag actgttgggg aagggtctac 1441 ctctgactgt gatatttttg tgtttaaagt cttgcctgag gtcttggaaa acagtgtgg 1501 atataagctg ttcatttatg aagggatga ctacgttggg gaagacattg ttgaggtcat 1561 taatgaaaac gtaaagaaa gcagaagact gattatcatt ttagtcagag aaacatcagg 1621 cttcagctgg ctgggtggtt catctgaaga gcaaatagcc atgtataatg ctccttgttca 1681 ggatggaatt aaagttgtcc tgcttgagct ggagaaaatc caagactatg agaaaatgcc 1741 agaatcgatt aaattcatta agcagaaaca tgggctatc cgctggtcag gggactttac 1801 acagggacca cagtctgcaa agacaaggtt ctggaagaat gtcaggtacc acatgccagt 1861 ccagcgacgg tcaccttcat ctaaacacca gttactgtca ccagccacta aggagaaact 1921 gcaaagagag gctcacgtgc ctctcgggta gcatggagaa gttgccaaga gttctttagg
```

-continued

```
1981  tgcctcctgt cttatggcgt tgcaggccag gttatgcctc atgctgactt gcagagttca
2041  tggaatgtaa ctatatcatc ctttatccct gaggtcacct ggaatcagat tattaaggga
2101  ataagccatg acgtcaatag cagcccaggg cacttcagag tagagggctt gggaagatct
2161  tttaaaaagg cagtaggccc ggtgtggtgg ctcacgccta taatcccagc actttgggag
2221  gctgaagtgg gtggatcacc agaggtcagg agttcgagac cagcccagcc aacatggcaa
2281  aaccccatct ctactaaaaa tacaaaaatg agctaggcat ggtggcacac gcctgtaatc
2341  ccagctacac ctgaggctga ggcaggagaa ttgcttgaac cggggagacg gaggttgcag
2401  tgagccgagt ttgggccact gcactctagc ctggcaacag agcaagactc cgtctcaaaa
2461  aaagggcaat aaatgccctc tctgaatgtt tgaactgcca agaaaaggca tggagacagc
2521  gaactagaag aaagggcaag aaggaaatag ccaccgtcta cagatggctt agttaagtca
2581  tccacagccc aagggcgggg ctatgccttg tctgggtacc ctgtagagtc actgaccctg
2641  gagcggctct cctgagaggt gctgcaggca aagtgagact gacacctcac tgaggaaggg
2701  agacatattc ttggagaact ttccatctgc ttgtattttc catacacatc cccagccaga
2761  agttagtgtc cgaagaccga atttttatttt acagagcttg aaaactcact tcaatgaaca
2821  aagggattct ccaggattcc aaagttttga agtcatctta gctttccaca ggagggagag
2881  aacttaaaaa agcaacagta gcagggaatt gatccacttc ttaatgcttt cctccctggc
2941  atgaccatcc tgtcctttgt tattatcctg cattttacgt ctttggagga acagctccct
3001  agtggcttcc tccgtctgca atgtcccttg cacagcccac acatgaacca tccttcccat
3061  gatgccgctc ttctgtcatc ccgctcctgc tgaaacacct cccaggggct ccacctgttc
3121  aggagctgaa gcccatgctt tcccaccagc atgtcactcc cagaccacct ccctgccctg
3181  tcctccagct tcccctcgct gtcctgctgt gtgaattccc aggttggcct ggtggccatg
3241  tcgcctgccc ccagcactcc tctgtctctg ctcttgcctg caccttcct cctcctttgc
3301  ctaggaggcc ttctcgcatt ttctctagct gatcagaatt ttaccaaaat tcagaacatc
3361  ctccaattcc acagtctctg ggagactttc cctaagaggc gacttcctct ccagccttct
3421  ctctctggtc aggcccactg cagagatggt ggtgagcaca tctgggaggc tggtctccct
3481  ccagctggaa ttgctgctct ctgagggaga ggctgtggtg gctgtctctg tccctcactg
3541  ccttccagga gcaatttgca catgtaacat agatttatgt aatgctttat gtttaaaaac
3601  attccccaat tatcttattt aattttttgca attattctaa ttttatatat agagaaagtg
3661  acctatttt taaaaaaatc acactctaag ttctattgaa cctaggactt gagcctccat
3721  ttctggcttc tagtctggtg ttctgagtac ttgatttcag gtcaataacg gtcccccctc
3781  actccacact ggcacgtttg tgagaagaaa tgacattttg ctaggaagtg accgagtcta
3841  ggaatgcttt tattcaagac accaaattcc aaacttctaa atgttggaat tttcaaaaat
3901  tgtgtttaga ttttatgaaa aactcttcta ctttcatcta ttctttccct agaggcaaac
3961  atttcttaaa atgtttcatt ttcattaaaa atgaaagcca aatttatatg ccaccgattg
4021  caggacacaa gcacagtttt aagagttgta tgaacatgga gaggacttt ggttttata
4081  tttctcgtat ttaatatggg tgaacaccaa cttttatttg gaataataat tttcctccta
4141  aacaaaaaca cattgagttt aagtctctga ctcttgcctt tccacctgct ttctcctggg
4201  cccgctttgc ctgcttgaag gaacagtgct gttctggagc tgctgttcca acagacaggg
4261  cctagctttc atttgacaca cagactacag ccagaagccc atggagcagg atgtcacgt
4321  cttgaaaagc ctattagatg ttttacaaat ttaattttgc agattatttt agtctgtcat
```

-continued

```
4381 ccagaaaatg tgtcagcatg catagtgcta agaaagcaag ccaatttgga aacttaggtt
4441 agtgacaaaa ttggccagag agtgggggtg atgatgacca agaattacaa gtagaatggc
4501 agctggaatt taaggaggga caagaatcaa tggataagcg tgggtggagg aagatccaaa
4561 cagaaaagtg caaagttatt ccccatcttc caagggttga attctggagg aagaagacac
4621 attcctagtt ccccgtgaac ttcctttgac ttattgtccc cactaaaaca aacaaaaaa
4681 cttttaatgc cttccacatt aattagattt tcttgcagtt tttttatggc attttttta
4741 agatgcccta agtgttgaag aagagtttgc aaatgcaaca aaatatttaa ttaccggttg
4801 ttaaaactgg tttagcacaa tttatatttt ccctctcttg cctttcttat ttgcaataaa
4861 aggtattgag ccatttttta aatgacattt ttgataaatt atgtttgtac tagttgatga
4921 aggagttttt tttaacctgt ttatataatt ttgcagcaga agccaaattt tttgtatatt
4981 aaagcaccaa attcatgtac agcatgcatc acggatcaat agactgtact tattttccaa
5041 taaaattttc aaactttgta ctgttaaaaa aaaaaaaaaa aaa
```

Human IL-1R1 mRNA Variant 4

(SEQ ID NO: 107)

```
   1 attaaagccc taagaggctg tgacacagcc atctccaaaa ccccactttc tccttccttt
  61 gagcctccgt accagctggg gcgtccggca agatgtgagt tgtcactctg ctgcggcaca
 121 gacctgaatt aacaactcta gctagggctg acttcaaaaa gcactttcgt tttttaataa
 181 ccaacatcag ctcagcaggc ttcatttggg aaaagaaacc ttgtcggatt accccgacat
 241 tctccacctc ctgggaggcc agccattccc aaatgcccca aggatgaaga acggagacgg
 301 tagacgcacc ctctgaagat ggtgactccc tcctgagaag ctggaccccct tggtaaaaga
 361 caaggccttc tccaagaaga atatgaaagt gttactcaga cttatttgtt tcatagctct
 421 actgatttct tctctggagg ctgataaatg caaggaacgt gaagaaaaaa taattttagt
 481 gtcatctgca aatgaaattg atgttcgtcc ctgtcctctt aacccaaatg aacacaaagg
 541 cactataact tggtataaag atgacagcaa gacacctgta tctacagaac aagcctccag
 601 gattcatcaa cacaaagaga actttggtt tgttcctgct aaggtggagg attcaggaca
 661 ttactattgc gtggtaagaa attcatctta ctgcctcaga attaaaataa gtgcaaaatt
 721 tgtggagaat gagcctaact tatgttataa tgcacaagcc atatttaagc agaaactacc
 781 cgttgcagga gacggaggac ttgtgtgccc ttatatggag tttttaaaa atgaaaataa
 841 tgagttacct aaattacagt ggtataagga ttgcaaacct ctacttcttg acaatataca
 901 ctttagtgga gtcaaagata ggctcatcgt gatgaatgtg gctgaaaagc atagagggaa
 961 ctatacttgt catgcatcct acacatactt gggcaagcaa tatcctatta cccgggtaat
1021 agaatttatt actctagagg aaaacaaacc cacaaggcct gtgattgtga gcccagctaa
1081 tgagacaatg gaagtagact tgggatccca gatacaattg atctgtaatg tcaccggcca
1141 gttgagtgac attgcttact ggaagtggaa tgggtcagta attgatgaag atgacccagt
1201 gctaggggaa gactattaca gtgtggaaaa tcctgcaaac aaaagaagga gtaccctcat
1261 cacagtgctt aatatatcgg aaattgaaag tagattttat aaacatccat ttacctgttt
1321 tgccaagaat acacatggta tagatgcagc atatatccag ttaatatatc cagtcactaa
1381 tttccagaag cacatgattg gtatatgtgt cacgttgaca gtcataattg tgtgttctgt
1441 tttcatctat aaaatcttca agattgacat tgtgctttgg tacagggatt cctgctatga
1501 ttttctccca ataaaagctt cagatggaaa gacctatgac gcatatatac tgtatccaaa
1561 gactgttggg gaagggtcta ccctctgactg tgatattttt gtgtttaaag tcttgcctga
1621 ggtcttggaa aaacagtgtg gatataagct gttcatttat ggaagggatg actacgttgg
```

-continued

```
1681  ggaagacatt gttgaggtca ttaatgaaaa cgtaaagaaa agcagaagac tgattatcat
1741  tttagtcaga gaaacatcag gcttcagctg gctgggtggt tcatctgaag agcaaatagc
1801  catgtataat gctcttgttc aggatggaat taaagttgtc ctgcttgagc tggagaaaat
1861  ccaagactat gagaaaatgc cagaatcgat taaattcatt aagcagaaac atggggctat
1921  ccgctggtca ggggacttta cacagggacc acagtctgca aagacaaggt tctggaagaa
1981  tgtcaggtac cacatgccag tccagcgacg gtcaccttca tctaaacacc agttactgtc
2041  accagccact aaggagaaac tgcaaagaga ggctcacgtg cctctcgggt agcatggaga
2101  agttgccaag agttctttag gtgcctcctg tcttatggcg ttgcaggcca ggtatgcct
2161  catgctgact tgcagagttc atggaatgta actatatcat cctttatccc tgaggtcacc
2221  tggaatcaga ttattaaggg aataagccat gacgtcaata gcagcccagg gcacttcaga
2281  gtagagggct tgggaagatc ttttaaaaag gcagtaggcc cggtgtggtg gctcacgcct
2341  ataatcccag cactttggga ggctgaagtg ggtggatcac cagaggtcag gagttcgaga
2401  ccagcccagc caacatggca aaaccccatc tctactaaaa atacaaaaat gagctaggca
2461  tggtggcaca cgcctgtaat cccagctaca cctgaggctg aggcaggaga attgcttgaa
2521  ccggggagac ggaggttgca gtgagccgag tttgggccac tgcactctag cctggcaaca
2581  gagcaagact ccgtctcaaa aaagggcaa taaatgccct ctctgaatgt ttgaactgcc
2641  aagaaaaggc atggagacag cgaactagaa gaaagggcaa gaaggaaata gccaccgtct
2701  acagatggct tagttaagtc atccacagcc caaggcgggg ctatgcctt gtctggggac
2761  cctgtagagt cactgaccct ggagcggctc tcctgagagg tgctgcaggc aaagtgagac
2821  tgacacctca ctgaggaagg gagacatatt cttggagaac tttccatctg cttgtatttt
2881  ccatacacat ccccagccag aagttagtgt ccgaagaccg aattttattt tacagagctt
2941  gaaaactcac ttcaatgaac aaagggattc tccaggattc caaagttttg aagtcatctt
3001  agctttccac aggagggaga gaacttaaaa aagcaacagt agcagggaat tgatccactt
3061  cttaatgctt tcctccctgg catgaccatc ctgtcctttg ttattatcct gcattttacg
3121  tctttggagg aacagctccc tagtggcttc ctccgtctgc aatgtccctt gcacagccca
3181  cacatgaacc atccttccca tgatgccgct cttctgtcat cccgctcctg ctgaaacacc
3241  tcccaggggc tccacctgtt caggagctga agcccatgct ttcccaccag catgtcactc
3301  ccagaccacc tccctgccct gtcctccagc ttcccctcgc tgtcctgctg tgtgaattcc
3361  caggttggcc tggtggccat gtcgcctgcc cccagcactc ctctgtctct gctcttgcct
3421  gcacccttcc tcctcctttg cctaggaggc cttctcgcat tttctctagc tgatcagaat
3481  tttaccaaaa ttcagaacat cctccaattc cacagtctct gggagacttt ccctaagagg
3541  cgacttcctc tccagccttc tctctctggt caggcccact gcagagatgg tggtgagcac
3601  atctgggagg ctggtctccc tccagctgga attgctgctc tctgagggag aggctgtggt
3661  ggctgtctct gtccctcact gccttccagg agcaatttgc acatgtaaca tagatttatg
3721  taatgcttta tgtttaaaaa cattccccaa ttatcttatt taattttttgc aattattcta
3781  attttatata tagagaaagt gacctatttt ttaaaaaaat cacactctaa gttctattga
3841  acctaggact tgagcctcca tttctggctt ctagtctggt gttctgagta cttgatttca
3901  ggtcaataac ggtcccccct cactccacac tggcacgttt gtgagaagaa atgacatttt
3961  gctaggaagt gaccgagtct aggaatgctt ttattcaaga caccaaattc caaacttcta
4021  aatgttggaa ttttcaaaaa ttgtgtttag attttatgaa aaactcttct actttcatct
```

-continued

```
4081 attctttccc tagaggcaaa catttcttaa aatgtttcat ttcattaaa aatgaaagcc 4141 aaatttatat gccaccgatt gcaggacaca agcacagttt taagagttgt atgaacatgg 4201 agaggacttt tggtttttat atttctcgta tttaatatgg gtgaacacca acttttattt 4261 ggaataataa ttttcctcct aaacaaaaac acattgagtt taagtctctg actcttgcct 4321 ttccacctgc tttctcctgg gcccgctttg cctgcttgaa ggaacagtgc tgttctggag 4381 ctgctgttcc aacagacagg gcctagcttt catttgacac acagactaca gccagaagcc 4441 catggagcag ggatgtcacg tcttgaaaag cctattagat gttttacaaa tttaattttg 4501 cagattattt tagtctgtca tccagaaaat gtgtcagcat gcatagtgct aagaaagcaa 4561 gccaatttgg aaacttaggt tagtgacaaa attggccaga gagtgggggt gatgatgacc 4621 aagaattaca agtagaatgg cagctggaat ttaaggaggg acaagaatca atggataagc 4681 gtgggtggag gaagatccaa acagaaaagt gcaaagttat tccccatctt ccaagggttg 4741 aattctggag gaagaagaca cattcctagt tccccgtgaa cttcctttga cttattgtcc 4801 ccactaaaac aaaacaaaaa acttttaatg ccttccacat taattagatt ttcttgcagt 4861 ttttttatgg cattttttta aagatgccct aagtgttgaa gaagagtttg caaatgcaac 4921 aaaatattta attaccggtt gttaaaactg gtttagcaca atttatattt tccctctctt 4981 gcctttctta tttgcaataa aaggtattga gccattttttt aaatgacatt tttgataaat 5041 tatgtttgta ctagttgatg aaggagtttt ttttaacctg tttatataat tttgcagcag 5101 aagccaaatt ttttgtatat taaagcacca aattcatgta cagcatgcat cacggatcaa 5161 tagactgtac ttattttcca ataaaatttt caaactttgt actgttaaaa aaaaaaaaa 5221 aaaa
```

Human IL-1R1 mRNA Variant 5

(SEQ ID NO: 108)

```
   1 aggatggccc atgaagacct ccaaacaagc tggagggggcc agtcacttgc tgaagactag 61 cgaagtggag gggaaagcc cgagggagct gcagactcga ccactgcgcc ctcccctcct 121 ctccctgcaa ggagcccaag gtagacgcac cctctgaaga tggtgactcc ctcctgagaa 181 gctggacccc ttggtaaaag acaaggcctt ctccaagaag aatatgaaag tgttactcag 241 acttatttgt ttcatagctc tactgatttc ttctctggag gctgataaat gcaaggaacg 301 tgaagaaaaa ataattttag tgtcatctgc aaatgaaatt gatgttcgtc cctgtcctct 361 taacccaaat gaacacaaag gcactataac ttggtataaa gatgacagca agacacctgt 421 atctcagaa caagcctcca ggattcatca acacaaagag aaactttggt ttgttcctgc 481 taaggtggag gattcaggac attactattg cgtggtaaga aattcatctt actgcctcag 541 aattaaaata agtgcaaaat ttgtggagaa tgagcctaac ttatgttata atgcacaagc 601 catatttaag cagaaactac ccgttgcagg agacggagga cttgtgtgcc cttatatgga 661 gttttttaaa aatgaaaata atgagttacc taaattacag tggtataagg attgcaaacc 721 tctacttctt gacaatatac actttagtgg agtcaaagat aggctcatcg tgatgaatgt 781 ggctgaaaag catagaggga actatacttg tcatgcatcc tacacatact gggcaagca 841 atatcctatt acccgggtaa tagaatttat tactctagag gaaaacaaac ccacaaggcc 901 tgtgattgtg agcccagcta atgagacaat ggaagtagac ttgggatccc agatacaatt 961 gatctgtaat gtcaccggcc agttgagtga cattgcttac tggaagtgga atgggtcagt 1021 aattgatgaa gatgacccag tgctagggga agactattac agtgtggaaa atcctgcaaa 1081 caaaagaagg agtaccctca tcacagtgct aatatatcg gaaattgaaa gtagatttta 1141 taaacatcca tttacctgtt ttgccaagaa tacacatggt atagatgcag catatatcca
```

-continued

```
1201 gttaatatat ccagtcacta atttccagaa gcacatgatt ggtatatgtg tcacgttgac
1261 agtcataatt gtgtgttctg ttttcatcta taaaatcttc aagattgaca ttgtgctttg
1321 gtacagggat tcctgctatg attttctccc aataaaagct tcagatggaa agacctatga
1381 cgcatatata ctgtatccaa agactgttgg ggaagggtct acctctgact gtgatatttt
1441 tgtgtttaaa gtcttgcctg aggtcttgga aaaacagtgt ggatataagc tgttcattta
1501 tggaagggat gactacgttg gggaagacat tgttgaggtc attaatgaaa acgtaaagaa
1561 aagcagaaga ctgattatca ttttagtcag agaaacatca ggcttcagct ggctgggtgg
1621 ttcatctgaa gagcaaatag ccatgtataa tgctcttgtt caggatggaa ttaaagttgt
1681 cctgcttgag ctggagaaaa tccaagacta tgagaaaatg ccagaatcga ttaaattcat
1741 taagcagaaa catggggcta tccgctggtc aggggacttt acacagggac cacagtctgc
1801 aaagacaagg ttctggaaga atgtcaggta ccacatgcca gtccagcgac ggtcaccttc
1861 atctaaacac cagttactgt caccagccac taaggagaaa ctgcaaagag aggctcacgt
1921 gcctctcggg tagcatggag aagttgccaa gagttcttta ggtgcctcct gtcttatggc
1981 gttgcaggcc aggttatgcc tcatgctgac ttgcagagtt catggaatgt aactatatca
2041 tcctttatcc ctgaggtcac ctggaatcag attattaagg gaataagcca tgacgtcaat
2101 agcagcccag ggcacttcag agtagagggc ttgggaagat cttttaaaaa ggcagtaggc
2161 ccggtgtggt ggctcacgcc tataatccca gcactttggg aggctgaagt gggtggatca
2221 ccagaggtca ggagttcgag accagcccag ccaacatggc aaaaccccat ctctactaaa
2281 aatacaaaaa tgagctaggc atggtggcac acgcctgtaa tcccagctac acctgaggct
2341 gaggcaggag aattgcttga accggggaga cggaggttgc agtgagccga gtttgggcca
2401 ctgcactcta gcctggcaac agagcaagac tccgtctcaa aaaagggca ataaatgccc
2461 tctctgaatg tttgaactgc caagaaaagg catggagaca gcgaactaga agaaagggca
2521 agaaggaaat agccaccgtc tacagatggc ttagttaagt catccacagc ccaagggcgg
2581 ggctatgcct tgtctgggga ccctgtagag tcactgaccc tggagcggct ctcctgagag
2641 gtgctgcagg caaagtgaga ctgacacctc actgaggaag ggagacatat tcttggagaa
2701 ctttccatct gcttgtattt tccatacaca tccccagcca gaagttagtg tccgaagacc
2761 gaattttatt ttacagagct tgaaaactca cttcaatgaa caaagggatt ctccaggatt
2821 ccaaagtttt gaagtcatct tagctttcca caggagggag agaacttaaa aaagcaacag
2881 tagcagggaa ttgatccact tcttaatgct ttcctccctg gcatgaccat cctgtccttt
2941 gttattatcc tgcattttac gtctttggag gaacagctcc ctagtggctt cctccgtctg
3001 caatgtccct tgcacagccc acacatgaac catccttccc atgatgccgc tcttctgtca
3061 tcccgctcct gctgaaacac ctcccagggg ctccacctgt tcaggagctg aagcccatgc
3121 tttcccacca gcatgtcact cccagaccac ctccctgccc tgtcctccag cttcccctcg
3181 ctgtcctgct gtgtgaattc ccaggttggc ctggtggcca tgtcgcctgc ccccagcact
3241 cctctgtctc tgctcttgcc tgcacccttc ctcctccttt gcctaggagg ccttctcgca
3301 ttttctctag ctgatcagaa ttttaccaaa attcagaaca tcctccaatt ccacagtctc
3361 tgggagactt tccctaagag gcgacttcct ctccagcctt ctctctctgg tcaggcccac
3421 tgcagagatg gtggtgagca catctgggag gctggtctcc ctccagctgg aattgctgct
3481 ctctgaggga gaggctgtgg tggctgtctc tgtccctcac tgccttccag gagcaatttg
3541 cacacatgtaac atagatttat gtaatgcttt atgtttaaaa acattcccca attatcttat
```

```
3601 ttaattttg caattattct aattttatat atagagaaag tgacctattt tttaaaaaaa
3661 tcacactcta agttctattg aacctaggac ttgagcctcc atttctggct tctagtctgg
3721 tgttctgagt acttgatttc aggtcaataa cggtccccccc tcactccaca ctggcacgtt
3781 tgtgagaaga aatgacattt tgctaggaag tgaccgagtc taggaatgct tttattcaag
3841 acaccaaatt ccaaacttct aaatgttgga attttcaaaa attgtgttta gattttatga
3901 aaaactcttc tactttcatc tattctttcc ctagaggcaa acatttctta aaatgtttca
3961 ttttcattaa aaatgaaagc caaatttata tgccaccgat tgcaggacac aagcacagtt
4021 ttaagagttg tatgaacatg gagaggactt ttggtttta tatttctcgt atttaatatg
4081 ggtgaacacc aacttttatt tggaataata attttcctcc taaacaaaaa cacattgagt
4141 ttaagtctct gactcttgcc tttccacctg ctttctcctg ggcccgcttt gcctgcttga
4201 aggaacagtg ctgttctgga gctgctgttc caacagacag ggcctagctt tcatttgaca
4261 cacagactac agccagaagc ccatggagca gggatgtcac gtcttgaaaa gcctattaga
4321 tgttttacaa atttaatttt gcagattatt ttagtctgtc atccagaaaa tgtgtcagca
4381 tgcatagtgc taagaaagca agccaatttg gaaacttagg ttagtgacaa aattggccag
4441 agagtggggg tgatgatgac caagaattac aagtagaatg gcagctgaa tttaaggagg
4501 gacaagaatc aatggataag cgtgggtgga ggaagatcca aacagaaaag tgcaaagtta
4561 ttccccatct tccaagggtt gaattctgga ggaagaagac acattcctag ttccccgtga
4621 acttcctttg acttattgtc cccactaaaa caaaacaaaa aacttttaat gccttccaca
4681 ttaattagat tttcttgcag tttttttatg gcattttttt aaagatgccc taagtgttga
4741 agaagagttt gcaaatgcaa caaaatattt aattaccggt tgttaaaact ggtttagcac
4801 aatttatatt ttccctctct tgcctttctt atttgcaata aaaggtattg agccattttt
4861 taaatgacat ttttgataaa ttatgtttgt actagttgat gaaggagttt tttttaacct
4921 gtttatataa ttttgcagca gaagccaaat ttttttgtata ttaaagcacc aaattcatgt
4981 acagcatgca tcacggatca atagactgta cttattttcc aataaaattt tcaaactttg
5041 tactgttaaa aaaaaaaaaa aaaaa
```

Human IL-1R1 mRNA Variant 6

(SEQ ID NO: 109)

```
  1 ctgatgccct ggagtcgcca actcaattcg cgggtcgcag ccaggctcca tgggggtagt
 61 agagccaggt cgtagtggct aggtagacgc accctctgaa gatggtgact ccctcctgag
121 aagctggacc ccttggtaaa agacaaggcc ttctccaaga gaatatgaa agtgttactc
181 agacttattt gtttcatagc tctactgatt tcttctctgg aggctgataa atgcaaggaa
241 cgtgaagaaa aaataatttt agtgtcatct gcaaatgaaa ttgatgttcg tccctgtcct
301 cttaacccaa atgaacacaa aggcactata acttggtata aagatgacag caagacacct
361 gtatctacag aacaagcctc caggattcat caacacaaag agaaactttg gtttgttcct
421 gctaaggtgg aggattcagg acattactat tgcgtggtaa gaaattcatc ttactgcctc
481 agaattaaaa taagtgcaaa atttgtggag aatgagccta acttatgtta taatgcacaa
541 gccatattta agcagaaact acccgttgca ggagacggag gacttgtgtg ccccttatatg
601 gagtttttta aaaatgaaaa taatgagtta cctaaattac agtggtataa ggattgcaaa
661 cctctacttc ttgacaatat acactttagt ggagtcaaag ataggctcat cgtgatgaat
721 gtggctgaaa agcatagagg gaactatact tgtcatgcat cctacacata cttgggcaag
781 caatatcta ttacccgggt aatagaattt attactctag aggaaaacaa acccacaagg
841 cctgtgattg tgagcccagc taatgagaca atggaagtag acttgggatc ccagatacaa
```

-continued

```
 901 ttgatctgta atgtcaccgg ccagttgagt gacattgctt actggaagtg gaatgggtca
 961 gtaattgatg aagatgaccc agtgctaggg aagactatt acagtgtgga aaatcctgca
1021 aacaaaagaa ggagtaccct catcacagtg cttaatatat cggaaattga agtagattt
1081 tataaacatc catttacctg ttttgccaag aatacacatg gtatagatgc agcatatatc
1141 cagttaatat atccagtcac taatttccag aagcacatga ttggtatatg tgtcacgttg
1201 acagtcataa ttgtgtgttc tgttttcatc tataaaatct tcaagattga cattgtgctt
1261 tggtacaggg attcctgcta tgattttctc ccaataaaag cttcagatgg aaagacctat
1321 gacgcatata tactgtatcc aaagactgtt ggggaagggt ctacctctga ctgtgatatt
1381 tttgtgttta aagtcttgcc tgaggtcttg gaaaaacagt gtggatataa gctgttcatt
1441 tatggaaggg atgactacgt tggggaagac attgttgagg tcattaatga aaacgtaaag
1501 aaaagcagaa gactgattat cattttagtc agagaaacat caggcttcag ctggctgggt
1561 ggttcatctg aagagcaaat agccatgtat aatgctcttg ttcaggatgg aattaaagtt
1621 gtcctgcttg agctggagaa aatccaagac tatgagaaaa tgccagaatc gattaaattc
1681 attaagcaga acatggggc tatccgctgg tcaggggact ttacacaggg accacagtct
1741 gcaaagacaa ggttctggaa gaatgtcagg taccacatgc cagtccagcg acggtcacct
1801 tcatctaaac accagttact gtcaccagcc actaaggaga aactgcaaag agaggctcac
1861 gtgcctctcg ggtagcatgg agaagttgcc aagagttctt taggtgcctc ctgtcttatg
1921 gcgttgcagg ccaggttatg cctcatgctg acttgcagag ttcatggaat gtaactatat
1981 catcctttat ccctgaggtc acctggaatc agattattaa gggaataagc catgacgtca
2041 atagcagccc agggcacttc agagtagagg gcttgggaag atcttttaaa aaggcagtag
2101 gcccggtgtg gtggctcacg cctataatcc cagcactttg ggaggctgaa gtgggtggat
2161 caccagaggt caggagttcg agaccagccc agccaacatg gcaaaacccc atctctacta
2221 aaaatacaaa aatgagctag gcatggtggc acacgcctgt aatcccagct cacctgagg
2281 ctgaggcagg agaattgctt gaaccgggga gacggaggtt gcagtgagcc gagtttgggc
2341 cactgcactc tagcctggca acagagcaag actccgtctc aaaaaaaggg caataaatgc
2401 cctctctgaa tgtttgaact gccaagaaaa ggcatggaga cagcgaacta gaagaaaggg
2461 caagaaggaa atagccaccg tctacagatg gcttagttaa gtcatccaca gcccaagggc
2521 ggggctatgc cttgtctggg gaccctgtag agtcactgac cctggagcgg ctctcctgag
2581 aggtgctgca ggcaaagtga gactgacacc tcactgagga agggagacat attcttggag
2641 aactttccat ctgcttgtat tttccataca catccccagc cagaagttag tgtccgaaga
2701 ccgaattta ttttacagag cttgaaaact cacttcaatg aacaaaggga ttctccagga
2761 ttccaaagtt ttgaagtcat cttagctttc cacaggaggg agagaactta aaaaagcaac
2821 agtagcaggg aattgatcca cttcttaatg ctttcctccc tggcatgacc atcctgtcct
2881 ttgttattat cctgcatttt acgtctttgg aggaacagct ccctagtggc ttcctccgtc
2941 tgcaatgtcc cttgcacagc ccacacatga accatccttc ccatgatgcc gctcttctgt
3001 catcccgctc tgctgaaac acctcccagg ggctccacct gttcaggagc tgaagcccat
3061 gctttcccac cagcatgtca ctcccagacc acctccctgc cctgtcctcc agcttcccct
3121 cgctgtcctg ctgtgtgaat tccaggttg gcctggtggc catgtcgcct gcccccagca
3181 ctcctctgtc tctgctcttg cctgcaccct tcctcctcct ttgcctagga ggccttctcg
3241 cattttctct agctgatcag aattttacca aaattcagaa catcctccaa ttccacagtc
```

-continued

```
3301 tctgggagac tttccctaag aggcgacttc ctctccagcc ttctctctct ggtcaggccc
3361 actgcagaga tggtggtgag cacatctggg aggctggtct ccctccagct ggaattgctg
3421 ctctctgagg gagaggctgt ggtggctgtc tctgtccctc actgccttcc aggagcaatt
3481 tgcacatgta acatagattt atgtaatgct ttatgtttaa aaacattccc caattatctt
3541 atttaatttt tgcaattatt ctaatttat atatagagaa agtgacctat ttttaaaaa
3601 aatcacactc taagttctat tgaacctagg acttgagcct ccatttctgg cttctagtct
3661 ggtgttctga gtacttgatt tcaggtcaat aacggtcccc cctcactcca cactggcacg
3721 tttgtgagaa gaaatgacat tttgctagga agtgaccgag tctaggaatg ctttattca
3781 agacaccaaa ttccaaactt ctaaatgttg gaattttcaa aaattgtgtt tagattttat
3841 gaaaaactct tctactttca tctattcttt ccctagaggc aaacatttct taaaatgttt
3901 catttcatt aaaaatgaaa gccaaattta tatgccaccg attgcaggac acaagcacag
3961 ttttaagagt tgtatgaaca tggagaggac ttttggtttt tatatttctc gtatttaata
4021 tgggtgaaca ccaacttta tttggaataa taattttcct cctaaacaaa aacacattga
4081 gtttaagtct ctgactcttg cctttccacc tgctttctcc tgggcccgct ttgcctgctt
4141 gaaggaacag tgctgttctg gagctgctgt tccaacagac agggcctagc tttcatttga
4201 cacacagact acagccagaa gcccatggag cagggatgtc acgtcttgaa aagcctatta
4261 gatgttttac aaatttaatt ttgcagatta ttttagtctg tcatccagaa aatgtgtcag
4321 catgcatagt gctaagaaag caagccaatt tggaaactta ggttagtgac aaaattggcc
4381 agagagtggg ggtgatgatg accaagaatt acaagtagaa tggcagctga aatttaagga
4441 gggacaagaa tcaatggata agcgtgggtg gaggaagatc caaacagaaa agtgcaaagt
4501 tattccccat cttccaaggg ttgaattctg gaggaagaag acacattcct agttccccgt
4561 gaacttcctt tgacttattg tccccactaa aacaaaacaa aaaacttta atgccttcca
4621 cattaattag atttcttgc agttttttta tggcatttt ttaaagatgc cctaagtgtt
4681 gaagaagagt ttgcaaatgc aacaaaatat ttaattaccg gttgttaaaa ctggtttagc
4741 acaatttata ttttccctct cttgcctttc ttatttgcaa taaaaggtat tgagccattt
4801 tttaaatgac attttgata aattatgttt gtactagttg atgaaggagt tttttttaac
4861 ctgtttatat aattttgcag cagaagccaa attttttgta tattaaagca ccaaattcat
4921 gtacagcatg catcacggat caatagactg tacttatttt ccaataaaat tttcaaactt
4981 tgtactgtta aaaaaaaaaa aaaaaaa
```

Human IL-1R1 mRNA Variant 7

(SEQ ID NO: 110)

```
  1 gtagacgcac cctctgaaga tggtgactcc ctcctgagaa gctggacccc ttggtaaaag
 61 acaaggcctt ctccaagata aatgcaagga acgtgaagaa aaataatttt tagtgtcatc
121 tgcaaatgaa attgatgttc gtccctgtcc tcttaaccca atgaacacaa aaggcactat
181 aacttggtat aaagatgaca gcaagacacc tgtatctaca gaacaagcct ccaggattca
241 tcaacacaaa gagaaacttt ggtttgttcc tgctaaggtg gaggattcag acattacta
301 ttgcgtggta agaaattcat cttactgcct cagaattaaa ataagtgcaa aatttgtgga
361 gaatgagcct aacttatgtt ataatgcaca agccatattt aagcagaaac tacccgttgc
421 aggagacgga ggactgtgt gcccttatat ggagtttttt aaaaatgaaa ataatgagtt
481 acctaaatta cagtggtata aggattgcaa acctctactt cttgacaata tacactttag
541 tggagtcaaa gataggctca tcgtgatgaa tgtggctgaa aagcatagag ggaactatac
601 ttgtcatgca tcctacacat acttgggcaa gcaatatcct attacccggg taatagaatt
```

-continued

```
 661 tattactcta gaggaaaaca aacccacaag gcctgtgatt gtgagcccag ctaatgagac
 721 aatggaagta gacttgggat cccagataca attgatctgt aatgtcaccg gccagttgag
 781 tgacattgct tactggaagt ggaatgggtc agtaattgat gaagatgacc cagtgctagg
 841 ggaagactat tacagtgtgg aaaatcctgc aaacaaaaga aggagtaccc tcatcacagt
 901 gcttaatata tcggaaattg aaagtagatt ttataaacat ccatttacct gttttgccaa
 961 gaatacacat ggtatagatg cagcatatat ccagttaata tatccagtca ctaatttcca
1021 gaagcacatg attggtatat gtgtcacgtt gacagtcata attgtgtgtt ctgttttcat
1081 ctataaaatc ttcaagattg acattgtgct ttggtacagg gattcctgct atgattttct
1141 cccaataaaa gcttcagatg gaaagaccta tgacgcatat atactgtatc caaagactgt
1201 tggggaaggg tctacctctg actgtgatat ttttgtgttt aaagtcttgc ctgaggtctt
1261 ggaaaaacag tgtggatata agctgttcat ttatggaagg gatgactacg ttggggaaga
1321 cattgttgag gtcattaatg aaaacgtaaa gaaaagcaga agactgatta tcattttagt
1381 cagagaaaca tcaggcttca gctggctggg tggttcatct gaagagcaaa tagccatgta
1441 taatgctctt gttcaggatg gaattaaagt tgtcctgctt gagctggaga aaatccaaga
1501 ctatgagaaa atgccagaat cgattaaatt cattaagcag aaacatgggg ctatccgctg
1561 gtcagggggac tttacacagg gaccacagtc tgcaaagaca aggttctgga agaatgtcag
1621 gtaccacatg ccagtccagc gacggtcacc ttcatctaaa caccagttac tgtcaccagc
1681 cactaaggag aaactgcaaa gagaggctca cgtgcctctc gggtagcatg gagaagttgc
1741 caagagttct ttaggtgcct cctgtcttat ggcgttgcag gccaggttat gcctcatgct
1801 gacttgcaga gttcatggaa tgtaactata tcatccttta tccctgaggt cacctggaat
1861 cagattatta agggaataag ccatgacgtc aatagcagcc cagggcactt cagagtagag
1921 ggcttgggaa gatcttttaa aaaggcagta ggcccggtgt ggtggctcac gcctataatc
1981 ccagcacttt gggaggctga agtgggtgga tcaccagagg tcaggagttc gagaccagcc
2041 cagccaacat ggcaaaaccc catctctact aaaaatacaa aaatgagcta ggcatggtgg
2101 cacacgcctg taatcccagc tacacctgag gctgaggcag gagaattgct tgaaccgggg
2161 agacggaggt tgcagtgagc cgagtttggg ccactgcact ctagcctggc aacagagcaa
2221 gactccgtct caaaaaaagg gcaataaatg ccctctctga atgtttgaac tgccaagaaa
2281 aggcatggag acagcgaact agaagaaagg gcaagaagga aatagccacc gtctacagat
2341 ggcttagtta agtcatccac agcccaaggg cggggctatg ccttgtctgg ggaccctgta
2401 gagtcactga ccctggagcg gctctcctga gaggtgctgc aggcaaagtg agactgacac
2461 ctcactgagg aagggagaca tattcttgga gaactttcca tctgcttgta ttttccatac
2521 acatccccag ccagaagtta gtgtccgaag accgaatttt attttacaga gcttgaaaac
2581 tcacttcaat gaacaaaggg attctccagg attccaaagt tttgaagtca tcttagcttt
2641 ccacaggagg gagagaactt aaaaaagcaa cagtagcagg gaattgatcc acttcttaat
2701 gctttcctcc ctggcatgac catcctgtcc tttgttatta tcctgcattt tacgtctttg
2761 gaggaacagc tccctagtgg cttcctccgt ctgcaatgtc ccttgcacag cccacacatg
2821 aaccatcctt cccatgatgc cgctcttctg tcatcccgct cctgctgaaa cacctcccag
2881 gggctccacc tgttcaggag ctgaagccca tgctttccca ccagcatgtc actcccagac
2941 cacctccctg ccctgtcctc cagcttcccc tcgctgtcct gctgtgtgaa ttcccaggtt
3001 ggcctggtgg ccatgtcgcc tgcccccagc actcctctgt ctctgctctt gcctgcaccc
```

-continued

```
3061 ttcctcctcc tttgcctagg aggccttctc gcattttctc tagctgatca gaattttacc 3121 aaaattcaga acatcctcca attccacagt ctctgggaga ctttccctaa gaggcgactt 3181 cctctccagc cttctctctc tggtcaggcc cactgcagag atggtggtga gcacatctgg 3241 gaggctggtc tccctccagc tggaattgct gctctctgag ggagaggctg tggtggctgt 3301 ctctgtccct cactgccttc caggagcaat ttgcacatgt aacatagatt tatgtaatgc 3361 tttatgttta aaaacattcc ccaattatct tatttaattt ttgcaattat tctaatttta 3421 tatatagaga aagtgaccta tttttaaaa aaatcacact ctaagttcta ttgaacctag 3481 gacttgagcc tccatttctg gcttctagtc tggtgttctg agtacttgat tcaggtcaa 3541 taacggtccc ccctcactcc acactggcac gtttgtgaga agaaatgaca ttttgctagg 3601 aagtgaccga gtctaggaat gctttattc aagacaccaa attccaaact tctaaatgtt 3661 ggaattttca aaaattgtgt ttagatttta tgaaaaactc ttctactttc atctattctt 3721 tccctagagg caaacatttc ttaaaatgtt tcattttcat taaaaatgaa agccaaattt 3781 atatgccacc gattgcagga cacaagcaca gttttaagag ttgtatgaac atggagagga 3841 cttttggttt ttatatttct cgtatttaat atgggtgaac accaactttt atttggaata 3901 ataattttcc tcctaaacaa aaacacattg agtttaagtc tctgactctt gcctttccac 3961 ctgctttctc ctgggcccgc tttgcctgct tgaaggaaca gtgctgttct ggagctgctg 4021 ttccaacaga cagggcctag ctttcatttg acacacagac tacagccaga agcccatgga 4081 gcagggatgt cacgtcttga aaagcctatt agatgtttta caaatttaat tttgcagatt 4141 attttagtct gtcatccaga aaatgtgtca gcatgcatag tgctaagaaa gcaagccaat 4201 ttggaaactt aggttagtga caaaattggc cagagagtgg gggtgatgat gaccaagaat 4261 tacaagtaga atggcagctg gaatttaagg agggacaaga atcaatggat aagcgtgggt 4321 ggaggaagat ccaaacagaa aagtgcaaag ttattcccca tcttccaagg gttgaattct 4381 ggaggaagaa gacacattcc tagttccccg tgaacttcct ttgacttatt gtccccacta 4441 aaacaaaaca aaaaactttt aatgccttcc acattaatta gattttcttg cagttttttt 4501 atggcatttt tttaaagatg ccctaagtgt tgaagaagag tttgcaaatg caacaaaata 4561 tttaattacc ggttgttaaa actggtttag cacaatttat attttccctc tcttgccttt 4621 cttatttgca ataaaaggta ttgagccatt ttttaaatga catttttgat aaattatgtt 4681 tgtactagtt gatgaaggag tttttttaa cctgtttata taattttgca gcagaagcca 4741 aatttttgt atattaaagc accaaattca tgtacagcat gcatcacgga tcaatagact 4801 gtacttattt tccaataaaa ttttcaaact ttgtactgtt aaaaaaaaaa aaaaaaa
```

Human IL-1R1 mRNA Variant 8

(SEQ ID NO: 111)

```
  1 gtagacgcac cctctgaaga tggtgactcc ctcctgagaa gctggacccc ttggtaaaag 61 acaaggcctt ctccaagaag aatatgaaag tgttactcag acttatttgt ttcatagctc 121 tactgatttc ttctctggag gctgataaat gcaaggaacg tgaagaaaaa ataattttag 181 tgtcatctgc aaatgaaatt gatgttcgtc cctgtcctct taacccaaat gaacacaaag 241 gcactataac ttggtataaa gatgacagca agacacctgt atctacagaa caagcctcca 301 ggattcatca acacaaagag aaactttggt tgttcctgc taaggtggag gattcaggac 361 attactattg cgtggtaagg attgcaaacc tctacttctt gacaatatac acttagtgg 421 agtcaaagat aggctcatcg tgatgaatgt ggctgaaaag catagaggga actatacttg 481 tcatgcatcc tacacatact tgggcaagca atatcctatt acccgggtaa tagaatttat 541 tactctagag gaaaacaaac ccacaaggcc tgtgattgtg agcccagcta atgagacaat
```

-continued

```
 601 ggaagtagac ttgggatccc agatacaatt gatctgtaat gtcaccggcc agttgagtga
 661 cattgcttac tggaagtgga atgggtcagt aattgatgaa gatgacccag tgctagggga
 721 agactattac agtgtggaaa atcctgcaaa caaaagaagg agtaccctca tcacagtgct
 781 taatatatcg gaaattgaaa gtagatttta taaacatcca tttacctgtt ttgccaagaa
 841 tacacatggt atagatgcag catatatcca gttaatatat ccagtcacta atttccagaa
 901 gcacatgatt ggtatatgtg tcacgttgac agtcataatt gtgtgttctg ttttcatcta
 961 taaaatcttc aagattgaca ttgtgctttg gtacagggat tcctgctatg attttctccc
1021 aataaaagct tcagatggaa agacctatga cgcatatata ctgtatccaa agactgttgg
1081 ggaagggtct acctctgact gtgatatttt tgtgtttaaa gtcttgcctg aggtcttgga
1141 aaaacagtgt ggatataagc tgttcattta tggaagggat gactacgttg gggaagacat
1201 tgttgaggtc attaatgaaa acgtaaagaa aagcagaaga ctgattatca ttttagtcag
1261 agaaacatca ggcttcagct ggctgggtgg ttcatctgaa gagcaaaatag ccatgtataa
1321 tgctcttgtt caggatggaa ttaaagttgt cctgcttgag ctggagaaaa tccaagacta
1381 tgagaaaatg ccagaatcga ttaaattcat taagcagaaa catggggcta tccgctggtc
1441 aggggacttt acacagggac cacagtctgc aaagacaagg ttctggaaga atgtcaggta
1501 ccacatgcca gtccagcgac ggtcaccttc atctaaacac cagttactgt caccagccac
1561 taaggagaaa ctgcaaagag aggctcacgt gcctctcggg tagcatggag aagttgccaa
1621 gagttctttta ggtgcctcct gtcttatggc gttgcaggcc aggttatgcc tcatgctgac
1681 ttgcagagtt catggaatgt aactatatca tcctttatcc ctgaggtcac ctggaatcag
1741 attattaagg gaataagcca tgacgtcaat agcagcccag ggcacttcag agtagagggc
1801 ttgggaagat cttttaaaaa ggcagtaggc ccggtgtggt ggctcacgcc tataatccca
1861 gcactttggg aggctgaagt gggtggatca ccagaggtca ggagttcgag accagcccag
1921 ccaacatggc aaaacccat ctctactaaa aatacaaaaa tgagctaggc atggtggcac
1981 acgcctgtaa tcccagctac acctgaggct gaggcaggag aattgcttga accggggaga
2041 cggaggttgc agtgagccga gtttgggcca ctgcactcta gcctggcaac agagcaagac
2101 tccgtctcaa aaaagggca ataaatgccc tctctgaatg tttgaactgc caagaaaagg
2161 catggagaca gcgaactaga agaagggca agaaggaaat agccaccgtc tacagatggc
2221 ttagttaagt catccacagc ccaagggcgg ggctatgcct tgtctgggga ccctgtagag
2281 tcactgaccc tggagcggct ctcctgagag gtgctgcagg caaagtgaga ctgacacctc
2341 actgaggaag ggagacatat tcttggagaa cttccatct gcttgtattt tccatacaca
2401 tccccagcca gaagttagtg tccgaagacc gaatttatt ttacagagct tgaaaactca
2461 cttcaatgaa caaagggatt ctccaggatt ccaaagtttt gaagtcatct tagctttcca
2521 caggagggag agaacttaaa aaagcaacag tagcagggaa ttgatccact tcttaatgct
2581 ttcctccctg gcatgaccat cctgtccttt gttattatcc tgcattttac gtctttggag
2641 gaacagctcc ctagtggctt cctccgtctg caatgtccct tgcacagccc acacatgaac
2701 catccttccc atgatgccgc tcttctgtca tcccgctcct gctgaaacac ctcccagggg
2761 ctccacctgt tcaggagctg aagcccatgc tttcccacca gcatgtcact cccagaccac
2821 ctccctgccc tgtcctccag cttcccctcg ctgtcctgct gtgtgaattc ccaggttggc
2881 ctggtggcca tgtcgcctgc ccccagcact cctctgtctc tgctcttgcc tgcacccttc
2941 ctcctccttt gcctaggagg ccttctcgca ttttctctag ctgatcagaa ttttaccaaa
```

```
3001 attcagaaca tcctccaatt ccacagtctc tgggagactt tccctaagag gcgacttcct
3061 ctccagcctt ctctctctgg tcaggcccac tgcagagatg gtggtgagca catctgggag
3121 gctggtctcc ctccagctgg aattgctgct ctctgaggga gaggctgtgg tggctgtctc
3181 tgtccctcac tgccttccag gagcaatttg cacatgtaac atagatttat gtaatgcttt
3241 atgtttaaaa acattcccca attatcttat ttaattttg caattattct aattttatat
3301 atagagaaag tgacctattt tttaaaaaaa tcacactcta agttctattg aacctaggac
3361 ttgagcctcc atttctggct tctagtctgg tgttctgagt acttgatttc aggtcaataa
3421 cggtccccc tcactccaca ctggcacgtt tgtgagaaga aatgacattt gctaggaag
3481 tgaccgagtc taggaatgct tttattcaag acaccaaatt ccaaacttct aaatgttgga
3541 atttcaaaa attgtgttta gattttatga aaaactcttc tactttcatc tattctttcc
3601 ctagaggcaa acatttctta aaatgtttca ttttcattaa aaatgaaagc caaatttata
3661 tgccaccgat tgcaggacac aagcacagtt ttaagagttg tatgaacatg gagaggactt
3721 ttggtttta tatttctcgt atttaatatg ggtgaacacc aacttttatt tggaataata
3781 attttcctcc taaacaaaaa cacattgagt ttaagtctct gactcttgcc tttccacctg
3841 ctttctcctg ggcccgcttt gcctgcttga aggaacagtg ctgttctgga gctgctgttc
3901 caacagacag ggcctagctt tcatttgaca cacagactac agccagaagc ccatggagca
3961 gggatgtcac gtcttgaaaa gcctattaga tgttttacaa atttaatttt gcagattatt
4021 ttagtctgtc atccagaaaa tgtgtcagca tgcatagtgc taagaaagca agccaatttg
4081 gaaacttagg ttagtgacaa aattggccag agagtggggg tgatgatgac caagaattac
4141 aagtagaatg gcagctggaa tttaaggagg acaagaatc aatggataag cgtgggtgga
4201 ggaagatcca aacagaaaag tgcaaagtta ttccccatct tccaagggtt gaattctgga
4261 ggaagaagac acattcctag ttccccgtga acttcctttg acttattgtc cccactaaaa
4321 caaaacaaaa aacttttaat gccttccaca ttaattagat tttcttgcag tttttttatg
4381 gcattttttt aaagatgccc taagtgttga agaagagttt gcaaatgcaa caaaatattt
4441 aattaccggt tgttaaaact ggtttagcac aatttatatt ttccctctct tgcctttctt
4501 atttgcaata aaaggtattg agccattttt taaatgacat ttttgataaa ttatgtttgt
4561 actagttgat gaaggagttt ttttaacct gtttatataa ttttgcagca gaagccaaat
4621 tttttgtata ttaaagcacc aaattcatgt acagcatgca tcacggatca atagactgta
4681 cttatttcc aataaaattt tcaaactttg tactgttaaa aaaaaaaaa aaaaa
```

Human IL-1R1 mRNA Variant 9
(SEQ ID NO: 112)

```
  1 gtagacgcac cctctgaaga tggtgactcc ctcctgagaa gctggacccc ttggtaaaag
 61 acaaggcctt ctccaagaag aatatgaaag tgttactcag acttatttgt ttcatagctc
121 tactgatttc ttctctggag gctgataaat gcaaggaacg tgaagaaaaa ataattttag
181 tgtcatctgc aaatgaaatt gatgttcgtc cctgtcctct taacccaaat gaacacaaag
241 gcactataac ttggtataaa gatgacagca agacacctgt atctacagaa caagcctcca
301 ggattcatca acacaaagag aaactttggt tgttcctgc taaggtggag gattcaggac
361 attactattg cgtggtaaga aattcatctt actgcctcag aattaaaata agtgcaaaat
421 ttgtggagaa tgagcctaac ttatgttata atgcacaagc catatttaag cagaaactac
481 ccgttgcagg agacggagga cttgtgtgcc cttatatgga gttttttaaa aatgaaaata
541 atgagttacc taaattacag tggtataagg ggaaaacaaa cccacaaggc ctgtgattgt
601 gagcccagct aatgagacaa tggaagtaga cttgggatcc cagatacaat tgatctgtaa
```

-continued

```
 661 tgtcaccggc cagttgagtg acattgctta ctggaagtgg aatgggtcag taattgatga
 721 agatgaccca gtgctagggg aagactatta cagtgtggaa atcctgcaa acaaaagaag
 781 gagtaccctc atcacagtgc ttaatatatc ggaaattgaa agtagatttt ataaacatcc
 841 atttacctgt tttgccaaga atacacatgg tatagatgca gcatatatcc agttaatata
 901 tccagtcact aatttccaga agcacatgat tggtatatgt gtcacgttga cagtcataat
 961 tgtgtgttct gttttcatct ataaaatctt caagattgac attgtgcttt ggtacaggga
1021 ttcctgctat gattttctcc caataaaagc ttcagatgga aagacctatg acgcatatat
1081 actgtatcca aagactgttg gggaagggtc tacctctgac tgtgatattt ttgtgtttaa
1141 agtcttgcct gaggtcttgg aaaaacagtg tggatataag ctgttcattt atggaaggga
1201 tgactacgtt ggggaagaca ttgttgaggt cattaatgaa aacgtaaaga aaagcagaag
1261 actgattatc attttagtca gagaaacatc aggcttcagc tggctgggtg ttcatctga
1321 agagcaaata gccatgtata atgctcttgt tcaggatgga attaaagttg tcctgcttga
1381 gctggagaaa atccaagact atgagaaaat gccagaatcg attaaattca ttaagcagaa
1441 acatgggact atccgctggt cagggacctt tacacaggga ccacagtctg caaagacaag
1501 gttctggaag aatgtcaggt accacatgcc agtccagcga cggtcacctt catctaaaca
1561 ccagttactg tcaccagcca ctaaggagaa actgcaaaga gaggctcacg tgcctctcgg
1621 gtagcatgga gaagttgcca agagttcttt aggtgcctcc tgtcttatgg cgttgcaggc
1681 caggttatgc ctcatgctga cttgcagagt tcatggaatg taactatatc atcctttatc
1741 cctgaggtca cctggaatca gattattaag ggataagcc atgacgtcaa tagcagccca
1801 gggcacttca gagtagaggg cttgggaaga tcttttaaaa aggcagtagg cccggtgtgg
1861 tggctcacgc ctataatccc agcactttgg gaggctgaag tgggtggatc accagaggtc
1921 aggagttcga gaccagccca gccaacatgg caaaaccca tctctactaa aaatacaaaa
1981 atgagctagg catggtggca cacgcctgta atcccagcta cacctgaggc tgaggcagga
2041 gaattgcttg aaccggggag acgaggttg cagtgagccg agtttgggcc actgcactct
2101 agcctggcaa cagagcaaga ctccgtctca aaaaagggc aataaatgcc ctctctgaat
2161 gtttgaactg ccaagaaaag gcatggagac agcgaactag aagaagggc aagaaggaaa
2221 tagccaccgt ctacagatgg cttagttaag tcatccacag cccaagggcg gggctatgcc
2281 ttgtctgggg accctgtaga gtcactgacc ctggagcggc tctcctgaga ggtgctgcag
2341 gcaaagtgag actgacacct cactgaggaa gggagacata ttcttggaga actttccatc
2401 tgcttgtatt ttccatacac atccccagcc agaagttagt gtccgaagac cgaattttat
2461 tttacagagc ttgaaaactc acttcaatga acaaagggat tctccaggat tccaaagttt
2521 tgaagtcatc ttagctttcc acaggaggga gagaacttaa aaaagcaaca gtagcaggga
2581 attgatccac ttcttaatgc tttcctccct ggcatgacca tcctgtcctt tgttattatc
2641 ctgcattta cgtctttgga ggaacagctc cctagtggct tcctccgtct gcaatgtccc
2701 ttgcacagcc cacacatgaa ccatccttcc catgatgccg ctcttctgtc atcccgctcc
2761 tgctgaaaca cctcccaggg gctccacctg ttcaggagct gaagcccatg cttttcccacc
2821 agcatgtcac tcccagacca cctcccctgcc ctgtcctcca gcttcccctc gctgtcctgc
2881 tgtgtgaatt cccaggttgg cctggtggcc atgtcgcctg ccccagcac tcctctgtct
2941 ctgctcttgc ctgcaccctt cctcctcctt tgcctaggag gcttctcgc attttctcta
3001 gctgatcaga attttaccaa aattcagaac atcctccaat tccacagtct ctgggagact
```

-continued

```
3061 ttccctaaga ggcgacttcc tctccagcct tctctctctg gtcaggccca ctgcagagat
3121 ggtggtgagc acatctggga ggctggtctc cctccagctg gaattgctgc tctctgaggg
3181 agaggctgtg gtggctgtct ctgtccctca ctgccttcca ggagcaattt gcacatgtaa
3241 catagattta tgtaatgctt tatgtttaaa acattcccc aattatctta tttaattttt
3301 gcaattattc taattttata tatagagaaa gtgacctatt ttttaaaaaa atcacactct
3361 aagttctatt gaacctagga cttgagcctc catttctggc ttctagtctg gtgttctgag
3421 tacttgattt caggtcaata acggtccccc ctcactccac actggcacgt ttgtgagaag
3481 aaatgacatt ttgctaggaa gtgaccgagt ctaggaatgc ttttattcaa gacaccaaat
3541 tccaaacttc taaatgttgg aattttcaaa aattgtgttt agattttatg aaaaactctt
3601 ctactttcat ctattctttc cctagaggca aacatttctt aaaatgtttc attttcatta
3661 aaaatgaaag ccaaatttat atgccaccga ttgcaggaca caagcacagt tttaagagtt
3721 gtatgaacat ggagaggact tttggttttt atatttctcg tatttaatat gggtgaacac
3781 caacttttat ttggaataat aattttcctc ctaaacaaaa acacattgag tttaagtctc
3841 tgactcttgc ctttccacct gctttctcct gggcccgctt tgcctgcttg aaggaacagt
3901 gctgttctgg agctgctgtt ccaacagaca gggcctagct ttcatttgac acacagacta
3961 cagccagaag cccatggagc agggatgtca cgtcttgaaa agcctattag atgttttaca
4021 aatttaattt tgcagattat tttagtctgt catccagaaa atgtgtcagc atgcatagtg
4081 ctaagaaagc aagccaattt ggaaacttag gttagtgaca aaattggcca gagagtgggg
4141 gtgatgatga ccaagaatta caagtagaat ggcagctgga atttaaggag ggacaagaat
4201 caatggataa gcgtgggtgg aggaagatcc aaacagaaaa gtgcaaagtt attccccatc
4261 ttccaagggt tgaattctgg aggaagaaga cacattccta gttccccgtg aacttccttt
4321 gacttattgt ccccactaaa acaaacaaa aacttttaa tgccttccac attaattaga
4381 ttttcttgca gttttttat ggcatttttt taaagatgcc ctaagtgttg aagaagagtt
4441 tgcaaatgca acaaaatatt taattaccgg ttgttaaaac tggtttagca caatttatat
4501 tttccctctc ttgcctttct tatttgcaat aaaaggtatt gagccatttt ttaaatgaca
4561 tttttgataa attatgtttg tactagttga tgaaggagtt ttttttaacc tgtttatata
4621 attttgcagc agaagccaaa tttttttgtat attaaagcac caaattcatg tacagcatgc
4681 atcacggatc aatagactgt acttattttc caataaaatt ttcaaacttt gtactgttaa
4741 aaaaaaaaaa aaaaaa
```

Human IL-1R1 mRNA Variant 10

(SEQ ID NO: 113)

```
  1 attaaagccc taagaggctg tgacacagcc atctccaaaa ccccactttc tccttcctt
 61 gagcctccgt accagctggg gcgtccggca agatgtgagt tgtcactctg ctgcggcaca
121 gacctgaatt aacaactcta gctagggctg acttcaaaaa gcactttcgt tttttaataa
181 ccaacatcag ctcagcaggc ttcatttggg aaaagaaacc ttgtcggatt accccgacat
241 tctccacctc ctgggaggcc agccattccc aaatgcccca aggatgaaga acggagacgg
301 tagacgcacc ctctgaagat ggtgactccc tcctgagaag ctggaccct tggtaaaaga
361 caaggccttc tccaagaaga atatgaaagt gttactcaga cttatttgtt tcatagctct
421 actgatttct tctctggagg ctgataaatg caaggaacgt gaagaaaaaa taattttagt
481 gtcatctgca aatgaaattg atgttcgtcc ctgtcctctt aacccaaatg aacacaaagg
541 cactataact tggtataaag atgacagcaa gacacctgta tctacagaac aagcctccag
601 gattcatcaa cacaaagaga aactttggtt tgttcctgct aaggtggagg attcaggaca
```

```
    661 ttactattgc gtggtaagaa attcatctta ctgcctcaga attaaaataa gtgcaaaatt
    721 tgtggagaat gagcctaact tatgttataa tgcacaagcc atatttaagc agaaactacc
    781 cgttgcagga gacggaggac ttgtgtgccc ttatatggag tttttaaaa atgaaaataa
    841 tgagttacct aaattacagt ggtataaggt aatttatttt taaatatgac atttcacttt
    901 tccagaaaat aaaatagttc cctggacaat agaaaaaaaa aaaaaaaaa
```

Human IL1RAP mRNA Variant 1

(SEQ ID NO: 114)

```
      1 aaagggggaa aagaaagtgc ggcggaaagt aagaggctca ctggggaaga ctgccgggat
     61 ccaggtctcc ggggtccgct ttggccagag gcgcgaagg aagcagtgcc cggcgacact
    121 gcacccatcc cggctgcttt tgctgcgccc tctcagcttc ccaagaaagg catcgtcatg
    181 tgatcatcac ctaagaacta gaacatcagc aggccctaga agcctcactc ttgcccctcc
    241 ctttaatatc tcaaaggatg acacttctgt ggtgtgtagt gagtctctac ttttatggaa
    301 tcctgcaaag tgatgcctca gaacgctgcg atgactgggg actagacacc atgaggcaaa
    361 tccaagtgtt tgaagatgag ccagctcgca tcaagtgccc actctttgaa cacttcttga
    421 aattcaacta cagcacagcc cattcagctg gccttactct gatctggtat tggactaggc
    481 aggaccggga ccttgaggag ccaattaact tccgcctccc cgagaaccgc attagtaagg
    541 agaaagatgt gctgtggttc cggcccactc tcctcaatga cactggcaac tatacctgca
    601 tgttaaggaa cactacatat tgcagcaaag ttgcatttcc cttggaagtt gttcaaaaag
    661 acagctgttt caattccccc atgaaactcc cagtgcataa actgtatata gaatatggca
    721 ttcagaggat cacttgtcca aatgtagatg atatttcc ttccagtgtc aaaccgacta
    781 tcacttggta tatgggctgt tataaaatac agaattttaa taatgtaata cccgaaggta
    841 tgaacttgag tttcctcatt gccttaattt caaataatgg aaattacaca tgtgttgtta
    901 catatccaga aaatggacgt acgtttcatc tcaccaggac tctgactgta aaggtagtag
    961 gctctccaaa aaatgcagtg ccccctgtga tccattcacc taatgatcat gtggtctatg
   1021 agaaagaacc aggagaggag ctactcattc cctgtacggt ctattttagt tttctgatgg
   1081 attctcgcaa tgaggtttgg tggaccattg atggaaaaa acctgatgac atcactattg
   1141 atgtcaccat taacgaaagt ataagtcata gtagaacaga agatgaaaca agaactcaga
   1201 ttttgagcat caagaaagtt acctctgagg atctcaagcg cagctatgtc tgtcatgcta
   1261 gaagtgccaa aggcgaagtt gccaaagcag ccaaggtgaa gcagaaagtg ccagctccaa
   1321 gatacacagt ggaactggct tgtggttttg gagccacagt cctgctagtg gtgattctca
   1381 ttgttgttta ccatgtttac tggctagaga tggtcctatt ttaccgggct catttggaa
   1441 cagatgaaac cattttagat ggaaaagagt atgatattta tgtatcctat gcaaggaatg
   1501 cggaagaaga agaatttgta ttactgaccc tccgtggagt tttggagaat gaatttggat
   1561 acaagctgtg catctttgac cgagacagtc tgcctggggg aattgtcaca gatgagactt
   1621 tgagcttcat tcagaaaagc agacgcctcc tggttgttct aagccccaac tacgtgctcc
   1681 agggaaccca agccctcctg gagctcaagg ctggcctaga aaatatggcc tctcggggca
   1741 acatcaacgt catttttagta cagtacaaag ctgtgaagga aacgaaggtg aaagagctga
   1801 agagggctaa gacggtgctc acggtcatta aatggaaagg ggaaaaatcc aagtatccac
   1861 agggcaggtt ctggaagcag ctgcaggtgg ccatgccagt gaagaaaagt cccaggcggt
   1921 ctagcagtga tgagcagggc ctctcgtatt catctttgaa aaatgtatga aaggaataat
   1981 gaaaagggta aaaagaacaa ggggtgctcc aggaagaaag agtcccccca gtcttcattc
```

```
-continued
2041 gcagtttatg gtttcatagg caaaaataat ggtctaagcc tcccaatagg gataaattta 2101 gggtgactgt gtggctgact attctgcttc ctcaggcaac actaaagttt agaaagatat 2161 catcaacgtt ctgtcaccag tctctgatgc cactatgttc tttgcaggca aagacttgtt 2221 caatgcgaat ttccccttct acattgtcta tccctgtttt tatatgtctc cattctttt 2281 aaaatcttaa catatggagc agcctttcct atgaatttaa atatgccttt aaaataagtc 2341 actgttgaca gggtcatgag tttccgagta tagttttctt tttatcttat ttttactcgt 2401 ccgttgaaaa gataatcaag gcctacattt tagctgagga taatgaactt ttttcctcat 2461 tcggctgtat aatacataac cacagcaaga ctgacatcca cttaggatga tacaaagcag 2521 tgtaactgaa aatgtttctt ttaattgatt taaaggactt gtcttctata ccacccttgt 2581 cctcatctca ggtaatttat gaaatctatg taaacttgaa aaatatttct taattttgt 2641 ttttgctcca gtcaattcct gattatccac aggtcaaccc acatttttc attccttctc 2701 cctatctgct tatatcgcat tgctcattta gagtttgcag gaggctccat actaggttca 2761 gtctgaaaga aatctcctaa tggtgctata gagaggggagg taacagaaag actcttttag 2821 ggcatttttc tgactcatga aaagagcaca gaaaaggatg tttggcaatt tgtcttttaa 2881 gtcttaacct tgctaatgtg aatactggga aagtgatttt ttctcactcg ttttttgttgc 2941 tccattgtaa agggcggagg tcagtcttag tggccttgag agttgctttt ggcattaata 3001 ttctaagaga attaactgta tttcctgtca cctattcact agtgcaggaa atatacttgc 3061 tccaaataag tcagtatgag aagtcactgt caatgaaagt tgttttgttt gttttcagta 3121 atattttgct gttttttaaga cttggaaaac taagtgcaga gtttacagag tggtaaatat 3181 ctatgttaca tgtagattat acatatatat acacacgtgt atatgagata tatatcttat 3241 atctccacaa acacaaatta tatatataca tatccacaca catacattac atatatctgt 3301 gtatataaat ccacatgcac atgaaatata tatatatata taatttgtgt gtgtgtatgt 3361 gtatgtatat gactttaaat agctatgggt acaatattaa aaaccactgg aactcttgtc 3421 cagttttaa attatgtttt tactggaatg tttttgtgtc agtgttttct gtacatatta 3481 tttgttaatt cacagctcac agagtgatag ttgtcatagt tcttgccttc cctaagttta 3541 tataaataac ttaagtattg ctacagttta tctaggttgc agtggcatct gctgtgcaca 3601 gagcttccat ggtcactgct aagcagtagc cagccatcgg gcattaattg attcctact 3661 atattcccag cagacacatt tagaaactaa gctatgttaa cctcagtgct caactatttg 3721 aactgttgag tgataaagga acaaatata actgtaaatg aatcttggta tcctgtgaaa 3781 cagaataatt cgtaatttaa gaaagcccctt atcccggtaa catgaatgtt gatgaacaaa 3841 tgtaaaatta tatcctatat ttaagtaccc ataataaatc atttccctct ataagtgtta 3901 ttgattattt taaattgaaa aaagtttcac ttggatgaaa aaagtagaaa agtaggtcat 3961 tcttggatct acttttttt agccttatta atatttttcc ctattagaaa ccacaattac 4021 tccctctatt aacccttcac ttactagacc agaaaagaac ttattccaga taagctttga 4081 atatcaattc ttacataaac tttaggcaaa cagggaatag tctagtcacc aaaggaccat 4141 tctcttgcca atgctgcatt ccttttgcac ttttggattc catatttatc ccaaatgctg 4201 ttgggcaccc ctagaaatac cttgatgttt tttctattta tatgcctgcc tttggtactt 4261 aattttacaa atgctgtaat ataaagcata tcaagtttat gtgatacgta tcattgcaag 4321 agaatttgtt tcaagatttt tttttaatgt tccagaagat ggccaataga gaacattcaa 4381 gggaaatggg gaaacataat ttagagaaca agaacaaacc atgtctcaaa tttttttaaa 4441 aaaaattaat ggttttaaat atatgctata gggacgttcc atgcccaggt taacaaagaa
```

-continued

```
4501 ctgtgatata tagagtgtct aattacaaaa tcatatacga tttatttaat tctcttctgt 4561 attgtaactt agatgattcc caaggactct aataaaaaat cacttcattg tatttggaaa 4621 caaaaacatc attcattaat tacttatttt ctttccatag gttttaatat tttgagagtg 4681 tctttttat ttcattcatg aacttttgta ttttcattt ttcatttgat ttgtaaattt 4741 acttatgtta aaaataaacc atttattttc agctttgaat tttaaaaaaa aaaaaaaaaa 4801 a
```

Human IL1RAP mRNA Variant 2

(SEQ ID NO: 115)

```
   1 aaaggggaa aagaaagtgc ggcggaaagt aagaggctca ctggggaaga ctgccgggat 61 ccaggtctcc ggggtccgct ttggccagag gcgcggaagg aagcagtgcc cggcgacact 121 gcacccatcc cggctgcttt tgctgcgccc tctcagcttc caagaaaggc atcgtcatg 181 tgatcatcac ctaagaacta gaacatcagc aggccctaga agcctcactc ttgcccctcc 241 ctttaatatc tcaaaggatg acacttctgt ggtgtgtagt gagtctctac ttttatggaa 301 tcctgcaaag tgatgcctca gaacgctgcg atgactgggg actagacacc atgaggcaaa 361 tccaagtgtt tgaagatgag ccagctcgca tcaagtgccc actctttgaa cacttcttga 421 aattcaacta cagcacagcc cattcagctg gccttactct gatctggtat tggactaggc 481 aggaccggga ccttgaggag ccaattaact ccgcctccc cgagaaccgc attagtaagg 541 agaaagatgt gctgtggttc cggcccactc tcctcaatga cactggcaac tatacctgca 601 tgttaaggaa cactacatat gcagcaaag ttgcatttcc cttggaagtt gttcaaaaag 661 acagctgttt caattccccc atgaaactcc cagtgcataa actgtatata gaatatggca 721 ttcagaggat cacttgtcca aatgtagatg atatttcc ttccagtgtc aaaccgacta 781 tcacttggta tatgggctgt tataaaatac agaattttaa taatgtaata cccgaaggta 841 tgaacttgag tttcctcatt gccttaattt caaataatgg aaattacaca tgtgttgtta 901 catatccaga aaatggacgt acgtttcatc tcaccaggac tctgactgta aaggtagtag 961 gctctccaaa aaatgcagtg cccctgtga tccattcacc taatgatcat gtggtctatg 1021 agaaagaacc aggagaggag ctactcattc cctgtacggt ctattttagt tttctgatgg 1081 attctcgcaa tgaggtttgg tggaccattg atggaaaaaa acctgatgac atcactattg 1141 atgtcaccat taacgaaagt ataagtcata gtagaacaga agatgaaaca agaactcaga 1201 ttttgagcat caagaaagtt acctctgagg atctcaagcg cagctatgtc tgtcatgcta 1261 gaagtgccaa aggcgaagtt gccaaagcag ccaaggtgaa gcagaaaggt aatagatgcg 1321 gtcagtgatg aatctctcag ctccaaatta acattgtggt gaataaggac aaaaggagag 1381 attgagaaca agagagctcc agcacctagc ccgacggcat ctaacccata gtaatgaatc 1441 aaacttaaat gaaaaatatg aaagttttca tctatgtaag atactcaaaa tattgtttct 1501 gatattgtta gtaccgtaat gcccaaatgt agctaaaaaa atcgacgtga gtacagtgag 1561 acacaatttt gtgtctgtac aattatgaaa aattaaaaac aaagaaaata ttcaaagcta 1621 ccaaagatag aaaaaactgg tagagccaca tattgttggt gaattattaa gacccttta 1681 aaaatcattc atggtagact tcaagagtca taaaaaagat tgcatcatct gacctaagac 1741 tttcggaatt tttcctgaac aaataacaga aagggaatta tacccttttc aatattatta 1801 gaagcattat ctgtagttgt aaaacattat taatagcagc catccaattg tatgcaacta 1861 attaaggtat tgaatgttta ttttccaaaa atgcataatt ataatattat tttaaacact 1921 atgtatcaat atttaagcag gtttataata taccagcagc cacaattgct aaaatgaaaa
```

-continued

```
1981 tcatttaaat tatgatttta aatggtataa acatgatttc tatgttgata gtactatatt
2041 attctacaat aaatggaaat tataaagcct tcttgtcaga agtgctgctc ctaaaaaaaa
2101 aaaaaaaaaa aaaa
```

Human IL1RAP mRNA Variant 3

(SEQ ID NO: 116)

```
   1 aaaggggaa aagaaagtgc ggcggaaagt aagaggctca ctggggaaga ctgccgggat
  61 ccaggtctcc ggggtccgct ttggccagag gcgcggaagg aagcagtgcc cggcgacact
 121 gcacccatcc cggctgcttt tgctgcgccc tctcagcttc ccaagaaagg gctttgacct
 181 gaagcttgaa attgagtttg ggacaataat gtgtctcatg ggaattgca tggactcctt
 241 atcataagcc aaatgctgag gtaaagctgc ggaattgagt cgtcctccaa gaagggagag
 301 aaaatgatgt cttgtgacat ttccagataa ctggcatcgt catgtgatca tcacctaaga
 361 actagaacat cagcaggccc tagaagcctc actcttgccc ctcccttaa tatctcaaag
 421 gatgacactt ctgtggtgtg tagtgagtct ctactttat ggaatcctgc aaagtgatgc
 481 ctcagaacgc tgcgatgact ggggactaga caccatgagg caaatccaag tgtttgaaga
 541 tgagccagct cgcatcaagt gcccactctt tgaacacttc ttgaaattca actacagcac
 601 agcccattca gctggcctta ctctgatctg gtattggact aggcaggacc gggaccttga
 661 ggagccaatt aacttccgcc tccccgagaa ccgcattagt aaggagaaag atgtgctgtg
 721 gttccggccc actctcctca atgacactgg caactatacc tgcatgttaa ggaacactac
 781 atattgcagc aaagttgcat ttccccttgga agttgttcaa aaagacagct gtttcaattc
 841 ccccatgaaa ctcccagtgc ataaactgta tatagaatat ggcattcaga ggatcacttg
 901 tccaaatgta gatggatatt ttccttccag tgtcaaaccg actatcactt ggtatatggg
 961 ctgttataaa atacagaatt ttaataatgt aataccccgaa ggtatgaact tgagtttcct
1021 cattgcctta atttcaaata atggaaatta cacatgtgtt gttacatatc agaaaatgg
1081 acgtacgttt catctcacca ggactctgac tgtaaaggta gtaggctctc caaaaaatgc
1141 agtgccccct gtgatccatt caacctaatga tcatgtggtc tatgagaaag aaccaggaga
1201 ggagctactc attccctgta cggtctattt tagttttctg atggattctc gcaatgaggt
1261 ttggtggacc attgatggaa aaaaacctga tgacatcact attgatgtca ccattaacga
1321 aagtatagt catagtagaa cagaagatga aacaagaact cagattttga gcatcaagaa
1381 agttacctct gaggatctca gcgcagcta tgtctgtcat gctagaagtg ccaaaggcga
1441 agttgccaaa gcagccaagg tgaagcagaa agtgccagct ccaagataca cagtggaact
1501 ggcttgtggt tttggagcca cagtcctgct agtggtgatt ctcattgttg tttaccatgt
1561 ttactggcta gagatggtcc tattttaccg ggctcatttt ggaacagatg aaaccatttt
1621 agatggaaaa gagtatgata tttatgtatc ctatgcaagg aatgcggaag aagaagaatt
1681 tgtattactg accctccgtg gagttttgga gaatgaattt ggatacaagc tgtgcatctt
1741 tgaccgagac agtctgcctg ggggaattgt cacagatgag actttgagct tcattcagaa
1801 aagcagacgc ctcctggttt tctaagccc caactacgtg ctccagggaa cccaagccct
1861 cctggagctc aaggctgcc tagaaaatat ggcctctcgg ggcaacatca acgtcatttt
1921 agtacagtac aaagctgtga aggaaacgaa ggtgaaagag ctgaagaggg ctaagacggt
1981 gctcacggtc attaaatgga aggggaaaa atccaagtat ccacagggca ggttctggaa
2041 gcagctgcag gtggccatgc cagtgaagaa aagtcccagg cggtctagca gtgatgagca
2101 gggcctctcg tattcatctt tgaaaaatgt atgaaaggaa taatgaaaag ggtaaaaaga
2161 acaaggggtg ctccaggaag aaagagtccc cccagtcttc attcgcagtt tatggtttca
```

```
2221  taggcaaaaa taatggtcta agcctcccaa tagggataaa tttagggtga ctgtgtggct
2281  gactattctg cttcctcagg caacactaaa gtttagaaag atatcatcaa cgttctgtca
2341  ccagtctctg atgccactat gttctttgca ggcaaagact tgttcaatgc gaatttcccc
2401  ttctacattg tctatccctg tttttatatg tctccattct ttttaaaatc ttaacatatg
2461  gagcagcctt tcctatgaat ttaaatatgc ctttaaaata agtcactgtt gacagggtca
2521  tgagtttccg agtatagttt tcttttatc ttattttac tcgtccgttg aaaagataat
2581  caaggcctac attttagctg aggataatga acttttttcc tcattcggct gtataataca
2641  taaccacagc aagactgaca tccacttagg atgatacaaa gcagtgtaac tgaaaatgtt
2701  tctttaatt gatttaaagg acttgtcttc tataccaccc ttgtcctcat ctcaggtaat
2761  ttatgaaatc tatgtaaact tgaaaaatat ttcttaattt ttgttttgc tccagtcaat
2821  tcctgattat ccacaggtca acccacattt tttcattcct tctccctatc tgcttatatc
2881  gcattgctca tttagagttt gcaggaggct ccatactagg ttcagtctga aagaaatctc
2941  ctaatggtgc tatagagagg gaggtaacag aaagactctt ttagggcatt tttctgactc
3001  atgaaaagag cacagaaaag gatgtttggc aatttgtctt ttaagtctta accttgctaa
3061  tgtgaatact gggaaagtga tttttttctca ctcgtttttg ttgctccatt gtaaagggcg
3121  gaggtcagtc ttagtggcct tgagagttgc ttttggcatt aatattctaa gagaattaac
3181  tgtatttcct gtcacctatt cactagtgca ggaaatatac ttgctccaaa taagtcagta
3241  tgagaagtca ctgtcaatga aagttgtttt gtttgttttc agtaatattt tgctgttttt
3301  aagacttgga aaactaagtg cagagtttac agagtggtaa atatctatgt tacatgtaga
3361  ttatacatat atatacacac gtgtatatga gatatatatc ttatatctcc acaaacacaa
3421  attatatata tacatatcca cacacataca ttacatatat ctgtgtatat aaatccacat
3481  gcacatgaaa tatatatata tatataattt gtgtgtgtgt atgtgtatgt atatgacttt
3541  aaatagctat gggtacaata ttaaaaacca ctggaactct tgtccagttt ttaaattatg
3601  tttttactgg aatgtttttg tgtcagtgtt ttctgtacat attatttgtt aattcacagc
3661  tcacagagtg atagttgtca tagttcttgc cttccctaag tttatataaa taacttaagt
3721  attgctacag tttatctagg ttgcagtggc atctgctgtg cacagagctt ccatggtcac
3781  tgctaagcag tagccagcca tcgggcatta attgatttcc tactatattc ccagcagaca
3841  catttagaaa ctaagctatg ttaacctcag tgctcaacta tttgaactgt tgagtgataa
3901  aggaaacaaa tataactgta aatgaatctt ggtatcctgt gaaacagaat aattcgtaat
3961  ttaagaaagc ccttatcccg gtaacatgaa tgttgatgaa caaatgtaaa attatatcct
4021  atatttaagt acccataata aatcatttcc ctctataagt gttattgatt attttaaatt
4081  gaaaaagtt tcacttggat gaaaaagta gaaagtagg tcattcttgg atctactttt
4141  ttttagcctt attaatattt ttccctatta gaaaccacaa ttactccctc tattaaccct
4201  tcacttacta gaccagaaaa gaacttattc cagataagct ttgaatatca attcttacat
4261  aaactttagg caaacaggga atagtctagt caccaaagga ccattctctt gccaatgctg
4321  cattcctttt gcacttttgg attccatatt tatcccaaat gctgttgggc acccctagaa
4381  ataccttgat gttttttcta tttatatgcc tgcctttggt acttaatttt acaaatgctg
4441  taatataaag catatcaagt ttatgtgata cgtatcattg caagagaatt tgtttcaaga
4501  ttttttttta atgttccaga agatggccaa tagagaacat tcaagggaaa tggggaaaca
4561  taatttagag aacaagaaca aaccatgtct caaatttttt taaaaaaaat taatggtttt
```

-continued

```
4621 aaatatatgc tatagggacg ttccatgccc aggttaacaa agaactgtga tatatagagt
4681 gtctaattac aaaatcatat acgatttatt taattctctt ctgtattgta acttagatga
4741 ttcccaagga ctctaataaa aaatcacttc attgtatttg gaaacaaaaa catcattcat
4801 taattactta ttttctttcc ataggtttta atattttgag agtgtctttt ttatttcatt
4861 catgaacttt tgtattttc attttcatt tgatttgtaa atttacttat gttaaaaata
4921 aaccatttat tacagcttt gaatttaaa aaaaaaaaaa aaaaa
```

Human IL1RAP mRNA Variant 4

(SEQ ID NO: 117)
```
   1 aaaggggaa aagaaagtgc ggcggaaagt aagaggctca ctggggaaga ctgccgggat
  61 ccaggtctcc ggggtccgct ttggccagag gcgcggaagg aagcagtgcc cggcgacact
 121 gcacccatcc cggctgcttt tgctgcgccc tctcagcttc ccaagaaagg atgacacttc
 181 tgtggtgtgt agtgagtctc tactttatg gaatcctgca aagtgatgcc tcagaacgct
 241 gcgatgactg gggactagac accatgaggc aaatccaagt gtttgaagat gagccagctc
 301 gcatcaagtg cccactcttt gaacacttct tgaaattcaa ctacagcaca gcccattcag
 361 ctggccttac tctgatctgg tattggacta ggcaggaccg ggaccttgag gagccaatta
 421 acttccgcct ccccgagaac cgcattagta aggagaaaga tgtgctgtgg ttccggccca
 481 ctctcctcaa tgacactggc aactatacct gcatgttaag gaacactaca tattgcagca
 541 aagttgcatt tccttggaa gttgttcaaa aagacagctg tttcaattcc cccatgaaac
 601 tcccagtgca taaactgtat atagaatatg gcattcagag gatcacttgt ccaaatgtag
 661 atggatattt tccttccagt gtcaaaccga ctatcacttg gtatatgggc tgttataaaa
 721 tacagaattt taataatgta atacccgaag gtatgaactt gagtttcctc attgccttaa
 781 tttcaaataa tggaaattac acatgtgttg ttacatatcc agaaaatgga cgtacgtttc
 841 atctcaccag gactctgact gtaaaggtag taggctctcc aaaaaatgca gtgcccctg
 901 tgatccattc acctaatgat catgtggtct atgagaaaga accaggagag gagctactca
 961 ttccctgtac ggtctatttt agttttctga tggattctcg caatgaggtt tggtggacca
1021 ttgatggaaa aaaacctgat gacatcacta ttgatgtcac cattaacgaa agtataagtc
1081 atagtagaac agaagatgaa acaagaactc agattttgag catcaagaaa gttacctctg
1141 aggatctcaa gcgcagctat gtctgtcatg ctagaagtgc aaaggcgaa gttgccaaag
1201 cagccaaggt gaagcagaaa gtgccagctc aagatacac agtggaactg gcttgtggtt
1261 ttggagccac agtcctgcta gtggtgattc tcattgttgt ttaccatgtt tactggctag
1321 agatggtcct attttaccgg gctcattttg gaacagatga aaccatttta gatggaaaag
1381 agtatgatat ttatgtatcc tatgcaagga atgcggaaga agaagaattt gtattactga
1441 ccctccgtgg agttttggag aatgaatttg gatacaagct gtgcatcttt gaccgagaca
1501 gtctgcctgg gggaattgtc acagatgaga ctttgagctt cattcagaaa agcagacgcc
1561 tcctggttgt tctaagcccc aactacgtgc tccagggaac ccaagccctc ctggagctca
1621 aggctggcct agaaaatatg gcctctcggg gcaacatcaa cgtcatttta gtacagtaca
1681 aagctgtgaa ggaaacgaag gtgaaagagc tgaagagggc taagacggtg ctcacggtca
1741 ttaaatggaa agggggaaaaa tccaagtatc cacagggcag gttctggaag cagctgcagg
1801 tggccatgcc agtgaagaaa agtcccaggc ggtctagcag tgatgagcag ggcctctcgt
1861 attcatcttt gaaaaatgta tgaaaggaat aatgaaaagg gtaaaaagaa caagggggtgc
1921 tccaggaaga aagagtcccc ccagtcttca ttcgcagttt atggtttcat aggcaaaaat
1981 aatggtctaa gcctcccaat agggataaat ttagggtgac tgtgtggctg actattctgc
```

-continued

```
2041  ttcctcaggc aacactaaag tttagaaaga tatcatcaac gttctgtcac cagtctctga
2101  tgccactatg ttctttgcag gcaaagactt gttcaatgcg aatttcccct tctacattgt
2161  ctatccctgt ttttatatgt ctccattctt tttaaaatct taacatatgg agcagccttt
2221  cctatgaatt taaatatgcc tttaaaataa gtcactgttg acagggtcat gagtttccga
2281  gtatagtttt cttttatct tatttttact cgtccgttga aaagataatc aaggcctaca
2341  ttttagctga ggataatgaa cttttttcct cattcggctg tataatacat aaccacagca
2401  agactgacat ccacttagga tgatacaaag cagtgtaact gaaaatgttt cttttaattg
2461  atttaaagga cttgtcttct ataccaccct tgtcctcatc tcaggtaatt tatgaaatct
2521  atgtaaactt gaaaaatatt tcttaatttt tgttttgct ccagtcaatt cctgattatc
2581  cacaggtcaa cccacatttt ttcattcctt ctccctatct gcttatatcg cattgctcat
2641  ttagagtttg caggaggctc catactaggt tcagtctgaa agaaatctcc taatggtgct
2701  atagagaggg aggtaacaga aagactcttt tagggcattt ttctgactca tgaaaagagc
2761  acagaaaagg atgtttggca atttgtcttt taagtcttaa ccttgctaat gtgaatactg
2821  ggaaagtgat tttttctcac tcgttttgt tgctccattg taaagggcgg aggtcagtct
2881  tagtggcctt gagagttgct tttggcatta atattctaag agaattaact gtatttcctg
2941  tcacctattc actagtgcag gaaatatact tgctccaaat aagtcagtat gagaagtcac
3001  tgtcaatgaa agttgttttg tttgttttca gtaatatttt gctgttttta agacttggaa
3061  aactaagtgc agagtttaca gagtggtaaa tatctatgtt acatgtagat tatacatata
3121  tatacacacg tgtatatgag atatatatct tatatctcca caaacacaaa ttatatatat
3181  acatatccac acacatacat tacatatatc tgtgtatata aatccacatg cacatgaaat
3241  atatatatat atataatttg tgtgtgtgta tgtgtatgta tatgacttta aatagctatg
3301  ggtacaatat taaaaaccac tggaactctt gtccagtttt taaattatgt ttttactgga
3361  atgtttttgt gtcagtgttt tctgtacata ttatttgtta attcacagct cacagagtga
3421  tagttgtcat agttcttgcc ttccctaagt ttatataaat aacttaagta ttgctacagt
3481  ttatctaggt tgcagtggca tctgctgtgc acagagcttc catggtcact gctaagcagt
3541  agccagccat cgggcattaa ttgatttcct actatattcc cagcagacac atttagaaac
3601  taagctatgt taacctcagt gctcaactat ttgaactgtt gagtgataaa ggaaacaaat
3661  ataactgtaa atgaatcttg gtatcctgtg aaacagaata attcgtaatt taagaaagcc
3721  cttatcccgg taacatgaat gttgatgaac aaatgtaaaa ttatatccta tatttaagta
3781  cccataataa atcatttccc tctataagtg ttattgatta ttttaaattg aaaaaagttt
3841  cacttggatg aaaaaagtag aaaagtaggt cattcttgga tctactttt tttagcctta
3901  ttaatatttt tccctattag aaaccacaat tactccctct attaaccctt cacttactag
3961  accagaaaag aacttattcc agataagctt tgaatatcaa ttcttacata aactttaggc
4021  aaacagggaa tagtctagtc accaaaggac cattctcttg ccaatgctgc attccttttg
4081  cacttttgga ttccatattt atcccaaatg ctgttgggca cccctagaaa taccttgatg
4141  ttttttctat ttatatgcct gcctttggta cttaattttta caaatgctgt aatataaagc
4201  atatcaagtt tatgtgatac gtatcattgc aagagaattt gtttcaagat ttttttttaa
4261  tgttccagaa gatggccaat agagaacatt caagggaaat ggggaaacat aatttagaga
4321  acaagaacaa accatgtctc aaattttttt aaaaaaaatt aatggtttta aatatatgct
4381  atagggacgt tccatgccca ggttaacaaa gaactgtgat atatagagtg tctaattaca
```

-continued

```
4441 aaatcatata cgatttattt aattctcttc tgtattgtaa cttagatgat tcccaaggac 4501 tctaataaaa aatcacttca ttgtatttgg aaacaaaaac atcattcatt aattacttat 4561 tttctttcca taggttttaa tattttgaga gtgtcttttt tatttcattc atgaactttt 4621 gtattttcca tttttcattt gatttgtaaa tttacttatg ttaaaaataa accatttatt 4681 ttcagctttg aatttaaaa aaaaaaaaaa aaaa
```

Human IL1RAP mRNA Variant 5

(SEQ ID NO: 118)

```
   1 aaaggggaa aagaaagtgc ggcggaaagt aagaggctca ctggggaaga ctgccgggat 61 ccaggtctcc ggggtccgct ttggccagag gcgcggaagg aagcagtgcc cggcgacact 121 gcacccatcc cggctgcttt tgctgcgccc tctcagcttc ccaagaaagg atgacacttc 181 tgtggtgtgt agtgagtctc tactttatg gaatcctgca aagtgatgcc tcagaacgct 241 gcgatgactg gggactagac accatgaggc aaatccaagt gtttgaagat gagccagctc 301 gcatcaagtg cccactcttt gaacacttct tgaaattcaa ctacagcaca gcccattcag 361 ctggccttac tctgatctgg tattggacta ggcaggaccg ggaccttgag gagccaatta 421 acttccgcct ccccgagaac cgcattagta aggagaaaga tgtgctgtgg ttccggccca 481 ctctcctcaa tgacactggc aactataccc gcatgttaag gaacactaca tattgcagca 541 aagttgcatt tccccttggaa gttgttcaaa aagacagctg tttcaattcc cccatgaaac 601 tcccagtgca taaactgtat atagaatatg gcattcagag gatcacttgt ccaaatgtag 661 atggatattt tccttccagt gtcaaaccga ctatcacttg gtatatgggc tgttataaaa 721 tacagaattt taataatgta atacccgaag gtatgaactt gagtttcctc attgccttaa 781 tttcaaataa tggaaattac acatgtgttg ttacatatcc agaaaatgga cgtacgtttc 841 atctcaccag gactctgact gtaaaggtag taggctctcc aaaaaatgca gtgccccctg 901 tgatccattc acctaatgat catgtggtct atgagaaaga accaggagag gagctactca 961 ttccctgtac ggtctatttt agttttctga tggattctcg caatgaggtt tggtggacca 1021 ttgatggaaa aaaacctgat gacatcacta ttgatgtcac cattaacgaa agtataagtc 1081 atagtagaac agaagatgaa acaagaactc agattttgag catcaagaaa gttacctctg 1141 aggatctcaa gcgcagctat gtctgtcatg ctagaagtgc caaggcgaa gttgccaaag 1201 cagccaaggt gaagcagaaa ggtaatagat gcggtcagtg atgaatctct cagctccaaa 1261 ttaacattgt ggtgaataag gacaaaagga gagattgaga acaagagagc tccagcacct 1321 agcccgacgg catctaaccc atagtaatga atcaaactta aatgaaaaat atgaaagttt 1381 tcatctatgt aagatactca aaatattgtt tctgatattg ttagtaccgt aatgcccaaa 1441 tgtagctaaa aaaatcgacg tgagtacagt gagacacaat tttgtgtctg tacaattatg 1501 aaaaattaaa aacaaagaaa atattcaaag ctaccaaaga tagaaaaaac tggtagagcc 1561 acatattgtt ggtgaattat taagacccctt ttaaaaatca ttcatggtag acttcaagag 1621 tcataaaaaa gattgcatca tctgacctaa gactttcgga atttttcctg aacaaataac 1681 agaaagggaa ttatatacct tttaatatta ttagaagcat tatctgtagt tgtaaaacat 1741 tattaatagc agccatccaa ttgtatgcaa ctaattaagg tattgaatgt ttatttttcca 1801 aaaatgcata attataatat tattttaaac actatgtatc aatatttaag caggtttata 1861 atataccagc agccacaatt gctaaaatga aatcattta aattatgatt ttaaatggta 1921 taaacatgat ttctatgttg atagtactat attattctac aataaatgga aattataaag 1981 ccttcttgtc agaagtgctg ctcctaaaaa aaaaaaaaa aaaaaa
```

-continued

Human IL1RAP mRNA Variant 6

(SEQ ID NO: 119)

```
   1 aaaggggggaa aagaaagtgc ggcggaaagt aagaggctca ctggggaaga ctgccgggat
  61 ccaggtctcc ggggtccgct ttggccagag gcgcggaagg aagcagtgcc cggcgacact
 121 gcacccatcc cggctgcttt tgctgcgccc tctcagcttc caagaaagg catcgtcatg
 181 tgatcatcac ctaagaacta gaacatcagc aggccctaga agcctcactc ttgcccctcc
 241 ctttaatatc tcaaaggatg acacttctgt ggtgtgtagt gagtctctac ttttatggaa
 301 tcctgcaaag tgatgcctca gaacgctgcg atgactgggg actagacacc atgaggcaaa
 361 tccaagtgtt tgaagatgag ccagctcgca tcaagtgccc actctttgaa cacttcttga
 421 aattcaacta cagcacagcc cattcagctg gccttactct gatctggtat tggactaggc
 481 aggaccggga ccttgaggag ccaattaact ccgcctccc cgagaaccgc attagtaagg
 541 agaaagatgt gctgtggttc cggcccactc tcctcaatga cactggcaac tatacctgca
 601 tgttaaggaa cactacatat tgcagcaaag ttgcatttcc cttggaagtt gttcaaaaag
 661 acagctgttt caattccccc atgaaactcc cagtgcataa actgtatata gaatatggca
 721 ttcagaggat cacttgtcca aatgtagatg atatttttcc ttccagtgtc aaaccgacta
 781 tcacttggta tatgggctgt tataaaatac agaattttaa taatgtaata cccgaaggta
 841 tgaacttgag tttcctcatt gccttaattt caaataatgg aaattacaca tgtgttgtta
 901 catatccaga aaatggacgt acgtttcatc tcaccaggac tctgactgta aaggtagtag
 961 gctctccaaa aaatgcagtg ccccctgtga tccattcacc taatgatcat gtggtctatg
1021 agaaagaacc aggagaggag ctactcattc cctgtacggt ctattttagt tttctgatgg
1081 attctcgcaa tgaggtttgg tggaccattg atggaaaaaa acctgatgac atcactattg
1141 atgtcaccat taacgaaagt ataagtcata gtagaacaga agatgaaaca gaactcaga
1201 ttttgagcat caagaaagtt acctctgagg atctcaagcg cagctatgtc tgtcatgcta
1261 gaagtgccaa aggcgaagtt gccaaagcag ccaaggtgaa gcagaaagtg ccagctccaa
1321 gatacacagt ggaactggct tgtggttttg gagccacagt cctgctagtg gtgattctca
1381 ttgttgttta ccatgtttac tggctagaga tggtcctatt ttaccgggct cattttggaa
1441 cagatgaaac catttttagat ggaaaagagt atgatattta tgtatcctat gcaaggaatg
1501 cggaagaaga agaatttgta ttactgaccc tccgtggagt tttggagaat gaatttggat
1561 acaagctgtg catctttgac cgagacagtc tgcctggggg aaatacagtg gaagcagttt
1621 ttgatttcat tcagagaagc agaaggatga ttgttgttct gagccctgac tatgtgacag
1681 aaaagagcat cagcatgctg gagtttaaac tgggtgtcat gtgccagaac tccattgcca
1741 ccaagctcat tgtggttgag taccgtcccc ttgagcaccc gcacccaggc attcttcagc
1801 tcaaagagtc tgtgtctttt gtgagctgga agggagaaaa gtccaaacat tctggctcta
1861 aattctggaa agctttgcgg ttggctcttc ccctgagaag tctgagtgcc agttctggct
1921 ggaatgagag ctgctcttcc cagtctgaca tcagtctgga tcacgttcaa aggaggagaa
1981 gtcgtttgaa agagcccca gaacttcaga gctcagagag ggctgcaggt agccctccag
2041 ccccaggcac aatgtccaag caccgaggga agtcctccgc cacctgccgc tgttgtgtca
2101 cctactgtga aggagagaat caccttagga caagagccg ggcagagatt cataaccagc
2161 cccagtggga gacacacctc tgtaagcctg ttcccccaaga gtcagaaact caatggatac
2221 aaaatggcac cagattggaa cccctgctc cccagatctc agcccttgct cttcatcatt
2281 tcacggactt atccaataac aacgactttt atatcctata attactgtgt gtggtgggtg
```

```
2341 gtggctacta tctctaccaa ccctctgtat gtcatgaacc tgtgggaaaa tctgacattt 2401 ttatcatcta atggactatc agatttctgt cccctttatt gattttaaa aactatttat 2461 ttctaggaga caaaagacct gaaggacctg aatccagaat tattgcctct aaaggcctca 2521 gaagagcaca ctcttcttgg gccctagaag gtcagtatgt gaaagttgcc taaagtctga 2581 tcctctatct tgtccaatgg tttaaaactg agctaagaat ttaaatgtgt ttcttttcag 2641 tgagttgatc aacctcacat tataagtcag tcaggtgtac ttgggctatg atgcttacag 2701 ggtgtatgca ttcccaggga gcagcatgga aaggagctgg ttctggtgga agctgtagga 2761 cgaagctcaa cagaaaacct acagcacatt tttcctcaaa gaaccaaaca tacccaccca 2821 gggatacatg gcgttctctg tctcactgta aactagtgtt ctctaaactg cctaacattg 2881 ttagcatcaa taaaattcta tttttacgtc aaaaaaaaaa aaaaaaaaa
```

Human IL-18Rα mRNA Variant 1

(SEQ ID NO: 120)
```
   1 tcaggaggcg gagatcgctg cttctcacct actttctgaa cttggcctcc gcagtcgcga 61 cctggcgtga aggaggagct gccgccccg ccccagcctc ggggacgcct ctctgaagag 121 aagccatttg aagcagaatc caaaccatga attgtagaga attacccttg accctttggg 181 tgcttatatc tgtaagcact gcagaatctt gtacttcacg tccccacatt actgtggttg 241 aagggggaacc tttctatctg aaacattgct cgtgttcact tgcacatgag attgaaacaa 301 ccaccaaaag ctggtacaaa agcagtggat cacaggaaca tgtggagctg aacccaagga 361 gttcctcgag aattgctttg catgattgtg ttttggagtt ttggccagtt gagttgaatg 421 acacaggatc ttactttttc caaatgaaaa attatactca gaatggaaaa ttaaatgtca 481 tcagaagaaa taaacacagc tgtttcactg aaagacaagt aactagtaaa attgtggaag 541 ttaaaaaatt ttttcagata acctgtgaaa acagttacta tcaaacactg gtcaacagca 601 catcattgta taagaactgt aaaaagctac tactggagaa caataaaaac ccaacgataa 661 agaagaacgc cgagtttgaa gatcaggggt attactcctg cgtgcatttc cttcatcata 721 atggaaaact atttaatatc accaaaacct tcaatataac aatagtggaa gatcgcagta 781 atatagttcc ggttcttctt ggaccaaagc ttaaccatgt tgcagtggaa ttaggaaaaa 841 acgtaaggct caactgctct gctttgctga atgaagagga tgtaatttat tggatgttcg 901 gggaagaaaa tggatcggat cctaatatac atgaagagaa agaaatgaga attatgactc 961 cagaaggcaa atggcatgct tcaaaagtat tgagaattga aaatattggt gaaagcaatc 1021 taaatgtttt atataattgc actgtggcca gcacgggagg cacagacacc aaaagcttca 1081 tcttggtgag aaaagcagac atggctgata tcccaggcca cgtcttcaca agaggaatga 1141 tcatagctgt tttgatcttg gtggcagtag tgtgcctagt gactgtgtgt gtcatttata 1201 gagttgactt ggttctattt tatagacatt taacgagaag agatgaaaca ttaacagatg 1261 gaaaaacata tgatgctttt gtgtcttacc taaaagaatg ccgacctgaa aatggagagg 1321 agcacacctt tgctgtggag attttgccca gggtgttgga gaaacatttt gggtataagt 1381 tatgcatatt tgaaagggat gtagtgcctg gaggagctgt tgttgatgaa atccactcac 1441 tgatagagaa aagccgaaga ctaatcattg tcctaagtaa agttatatgt ctaatgagg 1501 tcaggtatga acttgaaagt ggactccatg aagcattggt ggaagaaaa attaaaataa 1561 tcttaattga atttacacct gttactgact tcacattctt gccccaatca ctaaagcttt 1621 tgaaatctca cagagttctg aagtggaagg ccgataaatc tctttcttat aactcaaggt 1681 tctggaagaa ccttcttttac ttaatgcctg caaaaacagt caagccaggt agagacgaac 1741 cggaagtctt gcctgttctt tccgagtctt aatcttcaga aacagtgaac gccaaaaga
```

-continued

```
1801 actcaagata ttctggggac tgagcatatg aacctgttca taacaaaggc tgtgactcga
1861 aataattaac tttgtcaaaa tcctgctcac aatttgaaga tgaaacttgt cattaggttg
1921 gcgggaatga gactaaagat tgcgctgtgg gctgtggtca cgtgctccca gaagacctgg
1981 aattcaaaag aaatggagct attcttttc tccctctttc ataactggat gcagctgctc
2041 atactcaatc ccatattcag caagtgtgaa gctggacgtg atgcaaaata accgatgccc
2101 tacaaaaagg gcgcatcttt aagagtttta atgccagtgc ttaattcgaa tgaggggatt
2161 ttaagtgtct gaagaggcat tttctaggga ccagtgggtg actgagtaac tgaaatgctg
2221 ctttcactcc ctaacaccat ggatctggtt gtgcatagga tgtgggagga gggctggca
2281 gggccgcctt cagaggctgc agggcctcag cctcaggatg catttaatgt atcctggcca
2341 cagttgcagc caacggttct tgaaagctcg gtaaggccct gcaacgcaga gcctgcttat
2401 gtggatctat ttatgggaac ttcttaaaag daccccagaa tagctcttta tctttcacaa
2461 gagacacaaa ttctaattga gttaattatc tgggcctttc actttggatg ctctgaaaca
2521 tttgttgatt tgtgtgaat gtttatatca aaatgtttgc caggttgtat tagccattga
2581 atagcaaaaa actgatagtt acttgcttgt tttttaaaaa ttacatatta aaaatgccct
2641 tggcataagg cagcatggtg tggcagttaa gagatgggct gtgcagccca tcctgagctc
2701 cagtcctgag tttgctactt acttctgtgg cctctggaac cttatccaac ctcttggtgc
2761 ttcagtttcc tcatctgtga aattagaatt tataataatt gcacctacct cccaggggta
2821 actaaatgaa taaatataat aaagtactta cagtggttcc tgacacagac tcagcactcc
2881 gtcagtgttg ccatgactat ttttattatc attattaatg attacttaga tcaattattt
2941 agcagtggac taatggaagc tacagagcag ggaagggaag cagatctagg gaggaaggca
3001 gttttgattt gaggaggttt gcacatgtag agaagcatac tggagaagca tatccagagg
3061 gcgaaagata tctctccatt gtgcatctgc ctcttttgac gttggaagac acatgtctta
3121 ctccccaaag ggagcccagc actgggagcc ttcttgatga tctcaaaaat aatagctatt
3181 caagaaaatc accaagtgac tgtgaaaccg tcagttcgga aggctggtta aacatgtggg
3241 gagcaacatg aatgttctac aaaagtttaa agcagagatt gtttcaaatg ggtgtagtag
3301 atattactga aaaccaaaaa agagtgagat tgtcagtgta agaatgtgat ttaatgtttg
3361 tagtgcttac aattttgtgt accaactgga tgactaaaaa gagtaaaata atttaattaa
3421 tagctcatat tttatgtgtg aaaacatgtt agtgaacata tataatcaaa atagatttca
3481 ttgctattgc atagtctcta atacatagaa tgattttgct tttctctttt attatacttg
3541 ctttaaaata cttgaaatat attttgcatt aaatgcattt caagttaaat gtcttaaatg
3601 tatacattag atgtgtgttt taaaatgcat aaaacacgtt gaaatacatt aatgaaccat
3661 t
```

Human IL-18Rα mRNA Variant 2

(SEQ ID NO: 121)

```
  1 tcaggaggcg gagatcgctg cttctcacct actttctgaa cttggcctcc gcagtcgcga
 61 cctggcgtga aggaggagct gccgccccg ccccagcctc ggggacgcct ctctgaagag
121 aagccatttg aagcagaatc caaaccatga attgtagaga attacccttg accctttggg
181 tgcttatatc tgtaagcact gcagaaatta tactcagaaa tggaaattaa atgtcatcag
241 aagaaataaa cacagctgtt tcactgaaag acaagtaact agtaaaattg tggaagttaa
301 aaaattttt cagataacct gtgaaaacag ttactatcaa acactggtca acagcacatc
361 attgtataag ataggaccac ctatttgcag gaaaacaagc tcagggctcc actgattcta
```

-continued

```
 421 cattatgaac tgtaaaaagc tactactgga gaacaataaa aacccaacga taaagaagaa
 481 cgccgagttt gaagatcagg ggtattactc ctgcgtgcat ttccttcatc ataatggaaa
 541 actatttaat atcaccaaaa ccttcaatat aacaatagtg gaagatcgca gtaatatagt
 601 tccggttctt cttggaccaa agcttaacca tgttgcagtg gaattaggaa aaaacgtaag
 661 gctcaactgc tctgctttgc tgaatgaaga ggatgtaatt tattggatgt tcggggaaga
 721 aaatggatcg gatcctaata tacatgaaga gaaagaaatg agaattatga ctccagaagg
 781 caaatggcat gcttcaaaag tattgagaat tgaaatatt ggtgaaagca atctaaatgt
 841 tttatataat tgcactgtgg ccagcacggg aggcacagac accaaaagct catcttggt
 901 gagaaaagac atggctgata tcccaggcca cgtcttcaca agaggaatga tcatagctgt
 961 tttgatcttg gtggcagtag tgtgcctagt gactgtgtgt gtcatttata gagttgactt
1021 ggttctattt tatagacatt taacgagaag agatgaaaca ttaacagatg gaaaaacata
1081 tgatgctttt gtgtcttacc taaaagaatg ccgacctgaa aatggagagg agcacacctt
1141 tgctgtggag attttgccca gggtgttgga gaaacatttt gggtataagt tatgcatatt
1201 tgaagggat gtagtgcctg gaggagctgt tgttgatgaa atccactcac tgatagagaa
1261 aagccgaaga ctaatcattg tcctaagtaa aagttatatg tctaatgagg tcaggtatga
1321 acttgaaagt ggactccatg aagcattggt ggaagaaaaa attaaaataa tcttaattga
1381 atttacacct gttactgact tcacattctt gcccaatca ctaaagcttt gaaatctca
1441 cagagttctg aagtggaagg ccgataaatc tctttcttat aactcaaggt tctggaagaa
1501 ccttctttac ttaatgcctg caaaaacagt caagccaggt agagacgaac cggaagtctt
1561 gcctgttctt tccgagtctt aatcttcaga acagtgaac gccaaaaaga actcaagata
1621 ttctggggac tgagcatatg aacctgttca taacaaaggc tgtgactcga ataattaac
1681 tttgtcaaaa tcctgctcac aatttgaaga tgaaacttgt cattaggttg gcgggaatga
1741 gactaaagat tgcgctgtgg gctgtggtca cgtgctccca gaagacctgg aattcaaaag
1801 aaatggagct attctttttc tccctctttc ataactggat gcagctgctc atactcaatc
1861 ccatattcag caagtgtgaa gctggacgtg atgcaaaata accgatgccc tacaaaaagg
1921 gcgcatcttt aagagttta atgccagtgc ttaattcgaa tgagggggatt ttaagtgtct
1981 gaagaggcat tttctaggga ccagtgggtg actgagtaac tgaaatgctg ctttcactcc
2041 ctaacaccat ggatctggtt gtgcatagga tgtgggagga ggggctggca gggccgcctt
2101 cagaggctgc agggcctcag cctcaggatg catttaatgt atcctggcca cagttgcagc
2161 caacggttct tgaaagctcg gtaaggccct gcaacgcaga gcctgcttat gtggatctat
2221 ttatgggaac ttcttaaaag gaccccagaa tagctcttta tctttcacaa gagacacaaa
2281 ttctaattga gttaattatc tgggcctttc actttggatg ctctgaaaca tttgttgatt
2341 ttgtgtgaat gtttatatca aaatgtttgc caggttgtat tagccattga atagcaaaaa
2401 actgatagtt acttgcttgt tttttaaaaa ttacatatta aaaatgccct tggcataagg
2461 cagcatggtg tggcagttaa gagatgggct gtgcagccca tcctgagctc cagtcctgag
2521 tttgctactt acttctgtgg cctctggaac cttatccaac ctcttggtgc ttcagtttcc
2581 tcatctgtga aattagaatt tataataatt gcacctacct cccaggggta actaaatgaa
2641 taaatataat aaagtactta cagtggttcc tgacacagac tcagcactcc gtcagtgttg
2701 ccatgactat ttttattatc attattaatg attacttaga tcaattattt agcagtggac
2761 taatggaagc tacagagcag ggaagggaag cagatctagg gaggaaggca gttttgattt
2821 gaggaggttt gcacatgtag agaagcatac tggagaagca tatccagagg gcgaaagata
```

-continued

```
2881 tctctccatt gtgcatctgc ctcttttgac gttggaagac acatgtctta ctccccaaag
2941 ggagcccagc actgggagcc ttcttgatga tctcaaaaat aatagctatt caagaaaatc
3001 accaagtgac tgtgaaaccg tcagttcgga aggctggtta acatgtgg gagcaacatg
3061 aatgttctac aaaagtttaa agcagagatt gtttcaaatg ggtgtagtag atattactga
3121 aaaccaaaaa agagtgagat tgtcagtgta agaatgtgat ttaatgtttg tagtgcttac
3181 aattttgtgt accaactgga tgactaaaaa gagtaaaata atttaattaa tagctcatat
3241 tttatgtgtg aaaacatgtt agtgaacata tataatcaaa atagatttca ttgctattgc
3301 atagtctcta atacatagaa tgattttgct tttctctttt attatacttg ctttaaaata
3361 cttgaaatat attttgcatt aaatgcattt caagttaaat gtcttaaatg tatacattag
3421 atgtgtgttt taaaatgcat aaaacacgtt gaaatacatt aatgaaccat t
```

Human IL-1RL2 mRNA
(SEQ ID NO: 122)

```
   1 cccgcccacg gtggcgggga aataacctagg catggaagtg gcatgacagg gctcgtgtcc
  61 ctgtcatatt ttccactctc cacgaggtcc tgcgcgcttc aatcctgcag gcagcccggt
 121 ttggggatgt ggtccttgct gctctgcggg ttgtccatcg cccttccact gtctgtcaca
 181 gcagatggat gcaaggacat ttttatgaaa aatgagatac tttcagcaag ccagcctttt
 241 gcttttaatt gtacattccc tcccataaca tctggggaag tcagtgtaac atggtataaa
 301 aattctagca aaatcccagt gtccaaaatc atacagtcta gaattcacca ggacgagact
 361 tggattttgt ttctccccat ggaatggggg gactcaggag tctaccaatg tgttataaag
 421 ggtagagaca gctgtcatag aatacatgta aacctaactg tttttgaaaa acattggtgt
 481 gacacttcca taggtggttt accaaattta tcagatgagt acaagcaaat attacatctt
 541 ggaaaagatg atagtctcac atgtcatctg cacttcccga agagttgtgt tttgggtcca
 601 ataaagtggt ataaggactg taacgagatt aaaggggagc ggttcactgt tttggaaacc
 661 aggcttttgg tgagcaatgt ctcggcagag gacagaggga actacgcgtg tcaagccata
 721 ctgacacact cagggaagca gtacgaggtt ttaaatggca tcactgtgag cattacagaa
 781 agagctggat atggaggaag tgtccctaaa atcatttatc caaaaaatca ttcaattgaa
 841 gtacagcttg gtaccactct gattgtggac tgcaatgtaa cagacaccaa ggataataca
 901 aatctacgat gctggagagt caataacact ttggtggatg attactatga tgaatccaaa
 961 cgaatcagag aaggggtgga aacccatgtc tcttttcggg aacataattt gtacacagta
1021 aacatcacct tcttggaagt gaaaatggaa gattatgcc ttcctttcat gtgccacgct
1081 ggagtgtcca cagcatacat tatattacag ctcccagctc cggattttcg agcttacttg
1141 ataggagggc ttatcgcctt ggtggctgtg gctgtgtctg ttgtgtacat atacaacatt
1201 tttaagatcg acattgttct ttggtatcga agtgccttcc attctacaga gaccatagta
1261 gatgggaagc tgtatgacgc ctatgtctta taccccaagc cccacaagga aagccagagg
1321 catgccgtgg atgccctggt gttgaatatc ctgcccgagg tgttggagag acaatgtgga
1381 tataagttgt ttatattcgg cagagatgaa ttccctggac aagccgtggc caatgtcatc
1441 gatgaaaacg ttaagctgtg caggaggctg attgtcattg tggtccccga tcgctgggc
1501 tttggcctgt tgaagaacct gtcagaagaa caaatcgcgg tctacagtgc cctgatccag
1561 gacgggatga aggttattct cattgagctg gagaaaatcg aggactacac agtcatgcca
1621 gagtcaattc agtacatcaa acagaagcat ggtgccatcc ggtggcatgg ggacttcacg
1681 gagcagtcac agtgtatgaa gaccaagttt tggaagacag tgagatacca catgccgccc
```

-continued

```
1741 agaaggtgtc ggccgtttcc tccggtccag ctgctgcagc acacacttg ctaccgcacc 1801 gcaggcccag aactaggctc aagaagaaag aagtgtactc tcacgactgc ctaagacttg 1861 ctggactgac acctatggct ggaagatgac ttgttttgct ccatgtctcc tcattcctac 1921 acctattttc tgctgcagga tgaggctagg gttagcattc taga
```

Human IL1RL1 mRNA Variant 1

(SEQ ID NO: 123)

```
   1 aaagagaggc tggctgttgt atttagtaaa gctataaagc tgtaagagaa attggctttc 61 tgagttgtga aactgtgggc agaaagttga ggaagaaaga actcaagtac aacccaatga 121 ggttgagata taggctactc ttcccaactc agtcttgaag agtatcacca actgcctcat 181 gtgtggtgac cttcactgtc gtatgccagt gactcatctg gagtaatctc aacaacgagt 241 taccaatact tgctcttgat tgataaacag aatggggttt tggatcttag caattctcac 301 aattctcatg tattccacag cagcaaagtt tagtaaacaa tcatgggcc tggaaaatga 361 ggctttaatt gtaagatgtc ctagacaagg aaaacctagt tacaccgtgg attggtatta 421 ctcacaaaca aacaaaagta ttcccactca ggaaagaaat cgtgtgtttg cctcaggcca 481 acttctgaag tttctaccag ctgcagttgc tgattctggt atttatacct gtattgtcag 541 aagtcccaca ttcaatagga ctggatatgc aatgtcacc atatataaaa acaatcaga 601 ttgcaatgtt ccagattatt tgatgtattc aacagtatct ggatcagaaa aaaattccaa 661 aatttattgt cctaccattg acctctacaa ctggacagca cctcttgagt ggtttaagaa 721 ttgtcaggct cttcaaggat caaggtacag ggcgcacaag tcattttgg tcattgataa 781 tgtgatgact gaggacgcag gtgattacac ctgtaaattt atacacaatg aaaatggagc 841 caattatagt gtgacggcga ccaggtcctt cacggtcaag gatgagcaag cttttctct 901 gtttccagta atcggagccc ctgcacaaaa tgaaataaag gaagtggaaa ttgaaaaaa 961 cgcaaaccta acttgctctg cttgttttgg aaaaggcact cagttcttgg ctgccgtcct 1021 gtggcagctt aatggaacaa aaattacaga ctttggtgaa ccaagaattc aacaagagga 1081 agggcaaaat caaagtttca gcaatgggct ggcttgtcta gacatggttt taagaatagc 1141 tgacgtgaag gaagaggatt tattgctgca gtacgactgt ctggccctga atttgcatgg 1201 cttgagaagg cacaccgtaa gactaagtag gaaaaatcca attgatcatc atagcatcta 1261 ctgcataatt gcagtatgta gtgtattttt aatgctaatc aatgtcctgg ttatcatcct 1321 aaaaatgttc tggattgagg ccactctgct ctggagagac atagctaaac cttacaagac 1381 taggaatgat ggaaagctct atgatgctta tgttgtctac ccacggaact acaaatccag 1441 tacagatggg gccagtcgtg tagagcactt tgttcaccag attctgcctg atgttcttga 1501 aaataaatgt ggctatacct tatgcatta tgggagagat atgctacctg agaagatgt 1561 agtcactgca gtggaaacca acatacgaaa gagcaggcgg cacattttca tcctgaccccс

1621 tcagatcact cacaataagg agtttgccta cgagcaggag gttgccctgc actgtgccct 1681 catccagaac gacgccaagg tgatacttat tgagatggag gctctgagcg agctggacat 1741 gctgcaggct gaggcgcttc aggactccct ccagcatctt atgaaagtac aggggaccat 1801 caagtggagg gaggaccaca ttgccaataa aagtccctg aattctaaat tctggaagca 1861 cgtgaggtac caaatgcctg tgccaagcaa aattcccaga aaggcctcta gtttgactcc 1921 cttggctgcc cagaagcaat agtgcctgct gtgatgtgca aaggcatctg agtttgaagc 1981 tttcctgact tctccctagct ggcttatgcc cctgcactga agtgtgagga gcaggaatat 2041 taaagggatt caggcctc
```

-continued

Human IL1RL1 mRNA Variant 2

(SEQ ID NO: 124)

```
   1 agtctatgag gagggaccta caaagactgg aaactattct tagctccgtc actgactcca
  61 agttcatccc ctctgtcttt cagtttggtt gagatatagg ctactcttcc caactcagtc
 121 ttgaagagta tcaccaactg cctcatgtgt ggtgaccttc actgtcgtat gccagtgact
 181 catctggagt aatctcaaca acgagttacc aatacttgct cttgattgat aaacagaatg
 241 gggttttgga tcttagcaat tctcacaatt ctcatgtatt ccacagcagc aaagtttagt
 301 aaacaatcat ggggcctgga aaatgaggct ttaattgtaa gatgtcctag acaaggaaaa
 361 cctagttaca ccgtggattg gtattactca caaacaaaca aaagtattcc cactcaggaa
 421 agaaatcgtg tgtttgcctc aggccaactt ctgaagtttc taccagctgc agttgctgat
 481 tctggtattt atacctgtat tgtcagaagt cccacattca ataggactgg atatgcgaat
 541 gtcaccatat ataaaaaaca atcagattgc aatgttccag attatttgat gtattcaaca
 601 gtatctggat cagaaaaaaa ttccaaaatt tattgtccta ccattgacct ctacaactgg
 661 acagcacctc ttgagtggtt taagaattgt caggctcttc aaggatcaag gtacagggcg
 721 cacaagtcat ttttggtcat tgataatgtg atgactgagg acgcaggtga ttacacctgt
 781 aaatttatac acaatgaaaa tggagccaat tatagtgtga cggcgaccag gtccttcacg
 841 gtcaaggatg agcaaggctt ttctctgttt ccagtaatcg gagcccctgc acaaaatgaa
 901 ataaaggaag tggaaattgg aaaaaacgca aacctaactt gctctgcttg ttttggaaaa
 961 ggcactcagt tcttggctgc cgtcctgtgg cagcttaatg gaacaaaaat tacagacttt
1021 ggtgaaccaa gaattcaaca agaggaaggg caaaatcaaa gtttcagcaa tgggctggct
1081 tgtctagaca tggtttttaag aatagctgac gtgaaggaag aggatttatt gctgcagtac
1141 gactgtctgg ccctgaattt gcatggcttg agaaggcaca ccgtaagact aagtaggaaa
1201 aatccaagta aggagtgttt ctgagacttt gatcacctga actttctcta gcaagtgtaa
1261 gcagaatgga gtgtggttcc aagagatcca tcaagacaat gggaatggcc tgtgccataa
1321 aatgtgcttc tcttcttcgg gatgttgttt gctgtctgat ctttgtagac tgttcctgtt
1381 tgctgggagc ttctctgctg cttaaattgt tcgtcctccc ccactccctc ctatcgttgg
1441 tttgtctaga cactcagct gcttctttgg tcatccttgt tttctaactt tatgaactcc
1501 ctctgtgtca ctgtatgtga aggaaatgc accaacaacc gtaaactgaa cgtgttcttt
1561 tgtgctcttt tataacttgc attacatgtt gtaagcatgg tccgttctat accttttct
1621 ggtcataatg aacactcatt ttgttagcga gggtggtaaa gtgaacaaaa agggggaagta
1681 tcaaactact gccatttcag tgagaaaatc ctaggtgcta ctttataata agacatttgt
1741 taggccattc ttgcattgat ataagaaat acctgagact gggtgattta tatgaaaaga
1801 ggtttaattg gctcacagtt ctgcaggctg tatgggaagc atggcggcat ctgcttctgg
1861 ggacacctca ggagctttac tcatggcaga aggcaaagca aaggcaggca cttcacacag
1921 taaaagcagg agcgagagag aggtgccaca ctgaaacagc cagatctcat gagaagtcac
1981 tcactattgc aaggacagca tcaaagagat ggtgctaaac cattcatgat gaactcaccc
2041 ccatgatcca atcacctccc accaggctcc acctcgaata ctgggattaa ccattcagca
2101 tgagatttgg gcaggaacac agacccaaac cataccacac acattatcat tgttaaactt
2161 tgtaaagtat ttaaggtaca tggaacacac gggaagtctg gtagctcagc ccatttcttt
2221 attgcatctg ttattcacca tgtaattcag gtaccacgta ttccagggag cctttcttgg
2281 ccctcagttt gcagtataca cactttccaa gtactcttgt agcatcctgt ttgtatcata
```

-continued

```
2341 gcactggtca cattgcctta cctaaatctg tttgacagtc tgctcaacac gactgcaagc 2401 tccatgaggg cagggacatc atctcttcca tctttgggtc cttagtgcaa tacctggcag 2461 ctagccagtg ctcagctaaa tatttgttga ctgaataaat gaatgcacaa ccaaattatt 2521 gataccaaat gttttttttg tgtacatttc tacttctcta gctataagtc ttaattatac 2581 aacaaaatac tattttata tttatgtttg gtaaattcaa taactttcct catcatttgg 2641 aaagtcaaat tgtttattgc ttccctacag ttttttctga atctagcagg attttaatga 2701 tatcattata atttgacaca ataaaaggac aacatgaaac tgatgaatct ttattgggtt 2761 aatttcagac actatataat cttttaaaaa tgtaacattc ttttttatat ataaataatt 2821 ggtggcatca caaatagcca aagcagggtg gagagagtga tccttcctgg gtgcaggcaa 2881 gaaggggata tgttttctac agagttttca aaacagtgat aaagctgtct acaagtcatt 2941 gtgcttttta tcatcactat gcccagacaa tgtgaaacat cagagatgaa gtgctcttcc 3001 cacagaggtg gactgatcct tctccccact cccttggtgt gtctctgaat gcaatgttgt 3061 cttggaaaac agctttccaa gcatttcact cctgagcact tgccagtttc tcacttgtt 3121 cttcacatat ccaggcaaag acatcctgtt tgctatatga agcattgtat cccgtataaa 3181 aggaaggaaa gagagaaata tattttttaca ctcatcactc ctcagggggct gtacaatcat 3241 gtagaaattg tttaatgtgc ctgtcaaata gccaaagagt gttaaaccct gagttcccac 3301 ccatgtgtgt ggtatggtta ggattcatcc agatacacag agagaggcac aacaggagga 3361 gaaaggatag gggtgtgggg acagcgggcc cccaatatgg tgtaatcgtg gcaggtctct 3421 gcctgaagtg ctatgtgggg ttttctcttgt tttaattttg actttaaccc ctgatttgta 3481 agtttttcat aaaataaaca gaatcataac tcatgtagat ggctataagt gccgtagtgt 3541 tctgtgggtc tctggtgtct gccagtgata agtgtggcac cccaggaagg ctgtggaccc 3601 catcaaggtg ctatgtgagg gccatgcttg gggtggtggt gggcccagta gaccctgcag 3661 ccatccatcc agcctgccca ctcacactgc ccttgtgtac tcctgctttg ctacgttatc 3721 attgatcaat gtccctggtt acctatgtgt ttgaattatc ttcgtgttac aggtgtttaa 3781 tgattttgct ccttctagct tatttgtatt tcacctgttt ttctttaaat caacatggtt 3841 acactctgtt tcagcaactg tataaattaa acacaaatta ttactactgc taaaaaaaaa 3901 aaaaaaaaa
```

Human IL1RL1 mRNA Variant 3

(SEQ ID NO: 125)

```
  1 aaagagaggc tggctgttgt atttagtaaa gctataaagc tgtaagagaa attggctttc 61 tgagttgtga aactgtgggc agaaagttga ggaagaaaga actcaagtac aacccaatga 121 gggccaactt ctgaagtttc taccagctgc agttgctgat tctggtattt atacctgtat 181 tgtcagaagt cccacattca ataggactgg atatgcgaat gtcaccatat ataaaaaaca 241 atcagattgc aatgttccag attatttgat gtattcaaca gtatctggat cagaaaaaaa 301 ttccaaaatt tattgtccta ccattgacct ctacaactgg acagcacctc ttgagtggtt 361 taagaattgt caggctcttc aaggatcaag gtacagggcg cacaagtcat ttttggtcat 421 tgataatgtg atgactgagg acgcaggtga ttacacctgt aaatttatac acaatgaaaa 481 tggagccaat tatagtgtga cggcgaccag gtccttcacg gtcaaggatg agcaaggctt 541 ttctctgttt ccagtaatcg agcccctgc acaaaatgaa ataaggaag tggaaattgg 601 aaaaaacgca aacctaactt gctctgcttg ttttggaaaa ggcactcagt tcttggctgc 661 cgtcctgtgg cagcttaatg aacaaaaat tacagacttt ggtgaaccaa gaattcaaca 721 agaggaaggg caaaatcaaa gtttcagcaa tgggctggct tgtctagaca tggttttaag
```

-continued

```
 781 aatagctgac gtgaaggaag aggatttatt gctgcagtac gactgtctgg ccctgaattt
 841 gcatggcttg agaaggcaca ccgtaagact aagtaggaaa aatccaagta aggagtgttt
 901 ctgagacttt gatcacctga actttctcta gcaagtgtaa gcagaatgga gtgtggttcc
 961 aagagatcca tcaagacaat gggaatggcc tgtgccataa aatgtgcttc tcttcttcgg
1021 gatgttgttt gctgtctgat ctttgtagac tgttcctgtt tgctgggagc ttctctgctg
1081 cttaaattgt tcgtcctccc ccactccctc ctatcgttgg tttgtctaga cactcagct
1141 gcttctttgg tcatccttgt tttctaactt tatgaactcc ctctgtgtca ctgtatgtga
1201 aaggaaatgc accaacaacc gtaaactgaa cgtgttcttt tgtgctcttt tataacttgc
1261 attacatgtt gtaagcatgg tccgttctat accttttcct ggtcataatg aacactcatt
1321 ttgttagcga gggtggtaaa gtgaacaaaa aggggaagta tcaaactact gccatttcag
1381 tgagaaaatc ctaggtgcta ctttataata agacatttgt taggccattc ttgcattgat
1441 ataagaaat acctgagact gggtgattta tatgaaaaga ggtttaattg gctcacagtt
1501 ctgcaggctg tatgggaagc atggcggcat ctgcttctgg ggacacctca ggagctttac
1561 tcatggcaga aggcaaagca aaggcaggca cttcacacag taaaagcagg agcgagagag
1621 aggtgccaca ctgaaacagc cagatctcat gagaagtcac tcactattgc aaggacagca
1681 tcaaagagat ggtgctaaac cattcatgat gaactcaccc ccatgatcca atcacctccc
1741 accaggctcc acctcgaata ctggggatta ccattcagca tgagatttgg gcaggaacac
1801 agacccaaac cataccacac acattatcat tgttaaactt tgtaaagtat ttaaggtaca
1861 tggaacacac gggaagtctg gtagctcagc ccatttcttt attgcatctg ttattcacca
1921 tgtaattcag gtaccacgta ttccagggag cctttcttgg ccctcagttt gcagtataca
1981 cactttccaa gtactcttgt agcatcctgt ttgtatcata gcactggtca cattgcctta
2041 cctaaatctg tttgacagtc tgctcaacac gactgcaagc tccatgaggg cagggacatc
2101 atctcttcca tctttgggtc cttagtgcaa tacctggcag ctagccagtg ctcagctaaa
2161 tatttgttga ctgaataaat gaatgcacaa ccaaattatt gataccaaat gttttttttg
2221 tgtacatttc tacttctcta gctataagtc ttaattatac aacaaaatac tatttttata
2281 tttatgtttg gtaaattcaa taactttcct catcatttgg aaagtcaaat tgtttattgc
2341 ttccctacag ttttttctga atctagcagg attttaatga tatcattata atttgacaca
2401 ataaaaggac aacatgaaac tgatgaatct ttattgggtt aatttcagac actatataat
2461 cttttaaaaa tgtaacattc tttttatat ataaataatt ggtggcatca caaatagcca
2521 aagcagggtg gagagagtga tccttcctgg gtgcaggcaa gaagggata tgttttctac
2581 agagttttca aaacagtgat aaagctgtct acaagtcatt gtgcttttta tcatcactat
2641 gcccagacaa tgtgaaacat cagagatgaa gtgctcttcc cacagaggtg gactgatcct
2701 tctccccact cccttggtgt gtctctgaat gcaatgttgt cttggaaaac agctttccaa
2761 gcatttcact cctgagcact tgccagtttc ctcacttgtt cttcacatat ccaggcaaag
2821 acatcctgtt tgctatatga agcattgtat cccgtataaa aggaaggaaa gagagaaata
2881 tatttttaca ctcatcactc ctcagggct gtacaatcat gtagaaattg tttaatgtgc
2941 ctgtcaaata gccaaagagt gttaaaccct gagttcccac ccatgtgtgt ggtatggtta
3001 ggattcatcc agatacacag agagaggcac aacaggagga gaaaggatag gggtgtgggg
3061 acagcgggcc cccaatatgg tgtaatcgtg gcaggtctct gcctgaagtg ctatgtgggg
3121 ttttcttgt tttaattttg actttaaccc ctgatttgta agttttcat aaaataaaca
```

```
                                          -continued
3181 gaatcataac tcatgtagat ggctataagt gccgtagtgt tctgtgggtc tctggtgtct 3241 gccagtgata agtgtggcac cccaggaagg ctgtggaccc catcaaggtg ctatgtgagg 3301 gccatgcttg gggtggtggt gggcccagta gaccctgcag ccatccatcc agcctgccca 3361 ctcacactgc ccttgtgtac tcctgctttg ctacgttatc attgatcaat gtccctggtt 3421 acctatgtgt ttgaattatc ttcgtgttac aggtgtttaa tgattttgct ccttctagct 3481 tatttgtatt tcacctgttt ttctttaaat caacatggtt acactctgtt tcagcaactg 3541 tataaattaa acacaaatta ttactactgc taaaaaaaaa aaaaaaaaa
```

An antisense nucleic acid molecule can be complementary to all or part of a non-coding region of the coding strand of a nucleotide sequence encoding an IL-1α, IL-1β, IL-18, IL-36α, IL-36β, IL-36γ, IL-38, IL-33, IL-1R1, IL1RAP, IL-18Rα, IL-1RL2, or IL1RL1 protein. Non-coding regions (5' and 3' untranslated regions) are the 5' and 3' sequences that flank the coding region in a gene and are not translated into amino acids.

Based upon the sequences disclosed herein, one of skill in the art can easily choose and synthesize any of a number of appropriate antisense nucleic acids to target a nucleic acid encoding an IL-1α, IL-1β, IL-18, IL-36α, IL-36β, IL-36γ, IL-38, IL-33, IL-1R1, IL1RAP, IL-18Rα, IL-1RL2, or IL1RL1 protein described herein. Antisense nucleic acids targeting a nucleic acid encoding an IL-1α, IL-1β, IL-18, IL-36α, IL-36β, IL-36γ, IL-38, IL-33, IL-1R1, IL1RAP, IL-18Rα, IL-1RL2, or IL1RL1 protein can be designed using the software available at the Integrated DNA Technologies website.

An antisense nucleic acid can be, for example, about 5, 10, 15, 20, 25, 30, 35, 40, 45, or 50 nucleotides or more in length. An antisense oligonucleotide can be constructed using chemical synthesis and enzymatic ligation reactions using procedures known in the art. For example, an antisense nucleic acid can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used.

Examples of modified nucleotides which can be used to generate an antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3) w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest).

The antisense nucleic acid molecules described herein can be prepared in vitro and administered to a mammal, e.g., a human. Alternatively, they can be generated in situ such that they hybridize with or bind to cellular mRNA and/or genomic DNA encoding an IL-1α, IL-1β, IL-18, IL-36α, IL-36β, IL-36γ, IL-38, IL-33, IL-1R1, IL1RAP, IL-18Rα, IL-1RL2, or IL1RL1 protein to thereby inhibit expression, e.g., by inhibiting transcription and/or translation. The hybridization can be by conventional nucleotide complementarities to form a stable duplex, or, for example, in the case of an antisense nucleic acid molecule that binds to DNA duplexes, through specific interactions in the major groove of the double helix. The antisense nucleic acid molecules can be delivered to a mammalian cell using a vector (e.g., a lentivirus, a retrovirus, or an adenovirus vector).

An antisense nucleic acid can be an α-anomeric nucleic acid molecule. An α-anomeric nucleic acid molecule forms specific double-stranded hybrids with complementary RNA in which, contrary to the usual, β-units, the strands run parallel to each other (Gaultier et al., *Nucleic Acids Res.* 15:6625-6641, 1987). The antisense nucleic acid can also comprise a 2'-O-methylribonucleotide (Inoue et al., *Nucleic Acids Res.* 15:6131-6148, 1987) or a chimeric RNA-DNA analog (Inoue et al., *FEBS Lett.* 215:327-330, 1987).

Another example of an inhibitory nucleic acid is a ribozyme that has specificity for a nucleic acid encoding an IL-1α, IL-1β, IL-18, IL-36α, IL-36β, IL-36γ, IL-38, IL-33, IL-1R1, IL1RAP, IL-18Rα, IL-1RL2, or IL1RL1 protein (e.g., specificity for an IL-1α, IL-1β, IL-18, IL-36α, IL-36β, IL-36γ, IL-38, IL-33, IL-1R1, IL1RAP, IL-18Rα, IL-1RL2, or IL1RL1 mRNA, e.g., specificity for any one of SEQ ID NOs: 62-102). Ribozymes are catalytic RNA molecules with ribonuclease activity that are capable of cleaving a single-stranded nucleic acid, such as an mRNA, to which they have a complementary region. Thus, ribozymes (e.g., hammerhead ribozymes (described in Haselhoff and Gerlach, *Nature* 334:585-591, 1988)) can be used to catalytically cleave mRNA transcripts to thereby inhibit translation of the protein encoded by the mRNA. A ribozyme having specificity for an IL-1α, IL-1β, IL-18, IL-36α, IL-36β, IL-36γ, IL-38, IL-33, IL-1R1, IL1RAP, IL-18Rα, IL-1RL2, or IL1RL1 mRNA can be designed based upon the nucleotide sequence of any of the IL-1α, IL-1β, IL-18, IL-36α, IL-36β, IL-36γ, IL-38, IL-33, IL-1R1, IL1RAP, IL-18Rα, IL-1RL2, or IL1RL1 mRNA sequences disclosed herein. For example, a derivative of a Tetrahymena L-19 IVS RNA can be constructed in which the nucleotide sequence of the active site is complementary to the nucleotide sequence to be cleaved in an IL-1α, IL-1β, IL-18, IL-36α, IL-36β, IL-36γ, IL-38, IL-33, IL-1R1, IL1RAP, IL-18Rα, IL-1RL2, or IL1RL1 mRNA (see, e.g., U.S. Pat. Nos. 4,987,071 and 5,116,742).

Alternatively, a SMAD7 mRNA can be used to select a catalytic RNA having a specific ribonuclease activity from a pool of RNA molecules. See, e.g., Bartel et al., *Science* 261:1411-1418, 1993.

An inhibitory nucleic acid can also be a nucleic acid molecule that forms triple helical structures. For example, expression of an IL-1α, IL-1β, IL-18, IL-36α, IL-36β, IL-36γ, IL-38, IL-33, IL-1R1, IL1RAP, IL-18Rα, IL-1RL2, or IL1RL1 polypeptide can be inhibited by targeting nucleotide sequences complementary to the regulatory region of the gene encoding the IL-1α, IL-1β, IL-18, IL-36α, IL-36β, IL-36γ, IL-38, IL-33, IL-1R1, IL1RAP, IL-18Rα, IL-1RL2, or IL1RL1 polypeptide (e.g., the promoter and/or enhancer, e.g., a sequence that is at least 1 kb, 2 kb, 3 kb, 4 kb, or 5 kb upstream of the transcription initiation start state) to form triple helical structures that prevent transcription of the gene in target cells. See generally Helene, *Anticancer Drug Des.* 6 (6): 569-84, 1991; Helene, *Ann. N.Y. Acad. Sci.* 660:27-36, 1992; and Maher, *Bioassays* 14 (12): 807-15, 1992.

In various embodiments, inhibitory nucleic acids can be modified at the base moiety, sugar moiety, or phosphate backbone to improve, e.g., the stability, hybridization, or solubility of the molecule. For example, the deoxyribose phosphate backbone of the nucleic acids can be modified to generate peptide nucleic acids (see, e.g., Hyrup et al., *Bioorganic Medicinal Chem.* 4 (1): 5-23, 1996). Peptide nucleic acids (PNAs) are nucleic acid mimics, e.g., DNA mimics, in which the deoxyribose phosphate backbone is replaced by a pseudopeptide backbone and only the four natural nucleobases are retained. The neutral backbone of PNAs allows for specific hybridization to DNA and RNA under conditions of low ionic strength. The synthesis of PNA oligomers can be performed using standard solid phase peptide synthesis protocols (see, e.g., Perry-O'Keefe et al., *Proc. Natl. Acad. Sci. U.S.A.* 93:14670-675, 1996). PNAs can be used as antisense or antigene agents for sequence-specific modulation of gene expression by, e.g., inducing transcription or translation arrest or inhibiting replication.

PNAs can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras can be generated which may combine the advantageous properties of PNA and DNA. Such chimeras allow DNA recognition enzymes, e.g., RNAse H and DNA polymerases, to interact with the DNA portion while the PNA portion would provide high binding affinity and specificity. PNA-DNA chimeras can be linked using linkers of appropriate lengths selected in terms of base stacking, number of bonds between the nucleobases, and orientation.

The synthesis of PNA-DNA chimeras can be performed as described in Finn et al., *Nucleic Acids Res.* 24:3357-63, 1996. For example, a DNA chain can be synthesized on a solid support using standard phosphoramidite coupling chemistry and modified nucleoside analogs. Compounds such as 5'-(4-methoxytrityl)amino-5'-deoxy-thymidine phosphoramidite can be used as a link between the PNA and the 5' end of DNA (Mag et al., *Nucleic Acids Res.* 17:5973-88, 1989). PNA monomers are then coupled in a stepwise manner to produce a chimeric molecule with a 5' PNA segment and a 3' DNA segment (Finn et al., *Nucleic Acids Res.* 24:3357-63, 1996). Alternatively, chimeric molecules can be synthesized with a 5' DNA segment and a 3' PNA segment (Peterser et al., *Bioorganic Med. Chem. Lett.* 5:1119-11124, 1975).

In some embodiments, the inhibitory nucleic acids can include other appended groups such as peptides, or agents facilitating transport across the cell membrane (see, Letsinger et al., *Proc. Natl. Acad. Sci. U.S.A.* 86:6553-6556, 1989; Lemaitre et al., *Proc. Natl. Acad. Sci. U.S.A.* 84:648-652, 1989; and WO 88/09810). In addition, the inhibitory nucleic acids can be modified with hybridization-triggered cleavage agents (see, e.g., Krol et al., *Bio/Techniques* 6:958-976, 1988) or intercalating agents (see, e.g., Zon, *Pharm. Res.*, 5:539-549, 1988). To this end, the oligonucleotide may be conjugated to another molecule, e.g., a peptide, hybridization triggered cross-linking agent, transport agent, hybridization-triggered cleavage agent, etc.

Another means by which expression of an IL-1α, IL-1β, IL-18, IL-36α, IL-36β, IL-36γ, IL-38, IL-33, IL-1R1, IL1RAP, IL-18Rα, IL-1RL2, or IL1RL1 mRNA can be decreased in a mammalian cell is by RNA interference (RNAi). RNAi is a process in which mRNA is degraded in host cells. To inhibit an mRNA, double-stranded RNA (dsRNA) corresponding to a portion of the gene to be silenced (e.g., a gene encoding an IL-1α, IL-1β, IL-18, IL-36α, IL-36β, IL-36γ, IL-38, IL-33, IL-1R1, IL1RAP, IL-18Rα, IL-1RL2, or IL1RL1 polypeptide) is introduced into a mammalian cell. The dsRNA is digested into 21-23 nucleotide-long duplexes called short interfering RNAs (or siRNAs), which bind to a nuclease complex to form what is known as the RNA-induced silencing complex (or RISC). The RISC targets the homologous transcript by base pairing interactions between one of the siRNA strands and the endogenous mRNA. It then cleaves the mRNA about 12 nucleotides from the 3' terminus of the siRNA (see Sharp et al., *Genes Dev.* 15:485-490, 2001, and Hammond et al., *Nature Rev. Gen.* 2:110-119, 2001).

RNA-mediated gene silencing can be induced in a mammalian cell in many ways, e.g., by enforcing endogenous expression of RNA hairpins (see, Paddison et al., *Proc. Natl. Acad. Sci. U.S.A.* 99:1443-1448, 2002) or, as noted above, by transfection of small (21-23 nt) dsRNA (reviewed in Caplen, *Trends Biotech.* 20:49-51, 2002). Methods for modulating gene expression with RNAi are described, e.g., in U.S. Pat. No. 6,506,559 and US 2003/0056235, which are hereby incorporated by reference.

Standard molecular biology techniques can be used to generate siRNAs. Short interfering RNAs can be chemically synthesized, recombinantly produced, e.g., by expressing RNA from a template DNA, such as a plasmid, or obtained from commercial vendors, such as Dharmacon. The RNA used to mediate RNAi can include synthetic or modified nucleotides, such as phosphorothioate nucleotides. Methods of transfecting cells with siRNA or with plasmids engineered to make siRNA are routine in the art.

The siRNA molecules used to decrease expression of an IL-1α, IL-1β, IL-18, IL-36α, IL-36β, IL-36γ, IL-38, IL-33, IL-1R1, IL1RAP, IL-18Rα, IL-1RL2, or IL1RL1 mRNA can vary in a number of ways. For example, they can include a 3' hydroxyl group and strands of 21, 22, or 23 consecutive nucleotides. They can be blunt ended or include an overhanging end at either the 3' end, the 5' end, or both ends. For example, at least one strand of the RNA molecule can have a 3' overhang from about 1 to about 6 nucleotides (e.g., 1-5, 1-3, 2-4, or 3-5 nucleotides (whether pyrimidine or purine nucleotides) in length. Where both strands include an overhang, the length of the overhangs may be the same or different for each strand.

To further enhance the stability of the RNA duplexes, the 3' overhangs can be stabilized against degradation (by, e.g., including purine nucleotides, such as adenosine or guanosine nucleotides or replacing pyrimidine nucleotides by modified analogues (e.g., substitution of uridine 2-nucleotide 3' overhangs by 2'-deoxythymidine is tolerated and does not affect the efficiency of RNAi). Any siRNA can be used in the methods of decreasing an IL-1α, IL-1β, IL-18, IL-36α, IL-36β, IL-36γ, IL-38, IL-33, IL-1R1, IL1RAP, IL-18Rα, IL-1RL2, or IL1RL1 mRNA, provided it has sufficient homology to the target of interest (e.g., a sequence present in any one of SEQ ID NOs: 62-102, e.g., a target sequence encompassing the translation start site or the first exon of the mRNA). There is no upper limit on the length of the siRNA that can be used (e.g., the siRNA can range from about 21 base pairs of the gene to the full length of the gene or more (e.g., about 20 to about 30 base pairs, about 50 to about 60 base pairs, about 60 to about 70 base pairs, about 70 to about 80 base pairs, about 80 to about 90 base pairs, or about 90 to about 100 base pairs).

As described herein, inhibitory nucleic acids preferentially bind (e.g., hybridize) to a nucleic acid encoding IL-1α, IL-1β, IL-18, IL-36α, IL-36β, IL-36γ, IL-38, IL-33, IL-1R1, IL1RAP, IL-18Rα, IL-1RL2, or IL1RL1 protein to treat allergic diseases (e.g., asthma (Corren et al., *N. Engl. J. Med.* 365:1088-1098, 2011)), radiation lung injury (Chung et al., *Sci. Rep.* 6:39714, 2016), ulcerative colitis (Hua et al., *Br. J. Clin. Pharmacol.* 80:101-109, 2015), dermatitis (Guttman-Yassky et al., *Exp. Opin. Biol. Ther.* 13 (4): 1517, 2013), and chronic obstructive pulmonary disease (COPD) (Walsh et al. (2010) *Curr. Opin. Investig Drugs.* 11 (11): 1305-1312, 2010).

Exemplary IL-1 inhibitors that are antisense nucleic acids are described in Yilmaz-Elis et al., *Mol. Ther. Nucleic Acids* 2 (1): e66, 2013; Lu et al., *J. Immunol.* 190 (12): 6570-6578, 2013), small interfering RNA (siRNA) (e.g., Ma et al., *Ann. Hepatol.* 15 (2): 260-270, 2016), or combinations thereof. In certain embodiments, a therapeutically effective amount of an inhibitory nucleic acid targeting a nucleic acid encoding IL-1α, IL-1β, IL-18, IL-36α, IL-36β, IL-36γ, IL-38, IL-33, IL-1R1, IL1RAP, IL-18Rα, IL-1RL2, or IL1RL1 protein can be administered to a subject (e.g., a human subject) in need thereof.

In some embodiments, the inhibitory nucleic acid can be about 10 nucleotides to about 40 nucleotides (e.g., about 10 to about 30 nucleotides, about 10 to about 25 nucleotides, about 10 to about 20 nucleotides, about 10 to about 15 nucleotides, 10 nucleotides, 11 nucleotides, 12 nucleotides, 13 nucleotides, 14 nucleotides, 15 nucleotides, 16 nucleotides, 17 nucleotides, 18 nucleotides, 19 nucleotides, 20 nucleotides, 21 nucleotides, 22 nucleotides, 23 nucleotides, 24 nucleotides, 25 nucleotides, 26 nucleotides, 27 nucleotides, 28 nucleotides, 29 nucleotides, 30 nucleotides, 31 nucleotides, 32 nucleotides, 33 nucleotides, 34 nucleotides, 35 nucleotides, 36 nucleotides, 37 nucleotides, 38 nucleotides, 39 nucleotides, or 40 nucleotides) in length. One skilled in the art will appreciate that inhibitory nucleic acids may comprise at least one modified nucleic acid at either the 5' or 3'end of DNA or RNA.

As is known in the art, the term "thermal melting point (Tm)" refers to the temperature, under defined ionic strength, pH, and inhibitory nucleic acid concentration, at which 50% of the inhibitory nucleic acids complementary to the target sequence hybridize to the target sequence at equilibrium. In some embodiments, an inhibitory nucleic acid can bind specifically to a target nucleic acid under stringent conditions, e.g., those in which the salt concentration is at least about 0.01 to 1.0 M Na ion concentration (or other salts) at pH 7.0 to 8.3 and the temperature is at least about 30° C. for short oligonucleotides (e.g., 10 to 50 nucleotide). Stringent conditions can also be achieved with the addition of destabilizing agents such as formamide.

In some embodiments of any of the inhibitory nucleic acids described herein, the inhibitory nucleic acid binds to a target nucleic acid (e.g., a nucleic acid encoding any one of IL-1α, IL-1β, IL-18, IL-36α, IL-36β, IL-36γ, IL-38, IL-33, IL-1R1, IL1RAP, IL-18Rα, IL-1RL2, or IL1RL1) with a Tm of greater than 20° C., greater than 22° C., greater than 24° C., greater than 26° C., greater than 28° C., greater than 30° C., greater than 32° C., greater than 34° C., greater than 36° C., greater than 38° C., greater than 40° C., greater than 42° C., greater than 44° C., greater than 46° C., greater than 48° C., greater than 50° C., greater than 52° C., greater than 54° C., greater than 56° C., greater than 58° C., greater than 60° C., greater than 62° C., greater than 64° C., greater than 66° C., greater than 68° C., greater than 70° C., greater than 72° C., greater than 74° C., greater than 76° C., greater than 78° C., or greater than 80° C., e.g., as measured in phosphate buffered saline using a UV spectrophotometer.

In some embodiments of any of the inhibitor nucleic acids described herein, the inhibitory nucleic acid binds to a target nucleic acid (e.g., a nucleic acid encoding any one of IL-1α, IL-1β, IL-18, IL-36α, IL-36β, IL-36γ, IL-38, IL-33, IL-1R1, IL1RAP, IL-18Rα, IL-1RL2, or IL1RL1) with a Tm of about 20° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., about 30° C., about 28° C., about 26° C., about 24° C., or about 22° C. (inclusive); about 22° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., about 30° C., about 28° C., about 26° C., or about 24° C. (inclusive); about 24° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., about 30° C., about 28° C., or about 26° C. (inclusive); about 26° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., about 30° C., or about 28° C. (inclusive); about 28° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., or about 30° C. (inclusive); about 30° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., or about 32° C. (inclusive); about 32° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., or about 34° C. (inclusive); about 34° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., or about 36° C. (inclusive); about 36° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., or about 38° C. (inclusive); about 38° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., or about 40° C. (inclusive); about 40° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., or about 42° C. (inclusive); about 42° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., or about 44° C. (inclusive); about 44° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., or about 46° C. (inclusive); about 46° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., or about 48° C. (inclusive); about 48° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., or about 50° C. (inclusive); about 50° C. to about 80° C., about 78° C., about 76° C., about 74° C., about 72° C., about 70° C., about 68° C., about 66° C., about 64° C., about 62° C., about 60° C., about 58° C., about 56° C., about 54° C., or about 52° C. (inclusive); about 52° C. to about 80° C., about 78° C., about 76° C., about 74° C., about 72° C., about 70° C., about 68° C., about 66° C., about 64° C., about 62° C., about 60° C., about 58° C., about 56° C., or about 54° C. (inclusive); about 54° C. to about 80° C., about 78° C., about 76° C., about 74° C., about 72° C., about 70° C., about 68° C., about 66° C., about 64° C., about 62° C., about 60° C., about 58° C., or about 56° C. (inclusive); about 56° C. to about 80° C., about 78° C., about 76° C., about 74° C., about 72° C., about 70° C., about 68° C., about 66° C., about 64° C., about 62° C., about 60° C., or about 58° C. (inclusive); about 58° C. to about 80° C., about 78° C., about 76° C., about 74° C., about 72° C., about 70° C., about 68° C., about 66° C., about 64° C., about 62° C., or about 60° C. (inclusive); about 60° C. to about 80° C., about 78° C., about 76° C., about 74° C., about 72° C., about 70° C., about 68° C., about 66° C., or about 62° C. (inclusive); about 62° C. to about 80° C., about 78° C., about 76° C., about 74° C., about 72° C., about 70° C., about 68° C., about 66° C., or about 64° C. (inclusive); about 64° C. to about 80° C., about 78° C., about 76° C., about 74° C., about 72° C., about 70° C., about 68° C., or about 66° C. (inclusive); about 66° C. to about 80° C., about 78° C., about 76° C., about 74° C., about 72° C., about 70° C., or about 68° C. (inclusive); about 68° C. to about 80° C., about 78° C., about 76° C., about 74° C., about 72° C., or about 70° C. (inclusive); about 70° C. to about 80° C., about 78° C., about 76° C., about 74° C., or about 72° C. (inclusive); about 72° C. to about 80° C., about 78° C., about 76° C., or about 74° C. (inclusive); about 74° C. to about 80° C., about 78° C., or about 76° C. (inclusive); about 76° C. to about 80° C. or about 78° C. (inclusive); or about 78° C. to about 80° C. (inclusive).

In some embodiments, the inhibitory nucleic acid can be formulated in a nanoparticle (e.g., a nanoparticle including one or more synthetic polymers, e.g., Patil et al., *Pharmaceutical Nanotechnol.* 367:195-203, 2009; Yang et al., *ACS Appl. Mater. Interfaces*, doi: 10.1021/acsami.6b16556, 2017; Perepelyuk et al., *Mol. Ther. Nucleic Acids* 6:259-268, 2017). In some embodiments, the nanoparticle can be a mucoadhesive particle (e.g., nanoparticles having a positively-charged exterior surface) (Andersen et al., *Methods Mol. Biol.* 555:77-86, 2009). In some embodiments, the nanoparticle can have a neutrally-charged exterior surface.

In some embodiments, the inhibitory nucleic acid can be formulated, e.g., as a liposome (Buyens et al., *J. Control Release* 158 (3): 362-370, 2012; Scarabel et al., *Expert Opin. Drug Deliv.* 17:1-14, 2017), a micelle (e.g., a mixed micelle) (Tangsangasaksri et al., *BioMacromolecules* 17:246-255, 2016; Wu et al., *Nanotechnology*, doi: 10.1088/1361-6528/aa6519, 2017), a microemulsion (WO 11/004395), a nanoemulsion, or a solid lipid nanoparticle (Sahay et al., *Nature Biotechnol.* 31:653-658, 2013; and Lin et al., *Nanomedicine* 9 (1): 105-120, 2014). Additional exemplary structural features of inhibitory nucleic acids and formulations of inhibitory nucleic acids are described in US 2016/0090598.

In some embodiments, a pharmaceutical composition can include a sterile saline solution and one or more inhibitory nucleic acid (e.g., any of the inhibitory nucleic acids described herein). In some examples, a pharmaceutical composition consists of a sterile saline solution and one or more inhibitory nucleic acid (e.g., any of the inhibitory nucleic acids described herein). In certain embodiments, the sterile saline is a pharmaceutical grade saline. In certain embodiments, a pharmaceutical composition can include one or more inhibitory nucleic acid (e.g., any of the inhibitory nucleic acids described herein) and sterile water. In certain embodiments, a pharmaceutical composition consists of one or more inhibitory nucleic acid (e.g., any of the inhibitory nucleic acids described herein) and sterile water. In certain embodiments, a pharmaceutical composition includes one or more inhibitory nucleic acid (e.g., any of the inhibitory nucleic acids described herein) and phosphate-buffered saline (PBS). In certain embodiments, a pharmaceutical composition consists of one or more inhibitory nucleic acids (e.g., any of the inhibitory nucleic acids described herein) and sterile phosphate-buffered saline (PBS). In some examples, the sterile saline is a pharmaceutical grade PBS.

In certain embodiments, one or more inhibitory nucleic acids (e.g., any of the inhibitory nucleic acids described herein) may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

Pharmaceutical compositions including one or more inhibitory nucleic acids encompass any pharmaceutically acceptable salts, esters, or salts of such esters. Non-limiting examples of pharmaceutical compositions include pharmaceutically acceptable salts of inhibitory nucleic acids. Suitable pharmaceutically acceptable salts include, but are not limited to, sodium and potassium salts.

Also provided herein are prodrugs that can include additional nucleosides at one or both ends of an inhibitory nucleic acid which are cleaved by endogenous nucleases within the body, to form the active inhibitory nucleic acid.

Lipid moieties can be used to formulate an inhibitory nucleic acid. In certain such methods, the inhibitory nucleic acid is introduced into preformed liposomes or lipoplexes made of mixtures of cationic lipids and neutral lipids. In certain methods, inhibitory nucleic acid complexes with mono- or poly-cationic lipids are formed without the presence of a neutral lipid. In certain embodiments, a lipid moiety is selected to increase distribution of an inhibitory nucleic acid to a particular cell or tissue in a mammal. In some examples, a lipid moiety is selected to increase distribution of an inhibitory nucleic acid to fat tissue in a mammal. In certain embodiments, a lipid moiety is selected to increase distribution of an inhibitory nucleic acid to muscle tissue.

In certain embodiments, pharmaceutical compositions provided herein comprise one or more inhibitory nucleic acid and one or more excipients. In certain such embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In some examples, a pharmaceutical composition provided herein includes liposomes and emulsions. Liposomes and emulsions can be used to formulate hydrophobic compounds. In some examples, certain organic solvents such as dimethylsulfoxide are used.

In some examples, a pharmaceutical composition provided herein includes one or more tissue-specific delivery molecules designed to deliver one or more inhibitory nucleic acids to specific tissues or cell types in a mammal. For example, a pharmaceutical composition can include liposomes coated with a tissue-specific antibody.

In some embodiments, a pharmaceutical composition provided herein can include a co-solvent system. Examples of such co-solvent systems include benzyl alcohol, a nonpolar surfactant, a water-miscible organic polymer, and an aqueous phase. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. As can be appreciated, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In some examples, a pharmaceutical composition can be formulated for oral administration. In some examples, pharmaceutical compositions are formulated for buccal administration.

In some examples, a pharmaceutical composition is formulated for administration by injection (e.g., intravenous, subcutaneous, intramuscular, etc.). In some of these embodiments, a pharmaceutical composition includes a carrier and is formulated in aqueous solution, such as water or physiologically compatible buffers such as Hanks's solution, Ringer's solution, or physiological saline buffer. In some examples, other ingredients are included (e.g., ingredients that aid in solubility or serve as preservatives). In some examples, injectable suspensions are prepared using appropriate liquid carriers, suspending agents, and the like. Some pharmaceutical compositions for injection are formulated in unit dosage form, e.g., in ampoules or in multi-dose containers. Some pharmaceutical compositions for injection are suspensions, solutions, or emulsions in oily or aqueous vehicles, and may contain formulatory agents such as suspending, stabilizing, and/or dispersing agents. Solvents suitable for use in pharmaceutical compositions for injection include, but are not limited to, lipophilic solvents and fatty oils, such as sesame oil, synthetic fatty acid esters, such as ethyl oleate or triglycerides, and liposomes.

Antibodies

In some embodiments, the IL-1 inhibitor is an antibody or an antigen-binding fragment thereof (e.g., a Fab or a scFv). In some embodiments, an antibody or antigen-binding fragment described herein binds specifically to any one of IL-1α, IL-1β, IL-18, IL-36α, IL-36β, IL-36γ, IL-38, and IL-33. In some embodiments, an antibody or antigen-binding fragment of an antibody described herein can bind specifically to one or both of IL-1R1 and IL1RAP. In some embodiments, an antibody or antigen-binding fragment of an antibody described herein can bind specifically to IL-18Rα. In some embodiments, an antibody or antigen-binding fragment of an antibody described herein can bind specifically to one or both of IL1RL1 and IL1RAP. In some embodiments, an antibody or antigen-binding fragment of an antibody described herein can bind to one or both of IL-1RL2 and IL-1RAP.

In some embodiments, the antibody can be a humanized antibody, a chimeric antibody, a multivalent antibody, or a fragment thereof. In some embodiments, an antibody can be a scFv-Fc, a VHH domain, a VNAR domain, a (scFv) 2, a minibody, or a BiTE. In some embodiments, an antibody can be a DVD-Ig, and a dual-affinity re-targeting antibody (DART), a triomab, kih IgG with a common LC, a crossmab, an ortho-Fab IgG, a 2-in-1-IgG, IgG-ScFv, scFv2-Fc, a bi-nanobody, tanden antibody, a DART-Fc, a scFv-HAS-scFv, DNL-Fab3, DAF (two-in-one or four-in-one), DutaMab, DT-IgG, knobs-in-holes common LC, knobs-in-holes assembly, charge pair antibody, Fab-arm exchange antibody, SEEDbody, Triomab, LUZ-Y, Fcab, kA-body, orthogonal Fab, DVD-IgG, IgG (H)-scFv, scFv-(H) IgG, IgG (L)-scFv, scFv-(L)-IgG, IgG (L,H)-Fc, IgG (H)-V, V (H)-IgG, IgG (L)-V, V (L)-IgG, KIH IgG-scFab, 2scFv-IgG, IgG-2scFv, scFv4-Ig, Zybody, DVI-IgG, nanobody, nanobody-HSA, a diabody, a TandAb, scDiabody, scDiabody-CH3, Diabody-CH3, Triple Body, miniantibody, minibody, TriBi minibody, scFv-CH3 KIH, Fab-scFv, scFv-CH-CL-scFv, F(ab')2-scFV2, scFv-KIH, Fab-scFv-Fc, tetravalent HCAb, scDiabody-Fc, diabody-Fc, tandem scFv-Fc, intrabody, dock and lock bispecific antibody, ImmTAC, HSAbody, scDiabody-HAS, tandem scFv, IgG-IgG, Cov-X-Body, and scFv1-PEG-scFv2.

Non-limiting examples of an antigen-binding fragment of an antibody include an Fv fragment, a Fab fragment, a F(ab')$_2$ fragment, and a Fab' fragment. Additional examples of an antigen-binding fragment of an antibody is an antigen-binding fragment of an IgG (e.g., an antigen-binding fragment of IgG1, IgG2, IgG3, or IgG4) (e.g., an antigen-binding fragment of a human or humanized IgG, e.g., human or humanized IgG1, IgG2, IgG3, or IgG4); an antigen-binding fragment of an IgA (e.g., an antigen-binding fragment of IgA1 or IgA2) (e.g., an antigen-binding fragment of a human or humanized IgA, e.g., a human or humanized IgA1 or IgA2); an antigen-binding fragment of an IgD (e.g., an antigen-binding fragment of a human or humanized IgD); an antigen-binding fragment of an IgE (e.g., an antigen-binding fragment of a human or humanized IgE); or an antigen-binding fragment of an IgM (e.g., an antigen-binding fragment of a human or humanized IgM).

In some embodiments, the IL-1 inhibitor is canakinumab (ACZ885, Ilaris®) (Dhimolca, MAbs 2 (1): 3-13, 2010; Yokota et al., Clin. Exp. Rheumatol. 2016; Torene et al., Ann. Rheum. Dis. 76 (1): 303-309, 2017; Gram, Curr. Opin. Chem. Biol. 32:1-9, 2016; Kontzias et al., Semin. Arthritis Rheum 42 (2): 201-205, 2012). In some embodiments, the IL-1 inhibitor is anakinra (Kineret®; Beynon et al., J. Clin. Rheumatol. 23 (3): 181-183, 2017; Stanam et al., Oncotarget 7 (46): 76087-76100, 2016; Nayki et al., J. Obstet Gynaecol. Res. 42 (11): 1525-1533, 2016; Greenhalgh et al., Dis. Model Mech. 5 (6): 823-833, 2012), or a variant thereof. In some embodiments, the IL-1 inhibitor is gevokizumab (XOMA 052; Knicklebein et al., Am. J. Ophthalmol. 172: 104-110, 2016; Roubille et al., Atherosclerosis 236 (2): 277-285, 2014; Issafras et al., J. Pharmacol. Exp. Ther. 348 (1): 202-215, 2014; Handa et al., Obesity 21 (2): 306-309, 2013; Geiler et al., Curr. Opin. Mol. Ther. 12 (6): 755-769, 2010), LY2189102 (Bihorel et al., AAPS J. 16 (5): 1009-1117, 2014; Sloan-Lancaster et al., Diabetes Care 36 (8): 2239-2246, 2013), MABp1 (Hickish et al., Lancey Oncol. 18 (2): 192-201, 2017; Timper et al., J. Diabetes Complications 29 (7): 955-960, 2015), CDP-484 (Braddock et al., Drug Discov. 3:330-339, 2004), or a variant thereof (Dinarello et al., Nat. Rev. Drug Discov. 11 (8): 633-652, 2012).

Further teachings of IL-1 inhibitors that are antibodies or antigen-binding fragments thereof are described in U.S. Pat. Nos. 5,075,222; 7,446,175; 7,531,166; 7,744,865; 7,829,093; and 8,273,350; US 2016/0326243; US 2016/0194392, and US 2009/0191187, each of which is incorporated by reference in its entirety.

In some embodiments, any of the antibodies or antigen-binding fragments described herein has a dissociation constant ($K_D$) of less than $1\times10^{-5}$ M (e.g., less than $0.5\times10^{-5}$ M, less than $1\times10^{-6}$ M, less than $0.5\times10^{-6}$ M, less than $1\times10^{-7}$ M, less than $0.5\times10^{-7}$ M, less than $1\times10^{-8}$ M, less than $0.5\times10^{-8}$ M, less than $1\times10^{-9}$ M, less than $0.5\times10^{-9}$ M, less than $1\times10^{-10}$ M, less than $0.5\times10^{-10}$ M, less than $1\times10^{-11}$ M, less than $0.5\times10^{-11}$ M, or less than $1\times10^{-12}$ M), e.g., as measured in phosphate buffered saline using surface plasmon resonance (SPR).

In some embodiments, any of the antibodies or antigen-binding fragments described herein has a $K_D$ of about $1\times10^{-12}$ M to about $1\times10^5$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$M, about $0.5\times10^{-9}$ M, about $1\times10^{-10}$M, about $0.5\times10^{-10}$M, about $1\times10^{-11}$ M, or about $0.5\times10^{-11}$ M (inclusive); about $0.5\times10^{-11}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$M, about $0.5\times10^{-9}$ M, about $1\times10^{-10}$M, about $0.5\times10^{-10}$ M, or about $1\times10^{-11}$ M (inclusive); about $1\times10^{-11}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$M, about $0.5\times10^{-9}$ M, about $1\times10^{-10}$M, or about $0.5\times10$ $10$ M (inclusive); about $0.5\times10^{-10}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, about $0.5\times10^{-9}$ M, or about $1\times10^{-10}$ M (inclusive); about $1\times10^{-10}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$M, or about $0.5\times10^{-9}$ M (inclusive); about $0.5\times10^{-9}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, or about $1\times10^{-9}$M (inclusive); about $1\times10^{-9}$ M to about $1\times10^5$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, or about $0.5\times10^{-8}$ M (inclusive); about $0.5\times10^{-8}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, or about $1\times10^{-8}$ M (inclusive); about $1\times10^{-8}$ M to about $1\times10^{-5}$ M, about $0.5\times10^{-5}$ M, about $1\times10^{-6}$ M, about $0.5\times10^{-6}$ M, about $1\times10^{-7}$ M, or about $0.5\times10^{-7}$ M (inclusive); about $0.5\times10^{-7}$ M to about $1\times10^5$ M, about $0.5\times10^{-5}$ M, about $1\times10^{-6}$ M, about $0.5\times10^{-6}$ M, or about $1\times10^{-7}$ M (inclusive); about $1\times10^{-7}$ M to about $1\times10^{-5}$ M, about $0.5\times10^{-5}$ M, about $1\times10^{-6}$ M, or about $0.5\times10^{-6}$ M (inclusive); about $0.5\times10^{-6}$ M to about $1\times10^{-5}$ M, about $0.5\times10^{-5}$ M, or about $1\times10^{-6}$ M (inclusive); about $1\times10^{-6}$ M to about $1\times10^{-5}$ M or about $0.5\times10^{-5}$ M (inclusive); or about $0.5\times10^{-5}$ M to about $1\times10^{-5}$ M (inclusive), e.g., as measured in phosphate buffered saline using surface plasmon resonance (SPR).

In some embodiments, any of the antibodies or antigen-binding fragments described herein has a $K_{off}$ of about $1\times10^{-6}$ s$^{-1}$ to about $1\times10^{-3}$ s$^{-1}$, about $0.5\times10^{-3}$ s$^{-1}$, about $1\times10^{-4}$ s$^{-1}$, about $0.5\times10^{-4}$ s$^{-1}$, about $1\times10^{-5}$ s$^{-1}$, or about $0.5\times10^{-5}$ s$^{-1}$ (inclusive); about $0.5\times10^{-5}$ s$^{-1}$ to about $1\times10^{-3}$ s$^{-1}$, about $0.5\times10^{-3}$ s$^{-1}$, about $1\times10^{-4}$ s$^{-1}$, about $0.5\times10^{-4}$ s$^{-1}$, or about $1\times10^{-5}$ s$^{-1}$ (inclusive); about $1\times10^{-5}$ s$^{-1}$ to about $1\times10^{-3}$ s$^{-1}$, about $0.5\times10^{-3}$ s$^{-1}$, about $1\times10^{-4}$ s$^{-1}$, or about $0.5\times10^{-4}$ s$^{-1}$ (inclusive); about $0.5\times10^{-4}$ s$^{-1}$ to about $1\times10^{-3}$ s$^{-1}$, about $0.5\times10^{-3}$ s$^{-1}$, or about $1\times10^{-4}$ s$^{-1}$ (inclusive); about $1\times10^{-4}$ s$^{-1}$ to about $1\times10^{-3}$ s$^{-1}$, or about $0.5\times10^{-3}$ s$^{-1}$ (inclusive); or about $0.5\times10^{-5}$ s$^{-1}$ to about $1\times10^{-3}$ s$^{-1}$ (inclusive), e.g., as measured in phosphate buffered saline using surface plasmon resonance (SPR).

In some embodiments, any of the antibodies or antigen-binding fragments described herein has a $K_{on}$ of about $1\times10^2$ M$^{-1}$s$^{-1}$ to about $1\times10^6$ M$^{-1}$s$^{-1}$, about $0.5\times10^6$ M$^{-1}$s$^{-1}$, about $1\times10^5$ M$^{-1}$s$^{-1}$, about $0.5\times10^5$ M$^{-1}$s$^{-1}$, about $1\times10^4$ M$^{-1}$s$^{-1}$, about $0.5\times10^4$ M$^{-1}$s$^{-1}$, about $1\times10^3$ M$^{-1}$s$^{-1}$, or about $0.5\times10^3$ M$^{-1}$s$^{-1}$ (inclusive); about $0.5\times10^3$ M$^{-1}$s$^{-1}$ to about $1\times10^6$ M$^{-1}$s$^{-1}$, about $0.5\times10^6$ M$^{-1}$s$^{-1}$, about $1\times10^5$ M$^1$s$^{-1}$, about $0.5\times10^5$ M$^{-1}$s$^{-1}$, about $1\times10^4$ M$^{-1}$s$^{-1}$, about $0.5\times10^4$ M$^{-1}$s$^{-1}$, or about $1\times10^3$ M$^{-1}$s$^{-1}$ (inclusive); about $1\times10^3$ M$^{-1}$s$^{-1}$ to about $1\times10^6$M$^{-1}$s$^{-1}$, about $0.5\times10^6$ M$^{-1}$s$^{-1}$, about $1\times10^5$ M$^{-1}$s$^{-1}$, about $0.5\times10^5$ M$^{-1}$s$^{-1}$, about $1\times10^4$ M$^{-1}$s$^{-1}$, or about $0.5\times10^4$ M$^{-1}$s$^{-1}$ (inclusive); about $0.5\times10^4$ M$^{-1}$s$^{-1}$ to about $1\times10^6$ M$^{-1}$s$^{-1}$, about $0.5\times10^6$ M$^{-1}$s$^{-1}$, about $1\times10^5$ M$^{-1}$s$^{-1}$, about $0.5\times10^5$ M$^{-1}$s$^{-1}$, or about $1\times10^4$ M$^{-1}$s$^{-1}$ (inclusive); about $1\times10^4$ M$^{-1}$s$^{-1}$ to about $1\times10^6$ M$^{-1}$s$^{-1}$, about $0.5\times10^6$ M$^{-1}$s$^{-1}$, about $1\times10^5$ M$^1$s$^{-1}$, or about $0.5\times10^5$ M$^{-1}$s$^{-1}$ (inclusive); about $0.5\times10^5$ M$^{-1}$s$^{-1}$ to about $1\times10^6$ M$^{-1}$s$^{-1}$, about $0.5\times10^6$M$^1$s$^{-1}$, or about $1\times10^5$ M$^{-1}$s$^{-1}$ (inclusive); about $1\times10^5$ M$^{-1}$s$^{-1}$ to about $1\times10^6$ M$^{-1}$s$^{-1}$, or about $0.5\times10^6$ M$^{-1}$s$^{-1}$ (inclusive); or about $0.5\times10^6$ M$^{-1}$s$^{-1}$ to about $1\times10^6$ M$^{-1}$s$^{-1}$ (inclusive), e.g., as measured in phosphate buffered saline using surface plasmon resonance (SPR).

IL-1 Inhibitor Fusion Proteins or Soluble Receptors

In some embodiments, the IL-1 inhibitor is a fusion protein or a soluble receptor. For example, a fusion can include an extracellular domain of any one of IL-1R1, IL1RAP, IL-18Rα, IL-1RL2, and IL1RL1 fused to a partner amino acid sequence (e.g., a stabilizing domain, e.g., an IgG Fc region, e.g., a human IgG Fc region). In some embodiments, the IL-1 inhibitor is a soluble version of one or both of IL-1RL1 and IL1RAP. In some embodiments, the IL-1 inhibitor is a soluble version of IL-18Rα. In some embodiments, the IL-1 inhibitor is a soluble version of one or both of IL-1RL2 and IL-1RAP.

In some embodiments, the IL-1 inhibitor is a fusion protein comprising or consisting of rilonacept (IL-1 Trap, Arcalyst®) (see, e.g., Kapur & Bonk, P. T. 34 (3): 138-141, 2009; Church et al., *Biologics* 2 (4): 733-742, 2008; McDermott, *Drugs Today* (Barc) 45 (6): 423-430, 2009). In some embodiments, the IL-1 inhibitor is a fusion protein that is chimeric (e.g., EBI-005 (Isunakinra®) (Furfine et al., *Invest. Ophthalmol. Vis. Sci.* 53 (14): 2340-2340, 2012; Goldstein et al., *Eye Contact Lens* 41 (3): 145-155, 2015; Goldstein et al., *Eye Contact Lens,* 2016)).

In some embodiments, the IL-1 inhibitor is a soluble receptor that comprises or consists of sIL-1R1 and/or sIL-1RII (Svenson et al., *Eur. J. Immunol.* 25 (10): 2842-2850, 1995).

Endogenous IL-I Inhibitor Peptides

In some embodiments, the IL-1 inhibitor can be an endogenous ligand or an active fragment thereof, e.g., IL-1Ra or IL-36Ra. IL-1Ra is an endogenous soluble protein that decreases the ability of IL-1α and IL-1β to bind to their receptor (e.g., a complex of IL-1R1 and IL1RAP proteins). IL-36Ra is an endogenous soluble protein that decreases the ability of IL-36α, IL-36β, and IL-36γ to bind to their receptor (e.g., a complex of IL-1RL2 and IL-1RAP proteins). Exemplary sequences for IL-1Ra and IL-36Ra are shown in SEQ ID NOs: 126-131.

```
Human IL-1Ra mRNA Transcript 1
                                                          (SEQ ID NO: 126)
   1 atttctttat aaaccacaac tctgggcccg caatggcagt ccactgcctt gctgcagtca 61 cagaatggaa atctgcagag gcctccgcag tcacctaatc actctcctcc tcttcctgtt 121 ccattcagag acgatctgcc gaccctctgg gagaaaatcc agcaagatgc aagccttcag 181 aatctgggat gttaaccaga agaccttcta tctgaggaac aaccaactag ttgctggata 241 cttgcaagga ccaaatgtca atttagaaga aaagatagat gtggtaccca ttgagcctca 301 tgctctgttc ttgggaatcc atggagggaa gatgtgcctg tcctgtgtca agtctggtga 361 tgagaccaga ctccagctgg aggcagttaa catcactgac ctgagcgaga acagaaagca 421 ggacaagcgc ttcgccttca tccgctcaga cagtggcccc accaccagtt ttgagtctgc 481 cgcctgcccc ggttggttcc tctgcacagc gatggaagct gaccagcccg tcagcctcac 541 caatatgcct gacgaaggcg tcatggtcac caaattctac ttccaggagg acgagtagta 601 ctgcccaggc ctgcctgttc ccattcttgc atggcaagga ctgcagggac tgccagtccc 661 cctgccccag ggctcccggc tatggggggca ctgaggacca gccattgagg ggtggaccct 721 cagaaggcgt cacaacaacc tggtcacagg actctgcctc ctcttcaact gaccagcctc 781 catgctgcct ccagaatggt ctttctaatg tgtgaatcag agcacagcag cccctgcaca 841 aagcccttcc atgtcgcctc tgcattcagg atcaaacccc gaccacctgc caacctgct 901 ctcctcttgc cactgcctct tcctccctca ttccaccttc ccatgccctg gatccatcag 961 gccacttgat gacccccaac caagtggctc ccacaccctg ttttacaaaa aagaaaagac 1021 cagtccatga gggaggtttt taagggtttg tggaaaatga aaattaggat ttcatgattt 1081 ttttttttca gtccccgtga aggagagccc ttcatttgga gattatgttc tttcggggag 1141 aggctgagga cttaaaatat tcctgcattt gtgaaatgat ggtgaaagta agtggtagct 1201 tttcccttct ttttcttctt tttttgtgat gtcccaactt gtaaaaatta aaagttatgg 1261 tactatgtta gccccataat tttttttttc cttttaaaac acttccataa tctggactcc 1321 tctgtccagg cactgctgcc cagcctccaa gctccatctc cactccagat tttttacagc 1381 tgcctgcagt actttacctc ctatcagaag tttctcagct cccaaggctc tgagcaaatg 1441 tggctcctgg gggttctttc ttcctctgct gaaggaataa attgctcctt gacattgtag 1501 agcttctggc acttggagac ttgtatgaaa gatggctgtg cctctgcctg tctcccccac 1561 cgggctggga gctctgcaga gcaggaaaca tgactcgtat atgtctcagg tccctgcagg 1621 gccaagcacc tagcctcgct cttggcaggt actcagcgaa tgaatgctgt atatgttggg
```

-continued

```
1681 tgcaaagttc cctacttcct gtgacttcag ctctgtttta caataaaatc ttgaaaatgc
1741 ctaaaaaaaa aaaaaaaaaa aaaaaaaaaa aaaaaaaaaa aaaaaaaaaa aaaa
```

Human IL-1Ra mRNA Transcript 2

(SEQ ID NO: 127)

```
   1 gggcagctcc accctgggag ggactgtggc ccaggtactg cccgggtgct actttatggg
  61 cagcagctca gttgagttag agtctggaag acctcagaag acctcctgtc ctatgaggcc
 121 ctccccatgg ctttagctga cttgtatgaa gaaggaggtg gaggaggagg agaaggtgaa
 181 gacaatgctg actcaaagga gacgatctgc cgaccctctg ggagaaaatc cagcaagatg
 241 caagccttca gaatctggga tgttaaccag aagaccttct atctgaggaa caaccaacta
 301 gttgctggat acttgcaagg accaaatgtc aatttagaag aaaagataga tgtggtaccc
 361 attgagcctc atgctctgtt cttgggaatc catggaggga gatgtgcct gtcctgtgtc
 421 aagtctggtg atgagaccag actccagctg gaggcagtta acatcactga cctgagcgag
 481 aacagaaagc aggacaagcg cttcgccttc atccgctcag acagtggccc caccaccagt
 541 tttgagtctg ccgcctgccc cggttggttc ctctgcacag cgatggaagc tgaccagccc
 601 gtcagcctca ccaatatgcc tgacgaaggc gtcatggtca ccaaattcta cttccaggag
 661 gacgagtagt actgcccagg cctgcctgtt cccattcttg catggcaagg actgcaggga
 721 ctgccagtcc cctgcccca gggctcccgg ctatgggggc actgaggacc agccattgag
 781 gggtggaccc tcagaaggcg tcacaacaac ctggtcacag gactctgcct cctcttcaac
 841 tgaccagcct ccatgctgcc tccagaatgg tctttctaat gtgtgaatca gagcacagca
 901 gccctgcac aaagcccttc catgtcgcct ctgcattcag gatcaaaccc cgaccacctg
 961 cccaacctgc tctcctcttg ccactgcctc ttcctccctc attccacctt cccatgccct
1021 ggatccatca ggccacttga tgaccccaa ccaagtggct cccacaccct gttttacaaa
1081 aaagaaaaga ccagtccatg agggaggttt ttaagggttt gtggaaaatg aaaattagga
1141 tttcatgatt ttttttttc agtccccgtg aaggagagcc cttcatttgg agattatgtt
1201 ctttcgggga gaggctgagg acttaaaata ttcctgcatt tgtgaaatga tggtgaaagt
1261 aagtggtagc ttttcccttc tttttcttct tttttgtga tgtcccaact tgtaaaaatt
1321 aaaagttatg gtactatgtt agccccataa ttttttttt ccttttaaaa cacttccata
1381 atctggactc ctctgtccag gcactgctgc ccagcctcca agctccatct ccactccaga
1441 tttttttacag ctgcctgcag tactttacct cctatcagaa gtttctcagc tcccaaggct
1501 ctgagcaaat gtggctcctg ggggttcttt cttcctctgc tgaaggaata aattgctcct
1561 tgacattgta gagcttctgg cacttggaga cttgtatgaa agatggctgt gcctctgcct
1621 gtctccccca ccgggctggg agctctgcag agcaggaaac atgactcgta tatgtctcag
1681 gtccctgcag ggccaagcac ctagcctcgc tcttggcagg tactcagcga atgaatgctg
1741 tatatgttgg gtgcaaagtt ccctacttcc tgtgacttca gctctgtttt acaataaaat
1801 cttgaaaatg cctaaaaaaa aaaaaaaaaa aaaaaaaaaa aaaaaaaaaa aaaaaaaaaa
1861 aaaaa
```

Human IL-1Ra mRNA Transcript 3

(SEQ ID NO: 128)

```
   1 gggcagctcc accctgggag ggactgtggc ccaggtactg cccgggtgct actttatggg
  61 cagcagctca gttgagttag agtctggaag acctcagaag acctcctgtc ctatgaggcc
 121 ctccccatgg ctttagagac gatctgccga ccctctggga gaaaatccag caagatgcaa
 181 gccttcagaa tctgggatgt taaccagaag accttctatc tgaggaacaa ccaactagtt
```

```
241 gctggatact tgcaaggacc aaatgtcaat ttagaagaaa agatagatgt ggtacccatt
301 gagcctcatg ctctgttctt gggaatccat ggagggaaga tgtgcctgtc ctgtgtcaag
361 tctggtgatg agaccagact ccagctggag gcagttaaca tcactgacct gagcgagaac
421 agaaagcagg acaagcgctt cgccttcatc cgctcagaca gtggcccac caccagtttt
481 gagtctgccg cctgccccgg ttggttcctc tgcacagcga tggaagctga ccagcccgtc
541 agcctcacca atatgcctga cgaaggcgtc atggtcacca aattctactt ccaggaggac
601 gagtagtact gcccaggcct gcctgttccc attcttgcat ggcaaggact gcagggactg
661 ccagtccccc tgcccaggg ctcccggcta tgggggcact gaggaccagc cattgagggg
721 tggaccctca gaaggcgtca acaacctg gtcacaggac tctgcctcct cttcaactga
781 ccagcctcca tgctgcctcc agaatggtct ttctaatgtg tgaatcagag cacagcagcc
841 cctgcacaaa gcccttccat gtcgcctctg cattcaggat caaaccccga ccacctgccc
901 aacctgctct cctcttgcca ctgcctcttc ctccctcatt ccaccttccc atgccctgga
961 tccatcaggc cacttgatga cccccaacca agtggctccc acaccctgtt ttacaaaaaa
1021 gaaaagacca gtccatgagg gaggttttta agggtttgtg gaaaatgaaa attaggattt
1081 catgattttt ttttttcagt ccccgtgaag gagagcccttc atttggaga ttatgttctt
1141 tcggggagag gctgaggact taaaatattc ctgcatttgt gaaatgatgg tgaaagtaag
1201 tggtagcttt tcccttcttt ttcttctttt tttgtgatgt cccaacttgt aaaaattaaa
1261 agttatggta ctatgttagc cccataattt ttttttttcct tttaaaacac ttccataatc
1321 tggactcctc tgtccaggca ctgctgccca gcctccaagc tccatctcca ctccagattt
1381 tttacagctg cctgcagtac tttacctcct atcagaagtt tctcagctcc caaggctctg
1441 agcaaatgtg gctcctgggg gttctttctt cctctgctga aggaataaat tgctccttga
1501 cattgtagag cttctggcac ttggagactt gtatgaaaga tggctgtgcc tctgcctgtc
1561 tcccccaccg ggctgggagc tctgcagagc aggaaacatg actcgtatat gtctcaggtc
1621 cctgcagggc caagcaccta gcctcgctct tggcaggtac tcagcgaatg aatgctgtat
1681 atgttgggtg caaagttccc tacttcctgt gacttcagct ctgttttaca ataaaatctt
1741 gaaaatgcct aaaaaaaaaa aaaaaaaaaa aaaaaaaaaa aaaaaaaaaa aaaaaaaaa
1801 aa
```

Human IL-1Ra mRNA Transcript 4

(SEQ ID NO: 129)

```
  1 gggcagctcc accctgggag ggactgtggc ccaggtactg cccgggtgct actttatggg
 61 cagcagctca gttgagttag agtctggaag acctcagaag acctcctgtc ctatgaggcc
121 ctccccatgg ctttaggggg attataaaac taatcatcaa agccaagaag gcaagagcaa
181 gcatgtaccg ctgaaaacac aagataactg cataagtaat gactttcagt gcagattcat
241 agctaaccca taaactgctg ggcaaaaat catcttggaa ggctctgaac ctcagaaagg
301 attcacaaga cgatctgccg accctctggg agaaaatcca gcaagatgca agccttcaga
361 atctgggatg ttaaccagaa gaccttctat ctgaggaaca accaactagt tgctggatac
421 ttgcaaggac caaatgtcaa tttagaagaa agatagatg tggtacccat tgagcctcat
481 gctctgttct tgggaatcca tggagggaag atgtgcctgt cctgtgtcaa gtctggtgat
541 gagaccagac tccagctgga ggcagttaac atcactgacc tgagcgagaa cagaaagcag
601 gacaagcgct tcgccttcat ccgctcagac agtggcccca ccaccagttt tgagtctgcc
661 gcctgccccg gttggttcct ctgcacagcg atggaagctg accagcccgt cagcctcacc
721 aatatgcctg acgaaggcgt catggtcacc aaattctact tccaggagga cgagtagtac
```

-continued

```
 781 tgcccaggcc tgcctgttcc cattcttgca tggcaaggac tgcagggact gccagtcccc
 841 ctgccccagg gctcccggct atgggggcac tgaggaccag ccattgaggg gtggaccctc
 901 agaaggcgtc acaacaacct ggtcacagga ctctgcctcc tcttcaactg accagcctcc
 961 atgctgcctc cagaatggtc tttctaatgt gtgaatcaga gcacagcagc ccctgcacaa
1021 agcccttcca tgtcgcctct gcattcagga tcaaaccccg accacctgcc caacctgctc
1081 tcctcttgcc actgcctctt cctccctcat tccaccttcc catgccctgg atccatcagg
1141 ccacttgatg accccaacc aagtggctcc cacaccctgt tttacaaaaa agaaaagacc
1201 agtccatgag ggaggttttt aagggtttgt ggaaaatgaa aattaggatt tcatgatttt
1261 tttttttcag tccccgtgaa ggagagccct tcatttggag attatgttct ttcggggaga
1321 ggctgaggac ttaaaatatt cctgcatttg tgaaatgatg gtgaaagtaa gtggtagctt
1381 ttcccttctt tttcttcttt ttttgtgatg tcccaacttg taaaaattaa aagttatggt
1441 actatgttag ccccataatt tttttttttcc ttttaaaaca cttccataat ctggactcct
1501 ctgtccaggc actgctgccc agcctccaag ctccatctcc actccagatt ttttacagct
1561 gcctgcagta ctttacctcc tatcagaagt ttctcagctc ccaaggctct gagcaaatgt
1621 ggctcctggg ggttctttct tcctctgctg aaggaataaa ttgctccttg acattgtaga
1681 gcttctggca cttggagact tgtatgaaag atggctgtgc ctctgcctgt ctcccccacc
1741 gggctgggag ctctgcagag caggaaacat gactcgtata tgtctcaggt ccctgcaggg
1801 ccaagcacct agcctcgctc ttggcaggta ctcagcgaat gaatgctgta tatgttgggt
1861 gcaaagttcc ctacttcctg tgacttcagc tctgttttac aataaaatct tgaaaatgcc
1921 taaaaaaaaa aaaaaaaaaa aaaaaaaaaa aaaaaaaaaa aaa
```

Human IL-36Ra mRNA Variant 1

(SEQ ID NO: 130)

```
   1 cgctgggaat cctgctcctc ctcaggtcct ggcagtttca gggcccctcc ctaggcctta
  61 cttaaaaggc tgaggcatcc ttggaggaac aggcagactc cacagctccc gccaggagaa
 121 aggaacattc tgaggggagt ctacaccctg tggagctcaa gatggtcctg agtggggcgc
 181 tgtgcttccg aatgaaggac tcggcattga aggtgcttta tctgcataat aaccagcttc
 241 tagctggagg gctgcatgca gggaaggtca ttaaaggtga agagatcagc gtggtcccca
 301 atcggtggct ggatgccagc ctgtcccccg tcatcctggg tgtccagggt ggaagccagt
 361 gcctgtcatg tgggggtgggg caggagccga ctctaacact agagccagtg aacatcatgg
 421 agctctatct tggtgccaag gaatccaaga gcttcacctt ctaccggcgg acatggggc
 481 tcacctccag cttcgagtcg gctgcctacc cgggctggtt cctgtgcacg gtgcctgaag
 541 ccgatcagcc tgtcagactc acccagcttc ccgagaatgg tggctggaat gccccccatca
 601 cagacttcta cttccagcag tgtgactagg gcaacgtgcc cccagaact ccctgggcag
 661 agccagctcg ggtgagggt gagtggagga gacccatggc ggacaatcac tctctctgct
 721 ctcaggaccc ccacgtctga cttagtgggc acctgaccac tttgtcttct ggttcccagt
 781 ttggataaat tctgagattt ggagctcagt ccacggtcct cccccactgg atggtgctac
 841 tgctgtggaa tcttgtaaaa accatgtggg gtaaactggg aataacatga aaagatttct
 901 gtggaggtgg ggtggggggag tggtgggaat cattcctgct taatggtaac tgaccagtgt
 961 taccctgagc cccgcaggcc aacccatccc cagttgagcc ttataggggtc agtagctctc
1021 cacatgaaga cctgtcactc accactatgc aggagaggga ggtggtcata gagtcaggga
1081 tctatggccc ttggcccagc cccacctcct tcccttttaat cctgccactg tcatatgcta
```

```
1141 cctttcctat ctcttccctc atcatcttgt tgtgggcatg aggaggtgct gatgtcagaa
1201 gaaatggctc gagctcagaa gataaaagat aagtagggta tgctgatcct cttttaaaaa
1261 cccaagatac aatcaaaatc ccagatgctg gtctctattc ccatgaaaaa gtgctcatga
1321 catattgaga agacctactt acaaagtggc atatattgca atttatttta attaaaagat
1381 acctatttat atatttcttt atagaaaaaa gtctggaaga gtttacttca attgtagcaa
1441 tgtcagggtg gtggcagtat aggtgatttt tcttttaatt ctgttaattt acctgtattt
1501 cctaattttt ctacaatgaa gatgaattcc ttgtataaaa ataagaaaag aaattaatct
1561 tgaggtaagc agagtagaca tcatctctga ttgtcctcag cctccacttc cccagagtaa
1621 attcaaattg aatcgagctc tgctgctctg gttggttgta gtagtgatca ggaaacagat
1681 ctcagcaaag ccactgagga ggaggctgtg ctgagtttgt gtggctggaa tctctgggta
1741 aggaacttaa agaacaaaaa tcatctggta attctttcct agaaggatca cagcccctgg
1801 gattccaagg cattggatcc agtctctaag aaggctgctg tactggttga attgtgtccc
1861 cctcaaattc acatccttct tggaatctca gtctgtgagt ttatttggag ataaggtctc
1921 tgcagatgta gttagttaag acaaggtcat gctggatgaa ggtagaccta aattcaatat
1981 gactggtttc cttgtatgaa aaggagagga cacagagaca gaggagatgc ggggaagact
2041 atgtaaagat gaaggcagag atcggagttt tgcagccaca agctaagaaa caccaaggat
2101 tgtggcaacc atcagaagct tggaagaggc aaagaagaat tcttccctag aggctttaga
2161 gggataacgg ctctgctgaa accttaatct cagacttcca gcctcctgaa cgaagaaaga
2221 ataaatttcg gctgttttaa gccaccaagg ataattggtt acagcagctc taggaaacta
2281 atacagctgc taaaatgatc cctgtctcct cgtgtttaca ttctgtgtgt gtcccctccc
2341 acaatgtacc aaagttgtct tgtgaccaa tagaatatgg cagaagtgat ggcatgccac
2401 ttccaagatt aggttataaa agacactgca gcttctactt gagccctctc tctctgccac
2461 ccaccgcccc caatctatct tggctcactc gctctggggg aagctagctg ccatgctatg
2521 agcaggccta taagagact acgtggtaa aaaatgaagt ctcctgccca cagccacatt
2581 agtgaaccta gaagcagaga ctctgtgaga taatcgatgt ttgttgtttt aagttgctca
2641 gttttggtct aacttgttat gcagcaatag ataaataata tgcagagaaa gagaaaaaaa
2701 aaaaaaaaaa aaaaaaa
Human IL-36Ra mRNA Variant 2
                                                    (SEQ ID NO: 131)
    1 ggagagtccc acctctaaca tctcctgtag gcctggcaat ggcaggcagg aaagacagag
   61 gaaggaagga gggagaaggg aaggagtgaa ggaaggagtg aaaaagggga gtctacaccc
  121 tgtggagctc aagatggtcc tgagtggggc gctgtgcttc cgaatgaagg actcggcatt
  181 gaaggtgctt tatctgcata taaccagct tctagctgga gggctgcatg cagggaaggt
  241 cattaaaggt gaagagatca gcgtggtccc caatcggtgg ctggatgcca gcctgtcccc
  301 cgtcatcctg ggtgtccagg gtggaagcca gtgcctgtca tgtggggtgg ggcaggagcc
  361 gactctaaca ctagagccag tgaacatcat ggagctctat cttggtgcca aggaatccaa
  421 gagcttcacc ttctaccggc gggacatggg gctcacctcc agcttcgagt cggctgccta
  481 cccgggctgg ttcctgtgca cggtgcctga agccgatcag cctgtcagac tcacccagct
  541 tcccgagaat ggtggctgga atgccccat cacagacttc tacttccagc agtgtgacta
  601 gggcaacgtg cccccagaa ctccctgggc agagccagct cgggtgaggg gtgagtggag
  661 gagacccatg gcggacaatc actctctctg ctctcaggac ccccacgtct gacttagtgg
  721 gcacctgacc actttgtctt ctggttccca gtttggataa attctgagat ttggagctca
```

```
 781 gtccacggtc ctcccccact ggatggtgct actgctgtgg aatcttgtaa aaaccatgtg 841 gggtaaactg ggaataacat gaaaagattt ctgtggaggt ggggtggggg agtggtggga 901 atcattcctg cttaatggta actgaccagt gttaccctga gccccgcagg ccaacccatc 961 cccagttgag ccttataggg tcagtagctc tccacatgaa gacctgtcac tcaccactat 1021 gcaggagagg gaggtggtca tagagtcagg gatctatggc ccttggccca gccccacctc 1081 cttcccttta atcctgccac tgtcatatgc tacctttcct atctcttccc tcatcatctt 1141 gttgtgggca tgaggaggtg ctgatgtcag aagaaatggc tcgagctcag aagataaaag 1201 ataagtaggg tatgctgatc ctcttttaaa acccaagat acaatcaaaa tcccagatgc 1261 tggtctctat tcccatgaaa aagtgctcat gacatattga gaagacctac ttacaaagtg 1321 gcatatattg caatttattt taattaaaag atacctattt atatatttct ttatagaaaa 1381 aagtctggaa gagtttactt caattgtagc aatgtcaggg tggtggcagt ataggtgatt 1441 tttcttttaa ttctgttaat ttacctgtat ttcctaattt ttctacaatg aagatgaatt 1501 ccttgtataa aaataagaaa agaaattaat cttgaggtaa gcagagtaga catcatctct 1561 gattgtcctc agcctccact tccccagagt aaattcaaat tgaatcgagc tctgctgctc 1621 tggttggttg tagtagtgat caggaaacag atctcagcaa agccactgag gaggaggctg 1681 tgctgagttt gtgtggctgg aatctctggg taaggaactt aaagaacaaa aatcatctgg 1741 taattctttc ctagaaggat cacagcccct gggattccaa ggcattggat ccagtctcta 1801 agaaggctgc tgtactggtt gaattgtgtc cccctcaaat tcacatcctt cttggaatct 1861 cagtctgtga gtttatttgg agataaggtc tctgcagatg tagttagtta agacaaggtc 1921 atgctggatg aaggtagacc taaattcaat atgactggtt tccttgtatg aaaaggagag 1981 gacacagaga cagaggagat gcggggaaga ctatgtaaag atgaaggcag agatcggagt 2041 tttgcagcca caagctaaga aacaccaagg attgtggcaa ccatcagaag cttggaagag 2101 gcaaagaaga attcttccct agaggcttta gagggataac ggctctgctg aaaccttaat 2161 ctcagacttc cagcctcctg aacgaagaaa gaataaattt cggctgtttt aagccaccaa 2221 ggataattgg ttacagcagc tctaggaaac taatacagct gctaaaatga tccctgtctc 2281 ctcgtgttta cattctgtgt gtgtcccctc ccacaatgta ccaaagttgt ctttgtgacc 2341 aatagaatat ggcagaagtg atggcatgcc acttccaaga ttaggttata aaagacactg 2401 cagcttctac ttgagccctc tctctctgcc acccaccgcc cccaatctat cttggctcac 2461 tcgctctggg ggaagctagc tgccatgcta tgagcaggcc tataaagaga cttacgtggt 2521 aaaaaatgaa gtctcctgcc cacagccaca ttagtgaacc tagaagcaga gactctgtga 2581 gataatcgat gtttgttgtt ttaagttgct cagtttttggt ctaacttgtt atgcagcaat 2641 agataaataa tatgcagaga aagagaaaaa aaaaaaaaaa aaaaaaaa
```

IL-13 Inhibitors

The term "IL-13 inhibitor" refers to an agent which decreases IL-13 expression and/or decreases the binding of IL-13 to an IL-13 receptor. In some embodiments, the IL-13 inhibitor decreases the ability of IL-13 to bind an IL-13 receptor (e.g., a complex including IL-4Rα and IL-13Rα1, or a complex including IL-13Rα1 and IL-13Ra2).

In some embodiments, the IL-13 inhibitor targets the IL-4Ra subunit. In some embodiments, the IL-13 inhibitor targets the IL-13Rα1. In some embodiments, the IL-13 inhibitor targets IL-13Ra2. In some embodiments, the IL-13 inhibitor targets an IL-13 receptor including IL-4Rα and IL-13Rα1. In some embodiments, the IL-13 inhibitor targets an IL-13 receptor including IL-13Rα1 and IL-13Ra2. In some embodiments, the IL-13 inhibitor targets IL-13.

In some embodiments, an IL-13 inhibitor is an inhibitory nucleic acid, an antibody or an antigen-binding fragment thereof, or a fusion protein. In some embodiments, the inhibitory nucleic acid can be an antisense nucleic acid, a ribozyme, a small interfering RNA, a small hairpin RNA, or a microRNA. Examples of aspects of these different inhibitory nucleic acids are described below. Any of the examples of inhibitory nucleic acids that can decrease expression of an IL-13, IL-13Rα1, IL-13Rα2, or IL-4Rα mRNA in a mammalian cell can be synthesized in vitro.

IL-13 Inhibitory Nucleic Acids

Inhibitory nucleic acids that can decrease the expression of IL-13, IL-13Rα1, IL-13Rα2, or IL-4Rα mRNA expression in a mammalian cell include antisense nucleic acid molecules, i.e., nucleic acid molecules whose nucleotide sequence is complementary to all or part of an IL-13, IL-13Rα1, IL-13Rα2, or IL-4Rα mRNA (e.g., complementary to all or a part of any one of SEQ ID NOs: 132-138).

```
Human IL-13 mRNA
                                                        (SEQ ID NO: 132)
   1 aagccaccca gcctatgcat ccgctcctca atcctctcct gttggcactg ggcctcatgg 61 cgcttttgtt gaccacggtc attgctctca cttgccttgg cggctttgcc tccccaggcc 121 ctgtgcctcc ctctacagcc ctcagggagc tcattgagga gctggtcaac atcacccaga 181 accagaaggc tccgctctgc aatggcagca tggtatggag catcaacctg acagctggca 241 tgtactgtgc agccctggaa tccctgatca acgtgtcagg ctgcagtgcc atcgagaaga 301 cccagaggat gctgagcgga ttctgcccgc acaaggtctc agctgggcag ttttccagct 361 tgcatgtccg agacaccaaa atcgaggtgg cccagtttgt aaaggacctg ctcttacatt 421 taaagaaact ttttcgcgag ggacagttca actgaaactt cgaaagcatc attatttgca 481 gagacaggac ctgactattg aagttgcaga ttcattttc tttctgatgt caaaaatgtc 541 ttgggtaggc gggaaggagg gttagggagg ggtaaaattc cttagcttag acctcagcct 601 gtgctgcccg tcttcagcct agccgacctc agccttcccc ttgcccaggg ctcagcctgg 661 tgggcctcct ctgtccaggg ccctgagctc ggtggaccca gggatgacat gtccctacac 721 ccctcccctg ccctagagca cactgtagca ttacagtggg tgccccctt gccagacatg 781 tggtgggaca gggacccact tcacacacag gcaactgagg cagacagcag ctcaggcaca 841 cttcttcttg gtcttattta ttattgtgtg ttatttaaat gagtgtgttt gtcaccgttg 901 gggattgggg aagactgtgg ctgctagcac ttggagccaa gggttcagag actcagggcc 961 ccagcactaa agcagtggac accaggagtc cctggtaata agtactgtgt acagaattct 1021 gctacctcac tggggtcctg gggcctcgga gcctcatccg aggcagggtc aggagagggg 1081 cagaacagcc gctcctgtct gccagccagc agccagctct cagccaacga gtaatttatt 1141 gttttctt gtatttaaat attaaatatg ttagcaaaga gttaatatat agaagggtac 1201 cttgaacact gggggagggg acattgaaca agttgtttca ttgactatca aactgaagcc 1261 agaaataaag ttggtgacag at Human IL-13Rα1 mRNA
                                                        (SEQ ID NO: 133)
   1 tgccaaggct ccagcccggc cgggctccga ggcgagaggc tgcatggagt ggccggcgcg 61 gctctgcggg ctgtgggcgc tgctgctctg cgccggcggc ggggcgggg cggggcgc 121 cgcgcctacg gaaactcagc cacctgtgac aaatttgagt gtctctgttg aaaacctctg 181 cacagtaata tggacatgga atccacccga gggagccagc tcaaattgta gtctatggta 241 ttttagtcat tttggcgaca aacaagataa gaaaatagct ccggaaactc gtcgttcaat 301 agaagtaccc ctgaatgaga ggatttgtct gcaagtgggg tcccagtgta gcaccaatga 361 gagtgagaag cctagcattt tggttgaaaa atgcatctca cccccagaag gtgatcctga 421 gtctgctgtg actgagcttc aatgcatttg gcacaacctg agctacatga agtgttcttg 481 gctccctgga aggaatacca gtcccgacac taactatact ctctactatt ggcacagaag 541 cctggaaaaa attcatcaat gtgaaaacat ctttagagaa ggccaatact ttggttgttc 601 ctttgatctg accaaagtga aggattccag ttttgaacaa cacagtgtcc aaataatggt 661 caaggataat gcaggaaaaa ttaaaccatc cttcaatata gtgcctttaa cttcccgtgt 721 gaaacctgat cctccacata ttaaaaacct ctccttccac aatgatgacc tatatgtgca 781 atgggagaat ccacagaatt ttattagcag atgcctattt tatgaagtag aagtcaataa
```

```
 841 cagccaaact gagacacata atgttttcta cgtccaagag gctaaatgtg agaatccaga
 901 atttgagaga aatgtggaga atacatcttg tttcatggtc cctggtgttc ttcctgatac
 961 tttgaacaca gtcagaataa gagtcaaaac aaataagtta tgctatgagg atgacaaact
1021 ctggagtaat tggagccaag aaatgagtat aggtaagaag cgcaattcca cactctacat
1081 aaccatgtta ctcattgttc cagtcatcgt cgcaggtgca atcatagtac tcctgcttta
1141 cctaaaaagg ctcaagatta ttatattccc tccaattcct gatcctggca agatttttaa
1201 agaaatgttt ggagaccaga atgatgatac tctgcactgg aagaagtacg acatctatga
1261 gaagcaaacc aaggaggaaa ccgactctgt agtgctgata gaaaacctga agaaagcctc
1321 tcagtgatgg agataattta ttttttacctt cactgtgacc ttgagaagat tcttcccatt
1381 ctccatttgt tatctgggaa cttattaaat ggaaactgaa actactgcac catttaaaaa
1441 caggcagctc ataagagcca caggtcttta tgttgagtcg cgcaccgaaa aactaaaaat
1501 aatgggcgct ttggagaaga gtgtggagtc attctcattg aattataaaa gccagcaggc
1561 ttcaaactag gggacaaagc aaaaagtgat gatagtggtg gagttaatct tatcaagagt
1621 tgtgacaact tcctgaggga tctatacttg ctttgtgttc tttgtgtcaa catgaacaaa
1681 ttttatttgt aggggaactc atttggggtg caaatgctaa tgtcaaactt gagtcacaaa
1741 gaacatgtag aaaacaaaat ggataaaatc tgatatgtat tgtttgggat cctattgaac
1801 catgtttgtg gctattaaaa ctcttttaac agtctgggct gggtccggtg gctcacgcct
1861 gtaatcccag caatttggga gtccgaggcg ggcggatcac tcgaggtcag gagttccaga
1921 ccagcctgac caaaatggtg aaacctcctc tctactaaaa ctacaaaaat taactgggtg
1981 tggtggcgcg tgcctgtaat cccagctact cgggaagctg aggcaggtga attgtttgaa
2041 cctgggaggt ggaggttgca gtgagcagag atcacaccac tgcactctag cctgggtgac
2101 agagcaagac tctgtctaaa aaacaaaaca aacaaaaca aaacaaaaaa acctcttaat
2161 attctggagt catcattccc ttcgacagca ttttcctctg ctttgaaagc cccagaaatc
2221 agtgttggcc atgatgacaa ctacagaaaa accagaggca gcttcttttgc caagaccttt
2281 caaagccatt ttaggctgtt aggggcagtg gaggtagaat gactccttgg gtattagagt
2341 ttcaaccatg aagtctctaa caatgtattt tcttcacctc tgctactcaa gtagcatttta
2401 ctgtgtcttt ggtttgtgct aggccccgg gtgtgaagca cagaccccctt ccaggggttt
2461 acagtctatt tgagactcct cagttcttgc cacttttttt tttaatctcc accagtcatt
2521 tttcagacct tttaactcct caattccaac actgatttcc cctttgcat tctccctcct
2581 tcccttcctt gtagccttt gactttcatt ggaaattagg atgtaaatct gctcaggaga
2641 cctggaggag cagaggataa ttagcatctc aggttaagtg tgagtaatct gagaaacaat
2701 gactaattct tgcatatttt gtaacttcca tgtgagggtt ttcagcattg atatttgtgc
2761 atttttctaaa cagagatgag gtggtatctt cacgtagaac attggtattc gcttgagaaa
2821 aaaagaatag ttgaacctat ttctctttct ttacaagatg ggtccaggat tcctcttttc
2881 tctgccataa atgattaatt aaatagcttt tgtgtcttac attggtagcc agccagccaa
2941 ggctctgttt atgcttttgg ggggcatata ttgggttcca ttctcaccta tccacacaac
3001 atatccgtat atatccccctc tactcttact tcccccaaat ttaaagaagt atgggaaatg
3061 agaggcattt cccccacccc atttctctcc tcacacacag actcatatta ctggtaggaa
3121 cttgagaact ttatttccaa gttgttcaaa catttaccaa tcatattaat acaatgatgc
3181 tatttgcaat tcctgctcct aggggagggg agataagaaa ccctcactct ctacaggttt
```

-continued

```
3241 gggtacaagt ggcaacctgc ttccatggcc gtgtagaagc atggtgccct ggcttctctg 3301 aggaagctgg ggttcatgac aatggcagat gtaaagttat tcttgaagtc agattgaggc 3361 tgggagacag ccgtagtaga tgttctactt tgttctgctg ttctctagaa agaatatttg 3421 gttttcctgt ataggaatga gattaattcc tttccaggta ttttataatt ctgggaagca 3481 aaacccatgc ctcccactag ccatttttac tgttatccta tttagatggc catgaagagg 3541 atgctgtgaa attcccaaca aacattgatg ctgacagtca tgcagtctgg gagtggggaa 3601 gtgatctttt gttcccatcc tcttctttta gcagtaaaat agctgaggga aaagggaggg 3661 aaaaggaagt tatgggaata cctgtggtgg ttgtgatccc taggtcttgg gagacttgg 3721 aggtgtctgt atcagtggat ttcccatccc ctgtgggaaa ttagtaggct catttactgt 3781 tttaggtcta gcctatgtgg attttttcct aacataccta agcaaaccca gtgtcaggat 3841 ggtaattctt attctttcgt tcagttaagt ttttcccttc atctgggcac tgaagggata 3901 tgtgaaacaa tgttaacatt tttggtagtc ttcaaccagg gattgtttct gtttaacttc 3961 ttataggaaa gcttgagtaa aataaatatt gtcttttgt atgtca
```

Human IL-13Rα2 mRNA (SEQ ID NO: 134)

```
  1 gtaagaacac tctcgtgagt ctaacggtct tccggatgaa ggctatttga agtcgccata 61 acctggtcag aagtgtgcct gtcggcgggg agagaggcaa tatcaaggtt ttaaatctcg 121 gagaaatggc tttcgtttgc ttggctatcg gatgcttata tacctttctg ataagcacaa 181 catttggctg tacttcatct tcagacaccg agataaaagt taaccctcct caggattttg 241 agatagtgga tcccggatac ttaggttatc tctatttgca atggcaaccc ccactgtctc 301 tggatcattt taaggaatgc acagtggaat atgaactaaa ataccgaaac attggtagtg 361 aaacatggaa gaccatcatt actaagaatc tacattacaa agatgggttt gatcttaaca 421 agggcattga agcgaagata cacacgcttt taccatggca atgcacaaat ggatcagaag 481 ttcaaagttc ctgggcagaa actacttatt ggatatcacc acaaggaatt ccagaaacta 541 aagttcagga tatggattgc gtatattaca attggcaata tttactctgt tcttggaaac 601 ctggcatagg tgtacttctt gataccaatt acaacttgtt ttactggtat gagggcttgg 661 atcatgcatt acagtgtgtt gattacatca aggctgatgg acaaaatata ggatgcagat 721 ttccctattt ggaggcatca gactataaag atttctatat ttgtgttaat ggatcatcag 781 agaacaagcc tatcagatcc agttatttca cttttcagct tcaaaatata gttaaacctt 841 tgccgccagt ctatcttact tttactcggg agagttcatg tgaaattaag ctgaaatgga 901 gcatacccttt gggacctatt ccagcaaggt gttttgatta tgaaattgag atcagagaag 961 atgatactac cttggtgact gctacagttg aaaatgaaac atacaccttg aaaacaacaa 1021 atgaaacccg acaattatgc tttgtagtaa gaagcaaagt gaatatttat tgctcagatg 1081 acggaatttg gagtgagtgg agtgataaac aatgctggaa aggtgaagac ctatcgaaga 1141 aaactttgct acgtttctgg ctaccatttg gtttcatctt aatattagtt atatttgtaa 1201 ccggtctgct tttgcgtaag ccaaacacct acccaaaaat gattccagaa tttttctgtg 1261 atacatgaag acttttccata tcaagagaca tggtattgac tcaacagttt ccagtcatgg 1321 ccaaatgttc aatatgagtc tcaataaact gaattttct tgcgaatgtt gaaaaa
```

Human IL-4Rα mRNA Transcript Variant 1

(SEQ ID NO: 135)

```
  1 gggtctccgc gcccaggaaa gccccgcgcg gcgcgggcca gggaagggcc acccaggggt 61 cccccacttc ccgcttgggc gcccggacgg cgaatggagc aggggcgcgc agataattaa 121 agatttacac acagctggaa gaaatcatag agaagccggg cgtggtggct catgcctata
```

-continued

```
 181 atcccagcac ttttggaggc tgaggcgggc agatcacttg agatcaggag ttcgagacca
 241 gcctggtgcc ttggcatctc caatggggt ggctttgctc tgggctcctg ttccctgtga
 301 gctgcctggt cctgctgcag gtggcaagct ctgggaacat gaaggtcttg caggagccca
 361 cctgcgtctc cgactacatg agcatctcta cttgcgagtg aagatgaat ggtcccacca
 421 attgcagcac cgagctccgc ctgttgtacc agctggtttt tctgctctcc gaagcccaca
 481 cgtgtatccc tgagaacaac ggaggcgcgg ggtgcgtgtg ccacctgctc atggatgacg
 541 tggtcagtgc ggataactat acactggacc tgtgggctgg gcagcagctg ctgtggaagg
 601 gctccttcaa gcccagcgag catgtgaaac ccagggcccc aggaaacctg acagttcaca
 661 ccaatgtctc cgacactctg ctgctgacct ggagcaaccc gtatccccct gacaattacc
 721 tgtataatca tctcacctat gcagtcaaca tttggagtga aaacgacccg gcagatttca
 781 gaatctataa cgtgacctac ctagaaccct ccctccgcat cgcagccagc accctgaagt
 841 ctgggatttc ctacagggca cgggtgaggg cctgggctca gtgctataac caccctgga
 901 gtgagtggag ccccagcacc aagtggcaca actcctacag ggagcccttc gagcagcacc
 961 tcctgctggg cgtcagcgtt tcctgcattg tcatcctggc cgtctgcctg ttgtgctatg
1021 tcagcatcac caagattaag aaagaatggt gggatcagat tcccaaccca gcccgcagcc
1081 gcctcgtggc tataataatc caggatgctc aggggtcaca gtgggagaag cggtcccgag
1141 gccaggaacc agccaagtgc ccacactgga agaattgtct taccaagctc ttgccctgtt
1201 ttctggagca acatgaaa agggatgaag atcctcacaa ggctgccaaa gagatgcctt
1261 tccagggctc tggaaaatca gcatggtgcc cagtggagat cagcaagaca gtcctctggc
1321 cagagagcat cagcgtggtg cgatgtgtgg agttgtttga ggccccggtg gagtgtgagg
1381 aggaggagga ggtagaggaa gaaaaaggga gcttctgtgc atcgcctgag agcagcaggg
1441 atgacttcca ggagggaagg gagggcattg tggcccggct aacagagagc ctgttcctgg
1501 acctgctcgg agaggagaat gggggctttt gccagcagga catggggag tcatgccttc
1561 ttccaccttc gggaagtacg agtgctcaca tgccctggga tgagttccca agtgcagggc
1621 ccaaggaggc acctccctgg ggcaaggagc agcctctcca cctggagcca agtcctcctg
1681 ccagcccgac ccagagtcca gacaacctga cttgcacaga gacgccctc gtcatcgcag
1741 gcaaccctgc ttaccgcagc ttcagcaact ccctgagcca gtcaccgtgt cccagagagc
1801 tgggtccaga cccactgctg gccagacacc tggaggaagt agaacccgag atgccctgtg
1861 tcccccagct ctctgagcca accactgtgc cccaacctga gccagaaacc tgggagcaga
1921 tcctccgccg aaatgtcctc cagcatgggg cagctgcagc cccgtctcg gcccccacca
1981 gtggctatca ggagtttgta catgcggtgg agcagggtgg cacccaggcc agtgcggtgg
2041 tgggcttggg tcccccagga gaggctggtt acaaggcctt ctcaagcctg cttgccagca
2101 gtgctgtgtc cccagagaaa tgtgggtttg ggctagcag tggggaagag gggtataagc
2161 ctttccaaga cctcattcct ggctgccctg ggaccctgc cccagtccct gtccccttgt
2221 tcacctttgg actggacagg gagccacctc gcagtccgca gagctcacat ctcccaagca
2281 gctccccaga gcacctgggt ctggagccgg gggaaaaggt agaggacatg ccaaagcccc
2341 cacttcccca ggagcaggcc acagaccccc ttgtggacag cctgggcagt ggcattgtct
2401 actcagccct tacctgccac ctgtgcggcc acctgaaaca gtgtcatggc caggaggatg
2461 gtggccagac ccctgtcatg gccagtcctt gctgtggctg ctgctgtgga gacaggtcct
2521 cgccccctac aaccccctg agggccccag acccctctcc aggtggggtt ccactggagg
```

```
2581 ccagtctgtg tccggcctcc ctggcaccct cgggcatctc agagaagagt aaatcctcat 2641 catccttcca tcctgcccct ggcaatgctc agagctcaag ccagacccc aaaatcgtga 2701 actttgtctc cgtgggaccc acatacatga gggtctctta ggtgcatgtc ctcttgttgc 2761 tgagtctgca gatgaggact agggcttatc catgcctggg aaatgccacc tcctggaagg 2821 cagccaggct ggcagatttc caaaagactt gaagaaccat ggtatgaagg tgattggccc 2881 cactgacgtt ggcctaacac tgggctgcag agactggacc ccgcccagca ttgggctggg 2941 ctcgccacat cccatgagag tagagggcac tgggtcgccg tgcccacgg caggcccctg 3001 caggaaaact gaggcccttg ggcacctcga cttgtgaacg agttgttggc tgctccctcc 3061 acagcttctg cagcagactg tccctgttgt aactgcccaa ggcatgtttt gcccaccaga 3121 tcatggccca cgtggaggcc cacctgcctc tgtctcactg aactagaagc cgagcctaga 3181 aactaacaca gccatcaagg gaatgacttg ggcggccttg ggaaatcgat gagaaattga 3241 acttcaggga gggtggtcat tgcctagagg tgctcattca tttaacagag cttccttagg 3301 ttgatgctgg aggcagaatc ccggctgtca aggggtgttc agttaagggg agcaacagag 3361 gacatgaaaa attgctatga ctaaagcagg acaatttgc tgccaaacac ccatgcccag 3421 ctgtatggct gggggctcct cgtatgcatg aacccccag aataaatatg ctcagccacc 3481 ctgtgggccg ggcaatccag acagcaggca taaggcacca gttaccctgc atgttggccc 3541 agacctcagg tgctagggaa ggcgggaacc ttgggttgag taatgctcgt ctgtgtgttt 3601 tagtttcatc acctgttatc tgtgtttgct gaggagagtg aacagaagg ggtggagttt 3661 tgtataaata aagtttcttt gtctctttaa aaaaaaaaa aaaaaaaaa
```

Human IL-4Rα mRNA Transcript Variant 3

(SEQ ID NO: 136)

```
   1 gggtctccgc gcccaggaaa gccccgcgcg gcgcgggcca gggaagggcc acccaggggt 61 ccccccacttc ccgcttgggc gccggacgg cgaatgcagc aggggcgcgc aggtgccttg 121 gcatctccca atgggtggc tttgctctgg gctcctgttc cctgtgagct gcctggtcct 181 gctgcaggtg gcaagctctg gaacatgaa ggtcttgcag gagcccacct gcgtctccga 241 ctacatgagc atctctactt gcgagtggaa gatgaatggt cccaccaatt gcagcaccga 301 gctccgcctg ttgtaccagc tggttttttct gctctccgaa gcccacacgt gtatccctga 361 gaacaacgga ggcgcggggt gcgtgtgcca cctgctcatg gatgacgtgg tcagtgcgga 421 taactataca ctggacctgt gggctgggca gcagctgctg tggaagggct ccttcaagcc 481 cagcgagcat gtgaaaccca gggccccagg aaacctgaca gttcacacca atgtctccga 541 cactctgctg ctgacctgga gcaacccgta tccccctgac aattacctgt ataatcatct 601 cacctatgca gtcaacattt ggagtgaaaa cgacccggca gatttcagaa tctataacgt 661 gacctaccta gaaccctccc tccgcatcgc agccagcacc ctgaagtctg ggatttccta 721 cagggcacgg gtgagggcct gggctcagtg ctataacacc acctggagtg agtggagccc 781 cagcaccaag tggcacaact cctacaggga gccttcgag cagcacctcc tgctgggcgt 841 cagcgttttcc tgcattgtca tcctggccgt ctgcctgttg tgctatgtca gcatcaccaa 901 gattaagaaa gaatggtggg atcagattcc caacccagcc cgcagccgcc tcgtggctat 961 aataatccag gatgctcagg ggtcacagtg ggagaagcgg tcccgaggcc aggaaccagc 1021 caagtgccca cactggaaga attgtcttac caagctcttg ccctgttttc tggagcacaa 1081 catgaaaagg gatgaagatc ctcacaaggc tgccaaagag atgcctttcc agggctctgg 1141 aaaatcagca tggtgcccag tggagatcag caagacagtc ctctggccag agagcatcag 1201 cgtggtgcga tgtgtggagt tgtttgaggc cccggtggag tgtgaggagg aggaggaggt
```

-continued

```
1261 agaggaagaa aaagggagct tctgtgcatc gcctgagagc agcagggatg acttccagga 1321 gggaagggag ggcattgtgg cccggctaac agagagcctg ttcctggacc tgctcggaga 1381 ggagaatggg ggcttttgcc agcaggacat gggggagtca tgccttcttc caccttcggg 1441 aagtacgagt gctcacatgc cctgggatga gttcccaagt gcagggccca aggaggcacc 1501 tccctggggc aaggagcagc ctctccacct ggagccaagt cctcctgcca gcccgaccca 1561 gagtccagac aacctgactt gcacagagac gcccctcgtc atcgcaggca accctgctta 1621 ccgcagcttc agcaactccc tgagccagtc accgtgtccc agagagctgg gtccagaccc 1681 actgctggcc agacacctgg aggaagtaga acccgagatg ccctgtgtcc cccagctctc 1741 tgagccaacc actgtgcccc aacctgagcc agaaacctgg gagcagatcc tccgccgaaa 1801 tgtcctccag catggggcag ctgcagcccc cgtctcggcc ccaccagtg gctatcagga 1861 gtttgtacat gcggtggagc agggtggcac ccaggccagt gcggtggtgg gcttgggtcc 1921 cccaggagag gctggttaca aggccttctc aagcctgctt gccagcagtg ctgtgtcccc 1981 agagaaatgt gggtttgggg ctagcagtgg ggaagagggg tataagcctt tccaagacct 2041 cattcctggc tgccctgggg accctgcccc agtccctgtc cccttgttca cctttggact 2101 ggacagggag ccacctcgca gtccgcagag ctcacatctc ccaagcagct ccccagagca 2161 cctgggtctg gagccggggg aaaaggtaga ggacatgcca aagcccccac ttccccagga 2221 gcaggccaca gacccccttg tggacagcct gggcagtggc attgtctact cagcccttac 2281 ctgccacctg tgcggccacc tgaaacagtg tcatggccag gaggatggtg ccagacccc 2341 tgtcatggcc agtccttgct gtggctgctg ctgtggagac aggtcctcgc ccctacaac 2401 cccctgagg gccccagacc cctctccagg tggggttcca ctggaggcca gtctgtgtcc 2461 ggcctccctg gcaccctcgg gcatctcaga gaagagtaaa tcctcatcat ccttccatcc 2521 tgccctggc aatgctcaga gctcaagcca gaccccaaa atcgtgaact ttgtctccgt 2581 gggacccaca tacatgaggg tctcttaggt gcatgtcctc ttgttgctga gtctgcagat 2641 gaggactagg gcttatccat gcctgggaaa tgccacctcc tggaaggcag ccaggctggc 2701 agatttccaa aagacttgaa gaaccatggt atgaaggtga ttggccccac tgacgttggc 2761 ctaacactgg gctgcagaga ctggaccccg cccagcattg ggctgggctc gccacatccc 2821 atgagagtag agggcactgg gtcgccgtgc cccacggcag gcccctgcag gaaaactgag 2881 gcccttgggc acctcgactt gtgaacgagt tgttggctgc tccctccaca gcttctgcag 2941 cagactgtcc ctgttgtaac tgcccaaggc atgttttgcc caccagatca tggcccacgt 3001 ggaggcccac ctgcctctgt ctcactgaac tagaagccga gcctagaaac taacacagcc 3061 atcaagggaa tgacttgggc ggccttggga atcgatgag aaattgaact tcagggaggg 3121 tggtcattgc ctagaggtgc tcattcattt aacagagctt ccttaggttg atgctggagg 3181 cagaatcccg gctgtcaagg ggtgttcagt taagggagc aacagaggac atgaaaaatt 3241 gctatgacta aagcagggac aatttgctgc caaacaccca tgcccagctg tatggctggg 3301 ggctcctcgt atgcatggaa ccccagaat aaatatgctc agccaccctg tgggccgggc 3361 aatccagaca gcaggcataa ggaccagtt accctgcatg ttggcccaga cctcaggtgc 3421 tagggaaggc gggaaccttg ggttgagtaa tgctcgtctg tgtgttttag tttcatcacc 3481 tgttatctgt gtttgctgag gagagtggaa cagaaggggt ggagttttgt ataaataaag 3541 tttctttgtc tctttaaaaa aaaaaaaaaa aaaaaaa
```

Human IL-4Rα mRNA Transcript Variant 4

(SEQ ID NO: 137)

```
   1 gggtctccgc gcccaggaaa gccccgcgcg gcgcgggcca gggaagggcc acccaggggt
  61 cccccacttc ccgcttgggc gcccggacgg cgaatggagc aggggcgcgc aggtgccttg
 121 gcatctccca atggggtggc tttgctctgg gctcctgttc cctgtgagct gcctggtcct
 181 gctgcaggtg gcaagctctg gactcttcag gatgccgtgt ggagaaagga agagggtgga
 241 agccaggagg tctggaggga ggtctggagt ggaggagatg agaggctccg gatccctctg
 301 ggaggtagat ttgaggacag attggaattg aggtgaaaga cagagaaaga gaagtggcca
 361 ggatgactcc aagatttctg acctaaacta ctgggaagga cgcggttgtc atttctgaaa
 421 tgcagaagga tgccagaaga aagggaaca tgaaggtctt gcaggagccc acctgcgtct
 481 ccgactacat gagcatctct acttgcgagt ggaagatgaa tggtcccacc aattgcagca
 541 ccgagctccg cctgttgtac cagctggttt ttctgctctc cgaagcccac acgtgtatcc
 601 ctgagaacaa cggaggcgcg gggtgcgtgt gccacctgct catggatgac gtggtcagtg
 661 cggataacta tacactggac ctgtgggctg gcagcagct gctgtggaag gctccttca
 721 agcccagcga gcatgtgaaa cccagggccc aggaaacct gacagttcac accaatgtct
 781 ccgacactct gctgctgacc tggagcaacc cgtatccccc tgacaattac ctgtataatc
 841 atctcaccta tgcagtcaac atttggagtg aaaacgaccc ggcagatttc agaatctata
 901 acgtgaccta cctagaaccc tccctccgca tcgcagccag caccctgaag tctgggattt
 961 cctacagggc acgggtgagg gcctgggctc agtgctataa caccacctgg agtgagtgga
1021 gccccagcac caagtggcac aactcctaca gggagcccct cgagcagcac ctcctgctgg
1081 gcgtcagcgt ttcctgcatt gtcatcctgg ccgtctgcct gttgtgctat gtcagcatca
1141 ccaagattaa gaaagaatgg tgggatcaga ttcccaaccc agcccgcagc cgcctcgtgg
1201 ctataataat ccaggatgct caggggtcac agtgggagaa gcggtcccga ggccaggaac
1261 cagccaagtg cccacactgg aagaattgtc ttaccaagct cttgccctgt ttctggagc
1321 acaacatgaa aagggatgaa gatcctcaca aggctgccaa agagatgcct ttccagggct
1381 ctggaaaatc agcatggtgc ccagtggaga tcagcaagac agtcctctgg ccagagagca
1441 tcagcgtggt gcgatgtgtg gagttgtttg aggccccggt ggagtgtgag gaggaggagg
1501 aggtagagga agaaaaaggg agcttctgtg catcgcctga gagcagcagg gatgacttcc
1561 aggagggaag ggagggcatt gtggcccggc taacagagag cctgttcctg gacctgctcg
1621 gagaggagaa tggggctttt gccagcagg acatggggga gtcatgcctt cttccaccttt
1681 cgggaagtac gagtgctcac atgcctgggg atgagttccc aagtgcaggg cccaaggagg
1741 cacctccctg gggcaaggag cagcctctcc acctggagcc aagtcctcct gccagcccga
1801 cccagagtcc agacaacctg acttgcacag agacgcccct cgtcatcgca ggcaaccctg
1861 cttaccgcag cttcagcaac tccctgagcc agtcaccgtg tcccagagag ctgggtccag
1921 acccactgct ggccagacac ctggaggaag tagaacccga gatgcctgt gtccccagc
1981 tctctgagcc aaccactgtg ccccaacctg agccagaaac ctgggagcag atcctccgcc
2041 gaaatgtcct ccagcatggg gcagctgcag ccccgtctc ggcccccacc agtggctatc
2101 aggagttgt acatgcggtg gagcagggtg gcacccaggc cagtgcggtg gtgggcttgg
2161 gtcccccagg agaggctggt tacaaggcct tctcaagcct gcttgccagc agtgctgtgt
2221 ccccagagaa atgtgggttt ggggctagca gtggggaaga ggggtataag cctttccaag
2281 acctcattcc tggctgccct ggggaccctg ccccagtccc tgtcccccttg ttcacctttg
```

-continued

```
2341 gactggacag ggagccacct cgcagtccgc agagctcaca tctcccaagc agctccccag
2401 agcacctggg tctggagccg ggggaaaagg tagaggacat gccaaagccc ccacttcccc
2461 aggagcaggc cacagacccc cttgtggaca gcctgggcag tggcattgtc tactcagccc
2521 ttacctgcca cctgtgcggc cacctgaaac agtgtcatgg ccaggaggat ggtggccaga
2581 cccctgtcat ggccagtcct tgctgtggct gctgctgtgg agacaggtcc tcgccccta
2641 caacccccct gagggcccca gaccctctc caggtggggt tccactggag gccagtctgt
2701 gtccggcctc cctggcaccc tcgggcatct cagagaagag taaatcctca tcatccttcc
2761 atcctgcccc tggcaatgct cagagctcaa gccagacccc caaaatcgtg aactttgtct
2821 ccgtgggacc cacatacatg agggtctctt aggtgcatgt cctcttgttg ctgagtctgc
2881 agatgaggac tagggcttat ccatgcctgg gaaatgccac ctcctggaag gcagccaggc
2941 tggcagattt ccaaaagact tgaagaacca tggtatgaag gtgattggcc ccactgacgt
3001 tggcctaaca ctgggctgca gagactggac cccgcccagc attgggctgg gctcgccaca
3061 tcccatgaga gtagagggca ctgggtcgcc gtgcccacg gcaggcccct gcaggaaaac
3121 tgaggccctt gggcaccctcg acttgtgaac gagttgttgg ctgctccctc cacagcttct
3181 gcagcagact gtccctgttg taactgccca aggcatgttt tgcccaccag atcatggccc
3241 acgtggaggc ccacctgcct ctgtctcact gaactagaag ccgagcctag aaactaacac
3301 agccatcaag gaatgactt gggcggcctt gggaaatcga tgagaaattg aacttcaggg
3361 agggtggtca ttgcctagag gtgctcattc atttaacaga gcttccttag gttgatgctg
3421 gaggcagaat cccggctgtc aagggtgtt cagttaaggg gagcaacaga ggacatgaaa
3481 aattgctatg actaaagcag ggacaatttg ctgccaaaca cccatgccca gctgtatggc
3541 tgggggctcc tcgtatgcat ggaaccccca gaataaatat gctcagccac cctgtgggcc
3601 gggcaatcca gacagcaggc ataaggcacc agttaccctg catgttggcc cagacctcag
3661 gtgctaggga aggcgggaac cttgggttga gtaatgctcg tctgtgtgtt ttagtttcat
3721 cacctgttat ctgtgtttgc tgaggagagt ggaacagaag gggtggagtt ttgtataaat
3781 aaagtttctt tgtctctttta aaaaaaaaa aaaaaaaaa a
```

Human IL-4Rα mRNA Transcript Variant 5
(SEQ ID NO: 138)

```
  1 gggtctccgc gcccaggaaa gccccgcgcg gcgcgggcca gggaagggcc acccaggggt
 61 cccccacttc ccgcttgggc gcccgacgg cgaatgagc aggggcgcgc aggtgccttg
121 gcatctccca atggggtggc tttgctctgg gctcctgttc cctgtgagct gcctggtcct
181 gctgcaggtg gcaagctctg ggaacatgaa ggtcttgcag gagcccacct gcgtctccga
241 ctacatgagc atctctactt gcgagtggaa gatgaatggt cccaccaatt gcagcaccga
301 gctccgcctg ttgtaccagc tggtttttct gctctccgaa gcccacacgt gtatccctga
361 gaacaacgga ggcgcggggt gcgtgtgcca cctgctcatg gatgacgtgg tcagtgcgga
421 taactataca ctggacctgt gggctgggca gcagctgctg tggaagggct ccttcaagcc
481 cagcgagcat gtgaaaccca gggcccccagg aaacctgaca gttcacacca atgtctccga
541 cactctgctg ctgacctgga gcaacccgta tccccctgac aattacctgt ataatcatct
601 cacctatgca gtcaacattt ggagtgaaaa cgacccggca gataatctat aacgtgacct
661 acctagaacc ctccctccgc atcgcagcca gcaccctgaa gtctgggatt cctacaggg
721 cacgggtgag ggcctgggct cagtgctata acaccacctg gagtgagtgg agccccagca
781 ccaagtggca caactcctac agggagccct tcgagcagca cctcctgctg ggcgtcagcg
841 tttcctgcat tgtcatcctg gccgtctgcc tgttgtgcta tgtcagcatc accaagatta
```

```
-continued 901 agaaagaatg gtgggatcag attcccaacc cagcccgcag ccgcctcgtg gctataataa
 961 tccaggatgc tcagggtca cagtgggaga agcggtcccg aggccaggaa ccagccaagt
1021 gcccacactg gaagaattgt cttaccaagc tcttgccctg ttttctggag cacaacatga
1081 aaagggatga agatcctcac aaggctgcca aagagatgcc tttccagggc tctggaaaat
1141 cagcatggtg cccagtggag atcagcaaga cagtcctctg ccagagagc atcagcgtgg
1201 tgcgatgtgt ggagttgttt gaggccccgg tggagtgtga ggaggaggag gaggtagagg
1261 aagaaaaagg gagcttctgt gcatcgcctg agagcagcag ggatgacttc caggagggaa
1321 gggagggcat tgtggcccgg ctaacagaga gcctgttcct ggacctgctc ggagaggaga
1381 atgggggctt ttgccagcag gacatggggg agtcatgcct tcttccacct tcgggaagta
1441 cgagtgctca catgccctgg gatgagttcc caagtgcagg gcccaaggag gcacctccct
1501 ggggcaagga gcagcctctc cacctggagc caagtcctcc tgccagcccg acccagagtc
1561 cagacaacct gacttgcaca gagacgcccc tcgtcatcgc aggcaaccct gcttaccgca
1621 gcttcagcaa ctccctgagc cagtcaccgt gtcccagaga gctgggtcca gacccactgc
1681 tggccagaca cctggaggaa gtagaacccg agatgccctg tgtcccccag ctctctgagc
1741 caaccactgt gccccaacct gagccagaaa cctgggagca gatcctccgc cgaaatgtcc
1801 tccagcatgg ggcagctgca gccccgtct cggcccccac cagtggctat caggagtttg
1861 tacatgcggt ggagcagggt ggcacccagg ccagtgcggt ggtgggcttg ggtcccccag
1921 gagaggctgg ttacaaggcc ttctcaagcc tgcttgccag cagtgctgtg tccccagaga
1981 aatgtgggtt tggggctagc agtggggaag aggggtataa gcctttccaa gacctcattc
2041 ctggctgccc tggggaccct gccccagtcc ctgtccccct tgttcacctt tggactggaca
2101 gggagccacc tcgcagtccg cagagctcac atctcccaag cagctcccca gagcacctgg
2161 gtctggagcc ggggaaaag gtagaggaca tgccaaagcc cccacttccc caggagcagg
2221 ccacagaccc ccttgtggac agcctgggca gtggcattgt ctactcagcc cttacctgcc
2281 acctgtgcgg ccacctgaaa cagtgtcatg gccaggagga tggtggccag acccctgtca
2341 tggccagtcc ttgctgtggc tgctgctgtg agacaggtc ctcgccccct acaaccccc
2401 tgagggcccc agaccctct ccaggtgggg ttccactgga ggccagtctg tgtccggcct
2461 ccctggcacc ctcgggcatc tcagagaaga gtaaatcctc atcatccttc catcctgccc
2521 ctggcaatgc tcagagctca agccagaccc ccaaaatcgt gaactttgtc tccgtgggac
2581 ccacatacat gagggtctct taggtgcatg tcctcttgtt gctgagtctg cagatgagga
2641 ctagggctta ccatgcctg ggaaatgcca cctcctggaa ggcagccagg ctggcagatt
2701 tccaaaagac ttgaagaacc atggtatgaa ggtgattggc cccactgacg ttggcctaac
2761 actgggctgc agagactgga ccccgcccag cattgggctg gctcgccac atcccatgag
2821 agtagagggc actgggtcgc cgtgcccac ggcaggcccc tgcaggaaaa ctgaggccct
2881 tgggcacctc gacttgtgaa cgagttgttg gctgctccct ccacagcttc tgcagcagac
2941 tgtccctgtt gtaactgccc aaggcatgtt ttgcccacca gatcatggcc cacgtggagg
3001 cccacctgcc tctgtctcac tgaactagaa gccgagccta gaaactaaca cagccatcaa
3061 gggaatgact tgggcggcct tgggaaatcg atgagaaatt gaacttcagg gagggtggtc
3121 attgcctaga ggtgctcatt catttaacag agcttcctta ggttgatgct ggaggcagaa
3181 tcccggctgt caagggggtgt tcagttaagg ggagcaacag aggacatgaa aaattgctat
3241 gactaaagca gggacaattt gctgccaaac acccatgccc agctgtatgg ctgggggctc
```

```
-continued
3301 ctcgtatgca tggaacccc  agaataaata tgctcagcca ccctgtgggc cgggcaatcc 3361 agacagcagg cataaggcac cagttaccct gcatgttggc ccagacctca ggtgctaggg 3421 aaggcgggaa ccttgggttg agtaatgctc gtctgtgtgt tttagtttca tcacctgtta 3481 tctgtgtttg ctgaggagag tggaacagaa ggggtggagt tttgtataaa taaagtttct 3541 ttgtctcttt aaaaaaaaaa aaaaaaaaaa aaaaaaaaaa aaaaaaaa
```

An antisense nucleic acid molecule can be complementary to all or part of a non-coding region of the coding strand of a nucleotide sequence encoding an IL-13, IL-13Rα1, IL-13Rα2, or IL-4Rα protein. Non-coding regions (5' and 3' untranslated regions) are the 5' and 3' sequences that flank the coding region in a gene and are not translated into amino acids.

Based upon the sequences disclosed herein, one of skill in the art can easily choose and synthesize any of a number of appropriate antisense nucleic acids to target a nucleic acid encoding an IL-13, IL-13Rα1, IL-13Rα2, or IL-4Rα protein described herein. Antisense nucleic acids targeting a nucleic acid encoding an IL-13, IL-13Rα1, IL-13Rα2, or IL-4Rα protein can be designed using the software available at the Integrated DNA Technologies website.

An antisense nucleic acid can be, for example, about 5, 10, 15, 20, 25, 30, 35, 40, 45, or 50 nucleotides or more in length. An antisense oligonucleotide can be constructed using chemical synthesis and enzymatic ligation reactions using procedures known in the art. For example, an antisense nucleic acid can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used.

Examples of modified nucleotides which can be used to generate an antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3) w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest).

The antisense nucleic acid molecules described herein can be prepared in vitro and administered to a mammal, e.g., a human. Alternatively, they can be generated in situ such that they hybridize with or bind to cellular mRNA and/or genomic DNA encoding an IL-13, IL-13Rα1, IL-13Rα2, or IL-4Rα protein to thereby inhibit expression, e.g., by inhibiting transcription and/or translation. The hybridization can be by conventional nucleotide complementarities to form a stable duplex, or, for example, in the case of an antisense nucleic acid molecule that binds to DNA duplexes, through specific interactions in the major groove of the double helix. The antisense nucleic acid molecules can be delivered to a mammalian cell using a vector (e.g., a lentivirus, a retrovirus, or an adenovirus vector).

An antisense nucleic acid can be an α-anomeric nucleic acid molecule. An α-anomeric nucleic acid molecule forms specific double-stranded hybrids with complementary RNA in which, contrary to the usual, β-units, the strands run parallel to each other (Gaultier et al., *Nucleic Acids Res.* 15:6625-6641, 1987). The antisense nucleic acid can also comprise a 2'-O-methylribonucleotide (Inoue et al., *Nucleic Acids Res.* 15:6131-6148, 1987) or a chimeric RNA-DNA analog (Inoue et al., *FEBS Lett.* 215:327-330, 1987).

Non-limiting examples of IL-13 inhibitors that are antisense nucleic acids are described in Kim et al., *J. Gene Med.* 11 (1): 26-37, 2009; and Mousavi et al., *Iran J. Allergy Asthma Immunol.* 2 (3): 131-137, 2003.

Another example of an inhibitory nucleic acid is a ribozyme that has specificity for a nucleic acid encoding an IL-13, IL-13Rα1, IL-13Rα2, or IL-4Rα protein (e.g., specificity for an IL-13, IL-13Rα1, IL-13Rα2, or IL-4Rα mRNA, e.g., specificity for any one of SEQ ID NOs: 109-115). Ribozymes are catalytic RNA molecules with ribonuclease activity that are capable of cleaving a single-stranded nucleic acid, such as an mRNA, to which they have a complementary region. Thus, ribozymes (e.g., hammerhead ribozymes (described in Haselhoff and Gerlach, *Nature* 334:585-591, 1988)) can be used to catalytically cleave mRNA transcripts to thereby inhibit translation of the protein encoded by the mRNA. A ribozyme having specificity for an IL-13, IL-13Rα1, IL-13Rα2, or IL-4Rα mRNA can be designed based upon the nucleotide sequence of any of the IL-13, IL-13Rα1, IL-13Rα2, or IL-4Rα mRNA sequences disclosed herein. For example, a derivative of a Tetrahymena L-19 IVS RNA can be constructed in which the nucleotide sequence of the active site is complementary to the nucleotide sequence to be cleaved in an IL-13, IL-13Rα1, IL-13Rα2, or IL-4Rα mRNA (see, e.g., U.S. Pat. Nos. 4,987,071 and 5,116,742). Alternatively, an IL-13, IL-13Rα1, IL-13Rα2, or IL-4Rα mRNA can be used to select a catalytic RNA having a specific ribonuclease activity from a pool of RNA molecules. See, e.g., Bartel et al., *Science* 261:1411-1418, 1993.

An inhibitory nucleic acid can also be a nucleic acid molecule that forms triple helical structures. For example, expression of an IL-13, IL-13Rα1, IL-13Rα2, or IL-4Rα polypeptide can be inhibited by targeting nucleotide sequences complementary to the regulatory region of the gene encoding the IL-13, IL-13Rα1, IL-13Rα2, or IL-4Rα polypeptide (e.g., the promoter and/or enhancer, e.g., a sequence that is at least 1 kb, 2 kb, 3 kb, 4 kb, or 5 kb upstream of the transcription initiation start state) to form triple helical structures that prevent transcription of the gene in target cells. See generally Helene, *Anticancer Drug Des.* 6 (6): 569-84, 1991; Helene, *Ann. N.Y. Acad. Sci.* 660:27-36, 1992; and Maher, *Bioassays* 14 (12): 807-15, 1992.

In various embodiments, inhibitory nucleic acids can be modified at the base moiety, sugar moiety, or phosphate backbone to improve, e.g., the stability, hybridization, or solubility of the molecule. For example, the deoxyribose phosphate backbone of the nucleic acids can be modified to generate peptide nucleic acids (see, e.g., Hyrup et al., *Bioorganic Medicinal Chem.* 4 (1): 5-23, 1996). Peptide nucleic acids (PNAs) are nucleic acid mimics, e.g., DNA mimics, in which the deoxyribose phosphate backbone is replaced by a pseudopeptide backbone and only the four natural nucleobases are retained. The neutral backbone of PNAs allows for specific hybridization to DNA and RNA under conditions of low ionic strength. The synthesis of PNA oligomers can be performed using standard solid phase peptide synthesis protocols (see, e.g., Perry-O'Keefe et al., *Proc. Natl. Acad. Sci. U.S.A.* 93:14670-675, 1996). PNAs can be used as antisense or antigene agents for sequence-specific modulation of gene expression by, e.g., inducing transcription or translation arrest or inhibiting replication.

PNAs can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras can be generated which may combine the advantageous properties of PNA and DNA. Such chimeras allow DNA recognition enzymes, e.g., RNAse H and DNA polymerases, to interact with the DNA portion while the PNA portion would provide high binding affinity and specificity. PNA-DNA chimeras can be linked using linkers of appropriate lengths selected in terms of base stacking, number of bonds between the nucleobases, and orientation.

The synthesis of PNA-DNA chimeras can be performed as described in Finn et al., *Nucleic Acids Res.* 24:3357-63, 1996. For example, a DNA chain can be synthesized on a solid support using standard phosphoramidite coupling chemistry and modified nucleoside analogs. Compounds such as 5'-(4-methoxytrityl)amino-5'-deoxy-thymidine phosphoramidite can be used as a link between the PNA and the 5' end of DNA (Mag et al., *Nucleic Acids Res.* 17:5973-88, 1989). PNA monomers are then coupled in a stepwise manner to produce a chimeric molecule with a 5' PNA segment and a 3' DNA segment (Finn et al., *Nucleic Acids Res.* 24:3357-63, 1996). Alternatively, chimeric molecules can be synthesized with a 5' DNA segment and a 3' PNA segment (Peterser et al., *Bioorganic Med. Chem. Lett.* 5:1119-11124, 1975).

In some embodiments, the inhibitory nucleic acids can include other appended groups such as peptides, or agents facilitating transport across the cell membrane (see, Letsinger et al., *Proc. Natl. Acad. Sci. U.S.A.* 86:6553-6556, 1989; Lemaitre et al., *Proc. Natl. Acad. Sci. U.S.A.* 84:648-652, 1989; and WO 88/09810). In addition, the inhibitory nucleic acids can be modified with hybridization-triggered cleavage agents (see, e.g., Krol et al., *Bio/Techniques* 6:958-976, 1988) or intercalating agents (see, e.g., Zon, *Pharm. Res.*, 5:539-549, 1988). To this end, the oligonucleotide may be conjugated to another molecule, e.g., a peptide, hybridization triggered cross-linking agent, transport agent, hybridization-triggered cleavage agent, etc.

Another means by which expression of an IL-13, IL-13Rα1, IL-13Rα2, or IL-4Rα mRNA can be decreased in a mammalian cell is by RNA interference (RNAi). RNAi is a process in which mRNA is degraded in host cells. To inhibit an mRNA, double-stranded RNA (dsRNA) corresponding to a portion of the gene to be silenced (e.g., a gene encoding an IL-13, IL-13Rα1, IL-13Rα2, or IL-4Rα polypeptide) is introduced into a mammalian cell. The dsRNA is digested into 21-23 nucleotide-long duplexes called short interfering RNAs (or siRNAs), which bind to a nuclease complex to form what is known as the RNA-induced silencing complex (or RISC). The RISC targets the homologous transcript by base pairing interactions between one of the siRNA strands and the endogenous mRNA. It then cleaves the mRNA about 12 nucleotides from the 3' terminus of the siRNA (see Sharp et al., *Genes Dev.* 15:485-490, 2001, and Hammond et al., *Nature Rev. Gen.* 2:110-119, 2001).

RNA-mediated gene silencing can be induced in a mammalian cell in many ways, e.g., by enforcing endogenous expression of RNA hairpins (see, Paddison et al., *Proc. Natl. Acad. Sci. U.S.A.* 99:1443-1448, 2002) or, as noted above, by transfection of small (21-23 nt) dsRNA (reviewed in Caplen, *Trends Biotech.* 20:49-51, 2002). Methods for modulating gene expression with RNAi are described, e.g., in U.S. Pat. No. 6,506,559 and US 2003/0056235, which are hereby incorporated by reference.

Standard molecular biology techniques can be used to generate siRNAs. Short interfering RNAs can be chemically synthesized, recombinantly produced, e.g., by expressing RNA from a template DNA, such as a plasmid, or obtained from commercial vendors, such as Dharmacon. The RNA used to mediate RNAi can include synthetic or modified nucleotides, such as phosphorothioate nucleotides. Methods of transfecting cells with siRNA or with plasmids engineered to make siRNA are routine in the art.

The siRNA molecules used to decrease expression of an IL-13, IL-13Rα1, IL-13Rα2, or IL-4Rα mRNA can vary in a number of ways. For example, they can include a 3' hydroxyl group and strands of 21, 22, or 23 consecutive nucleotides. They can be blunt ended or include an overhanging end at either the 3' end, the 5' end, or both ends. For example, at least one strand of the RNA molecule can have a 3' overhang from about 1 to about 6 nucleotides (e.g., 1-5, 1-3, 2-4, or 3-5 nucleotides (whether pyrimidine or purine nucleotides) in length. Where both strands include an overhang, the length of the overhangs may be the same or different for each strand.

To further enhance the stability of the RNA duplexes, the 3' overhangs can be stabilized against degradation (by, e.g., including purine nucleotides, such as adenosine or guanosine nucleotides or replacing pyrimidine nucleotides by modified analogues (e.g., substitution of uridine 2-nucleotide 3' overhangs by 2'-deoxythymidine is tolerated and does not affect the efficiency of RNAi). Any siRNA can be used in the methods of decreasing an IL-13, IL-13Rα1, IL-13Rα2, or IL-4Rα mRNA, provided it has sufficient homology to the target of interest (e.g., a sequence present in any one of SEQ ID NOs: 109-115, e.g., a target sequence encompassing the translation start site or the first exon of the mRNA). There is no upper limit on the length of the siRNA that can be used (e.g., the siRNA can range from about 21 base pairs of the gene to the full length of the gene or more (e.g., about 20 to about 30 base pairs, about 50 to about 60 base pairs, about 60 to about 70 base pairs, about 70 to about 80 base pairs, about 80 to about 90 base pairs, or about 90 to about 100 base pairs).

As described herein, inhibitory nucleic acids preferentially bind (e.g., hybridize) to a nucleic acid encoding IL-13, IL-13Rα1, IL-13Rα2, or IL-4Rα protein to treat allergic diseases (e.g., asthma (Corren et al., *N. Engl. J. Med.* 365:1088-1098, 2011)), radiation lung injury (Chung et al., Sci. Rep. 6:39714, 2016), ulcerative colitis (Hua et al., Br. J. Clin. Pharmacol. 80:101-109, 2015), dermatitis (Guttman-Yassky et al., Exp. Opin. Biol. Ther. 13 (4): 1517, 2013), and chronic obstructive pulmonary disease (COPD) (Walsh et al. (2010) Curr. Opin. Investig Drugs. 11 (11): 1305-1312, 2010).

Non-limiting examples of short interfering RNA (siRNA) that are IL-13 inhibitors are described in Lively et al., J. Allergy Clin. Immunol. 121 (1): 88-94, 2008). Non-limiting examples of short hairpin RNA (shRNA) that are IL-13 inhibitors are described in Lee et al., Hum Gene Ther. 22 (5): 577-586, 2011, and Shilovskiy et al., Eur. Resp. J. 42: P523, 2013).

In some embodiments, an inhibitory nucleic acid can be a microRNA. Non-limiting examples of microRNAs that are IL-13 inhibitors are let-7 (Kumar et al., J. Allergy Clin. Immunol. 128 (5): 1077-1085, 2011).

In certain embodiments, a therapeutically effective amount of an inhibitory nucleic acid targeting a nucleic acid encoding a IL-13, IL-13Rα1, IL-13Rα2, or IL-4Rα protein can be administered to a subject (e.g., a human subject) in need thereof.

In some embodiments, the inhibitory nucleic acid can be about 10 nucleotides to about 40 nucleotides (e.g., about 10 to about 30 nucleotides, about 10 to about 25 nucleotides, about 10 to about 20 nucleotides, about 10 to about 15 nucleotides, 10 nucleotides, 11 nucleotides, 12 nucleotides, 13 nucleotides, 14 nucleotides, 15 nucleotides, 16 nucleotides, 17 nucleotides, 18 nucleotides, 19 nucleotides, 20 nucleotides, 21 nucleotides, 22 nucleotides, 23 nucleotides, 24 nucleotides, 25 nucleotides, 26 nucleotides, 27 nucleotides, 28 nucleotides, 29 nucleotides, 30 nucleotides, 31 nucleotides, 32 nucleotides, 33 nucleotides, 34 nucleotides, 35 nucleotides, 36 nucleotides, 37 nucleotides, 38 nucleotides, 39 nucleotides, or 40 nucleotides) in length. One skilled in the art will appreciate that inhibitory nucleic acids may comprise at least one modified nucleic acid at either the 5' or 3'end of DNA or RNA.

As is known in the art, the term "thermal melting point (Tm)" refers to the temperature, under defined ionic strength, pH, and inhibitory nucleic acid concentration, at which 50% of the inhibitory nucleic acids complementary to the target sequence hybridize to the target sequence at equilibrium. In some embodiments, an inhibitory nucleic acid can bind specifically to a target nucleic acid under stingent conditions, e.g., those in which the salt concentration is at least about 0.01 to 1.0 M Na ion concentration (or other salts) at pH 7.0 to 8.3 and the temperature is at least about 30° C. for short oligonucleotides (e.g., 10 to 50 nucleotide). Stringent conditions can also be achieved with the addition of destabilizing agents such as formamide.

In some embodiments of any of the inhibitory nucleic acids described herein, the inhibitory nucleic acid binds to a target nucleic acid (e.g., a nucleic acid encoding any one of IL-13, IL-13Rα1, IL-13Rα2, or IL-4Ra) with a Tm of greater than 20° C., greater than 22° C., greater than 24° C., greater than 26° C., greater than 28° C., greater than 30° C., greater than 32° C., greater than 34° C., greater than 36° C., greater than 38° C., greater than 40° C., greater than 42° C., greater than 44° C., greater than 46° C., greater than 48° C., greater than 50° C., greater than 52° C., greater than 54° C., greater than 56° C., greater than 58° C., greater than 60° C., greater than 62° C., greater than 64° C., greater than 66° C., greater than 68° C., greater than 70° C., greater than 72° C., greater than 74° C., greater than 76° C., greater than 78° C., or greater than 80° C., e.g., as measured in phosphate buffered saline using a UV spectrophotometer.

In some embodiments of any of the inhibitor nucleic acids described herein, the inhibitory nucleic acid binds to a target nucleic acid (e.g., a nucleic acid encoding any one of IL-13, IL-13Rα1, IL-13Rα2, or IL-4Ra) with a Tm of about 20° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., about 30° C., about 28° C., about 26° C., about 24° C., or about 22° C. (inclusive); about 22° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., about 30° C., about 28° C., about 26° C., or about 24° C. (inclusive); about 24° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., about 30° C., about 28° C., or about 26° C. (inclusive); about 26° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., about 30° C., or about 28° C. (inclusive); about 28° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., or about 30° C. (inclusive); about 30° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., or about 32° C. (inclusive); about 32° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., or about 34° C. (inclusive); about 34° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., or about 36° C. (inclusive); about 36° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., or about 38° C. (inclusive); about 38° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., or about 40° C. (inclusive); about 40° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., or about 42° C. (inclusive); about 42° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., or about 44° C. (inclusive); about 44° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., or about 46° C. (inclusive); about 46° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., or about 48° C. (inclusive); about 48° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., or about 50° C. (inclusive); about 50° C. to about 80° C., about 78° C., about 76° C., about 74° C., about 72° C., about 70° C., about 68° C., about 66° C., about 64° C., about 62° C., about 60° C., about 58° C., about 56° C., about 54° C., or about 52° C. (inclusive); about 52° C. to about 80° C., about 78° C., about 76° C., about 74° C., about 72° C., about 70° C., about 68° C., about 66° C., about 64° C., about 62° C., about 60° C., about 58° C., about 56° C., or about 54° C. (inclusive); about 54° C. to about 80° C., about 78° C., about 76° C., about 74° C., about 72° C., about 70° C., about 68° C., about 66° C., about 64° C., about 62° C., about 60° C., about 58° C., or about 56° C. (inclusive); about 56° C. to about 80° C., about 78° C., about 76° C., about 74° C., about 72° C., about 70° C., about 68° C., about 66° C., about 64° C., about 62° C., or about 60° C. (inclusive); about 58° C. to about 80° C., about 78° C., about 76° C., about 74° C., about 72° C., about 70° C., about 68° C., about 66° C., about 64° C., about 62° C., or about 60° C. (inclusive); about 60° C. to about 80° C., about 78° C., about 76° C., about 74° C., about 72° C., about 70° C., about 68° C., about 66° C., about 64° C., or about 62° C. (inclusive); about 62° C. to about 80° C., about 78° C., about 76° C., about 74° C., about 72° C., about 70° C., about 68° C., about 66° C., or about 64° C. (inclusive); about 64° C. to about 80° C., about 78° C., about 76° C., about 74° C., about 72° C., about 70° C., about 68° C., or about 66° C. (inclusive); about 66° C. to about 80° C., about 78° C., about 76° C., about 74° C., about 72° C., about 70° C., or about 68° C. (inclusive); about 68° C. to about 80° C., about 78° C., about 76° C., about 74° C., about 72° C., or about 70° C. (inclusive); about 70° C. to about 80° C., about 78° C., about 76° C., about 74° C., or about 72° C. (inclusive); about 72° C. to about 80° C., about 78° C., about 76° C., or about 74° C. (inclusive); about 74° C. to about 80° C., about 78° C., or about 76° C. (inclusive); about 76° C. to about 80° C. or about 78° C. (inclusive); or about 78° C. to about 80° C. (inclusive).

In some embodiments, the inhibitory nucleic acid can be formulated in a nanoparticle (e.g., a nanoparticle including one or more synthetic polymers, e.g., Patil et al., *Pharmaceutical Nanotechnol.* 367:195-203, 2009; Yang et al., *ACS Appl. Mater. Interfaces*, doi: 10.1021/acsami.6b16556, 2017; Perepelyuk et al., *Mol. Ther. Nucleic Acids* 6:259-268, 2017). In some embodiments, the nanoparticle can be a mucoadhesive particle (e.g., nanoparticles having a positively-charged exterior surface) (Andersen et al., *Methods Mol. Biol.* 555:77-86, 2009). In some embodiments, the nanoparticle can have a neutrally-charged exterior surface.

In some embodiments, the inhibitory nucleic acid can be formulated, e.g., as a liposome (Buyens et al., *J. Control Release* 158 (3): 362-370, 2012; Scarabel et al., *Expert Opin. Drug Deliv.* 17:1-14, 2017), a micelle (e.g., a mixed micelle) (Tangsangasaksri et al., *BioMacromolecules* 17:246-255, 2016; Wu et al., *Nanotechnology*, doi: 10.1088/1361-6528/aa6519, 2017), a microemulsion (WO 11/004395), a nanoemulsion, or a solid lipid nanoparticle (Sahay et al., *Nature Biotechnol.* 31:653-658, 2013; and Lin et al., *Nanomedicine* 9 (1): 105-120, 2014). Additional exemplary structural features of inhibitory nucleic acids and formulations of inhibitory nucleic acids are described in US 2016/0090598.

In some embodiments, a pharmaceutical composition can include a sterile saline solution and one or more inhibitory nucleic acid (e.g., any of the inhibitory nucleic acids described herein). In some examples, a pharmaceutical composition consists of a sterile saline solution and one or more inhibitory nucleic acid (e.g., any of the inhibitory nucleic acids described herein). In certain embodiments, the sterile saline is a pharmaceutical grade saline. In certain embodiments, a pharmaceutical composition can include one or more inhibitory nucleic acid (e.g., any of the inhibitory nucleic acids described herein) and sterile water. In certain embodiments, a pharmaceutical composition consists of one or more inhibitory nucleic acid (e.g., any of the inhibitory nucleic acids described herein) and sterile water. In certain embodiments, a pharmaceutical composition includes one or more inhibitory nucleic acid (e.g., any of the inhibitory nucleic acids described herein) and phosphate-buffered saline (PBS). In certain embodiments, a pharmaceutical composition consists of one or more inhibitory nucleic acids (e.g., any of the inhibitory nucleic acids described herein) and sterile phosphate-buffered saline (PBS). In some examples, the sterile saline is a pharmaceutical grade PBS.

In certain embodiments, one or more inhibitory nucleic acids (e.g., any of the inhibitory nucleic acids described herein) may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

Pharmaceutical compositions including one or more inhibitory nucleic acids encompass any pharmaceutically acceptable salts, esters, or salts of such esters. Non-limiting examples of pharmaceutical compositions include pharmaceutically acceptable salts of inhibitory nucleic acids. Suitable pharmaceutically acceptable salts include, but are not limited to, sodium and potassium salts.

Also provided herein are prodrugs that can include additional nucleosides at one or both ends of an inhibitory nucleic acid which are cleaved by endogenous nucleases within the body, to form the active inhibitory nucleic acid.

Lipid moieties can be used to formulate an inhibitory nucleic acid. In certain such methods, the inhibitory nucleic acid is introduced into preformed liposomes or lipoplexes made of mixtures of cationic lipids and neutral lipids. In certain methods, inhibitory nucleic acid complexes with mono- or poly-cationic lipids are formed without the presence of a neutral lipid. In certain embodiments, a lipid moiety is selected to increase distribution of an inhibitory nucleic acid to a particular cell or tissue in a mammal. In some examples, a lipid moiety is selected to increase distribution of an inhibitory nucleic acid to fat tissue in a mammal. In certain embodiments, a lipid moiety is selected to increase distribution of an inhibitory nucleic acid to muscle tissue.

In certain embodiments, pharmaceutical compositions provided herein comprise one or more inhibitory nucleic acid and one or more excipients. In certain such embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In some examples, a pharmaceutical composition provided herein includes liposomes and emulsions. Liposomes and emulsions can be used to formulate hydrophobic compounds. In some examples, certain organic solvents such as dimethylsulfoxide are used.

In some examples, a pharmaceutical composition provided herein includes one or more tissue-specific delivery molecules designed to deliver one or more inhibitory nucleic acids to specific tissues or cell types in a mammal. For example, a pharmaceutical composition can include liposomes coated with a tissue-specific antibody.

In some embodiments, a pharmaceutical composition provided herein can include a co-solvent system. Examples of such co-solvent systems include benzyl alcohol, a non-polar surfactant, a water-miscible organic polymer, and an aqueous phase. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. As can be appreciated, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In some examples, a pharmaceutical composition can be formulated for oral administration. In some examples, pharmaceutical compositions are formulated for buccal administration.

In some examples, a pharmaceutical composition is formulated for administration by injection (e.g., intravenous, subcutaneous, intramuscular, etc.). In some of these embodiments, a pharmaceutical composition includes a carrier and is formulated in aqueous solution, such as water or physiologically compatible buffers such as Hanks's solution, Ringer's solution, or physiological saline buffer. In some examples, other ingredients are included (e.g., ingredients that aid in solubility or serve as preservatives). In some examples, injectable suspensions are prepared using appropriate liquid carriers, suspending agents, and the like. Some pharmaceutical compositions for injection are formulated in unit dosage form, e.g., in ampoules or in multi-dose containers. Some pharmaceutical compositions for injection are suspensions, solutions, or emulsions in oily or aqueous vehicles, and may contain formulatory agents such as suspending, stabilizing, and/or dispersing agents. Solvents suitable for use in pharmaceutical compositions for injection include, but are not limited to, lipophilic solvents and fatty oils, such as sesame oil, synthetic fatty acid esters, such as ethyl oleate or triglycerides, and liposomes.

Antibodies

In some embodiments, the IL-13 inhibitor is an antibody or an antigen-binding fragment thereof (e.g., a Fab or a scFv). In some embodiments, an antibody or antigen-binding fragment described herein binds specifically to any one of IL-13, IL-13Rα1, IL-13Rα2, or IL-4Ra, or a combination thereof. In some embodiments, an antibody or antigen-binding fragment of an antibody described herein can bind specifically to IL-13. In some embodiments, an antibody or antigen-binding fragment of an antibody described herein can bind specifically to an IL-13 receptor (e.g., a complex including IL-4Rα and IL-13Rα1, or a complex including IL-13Rα1 and IL-13Rα2).

In some embodiments, the antibody can be a humanized antibody, a chimeric antibody, a multivalent antibody, or a fragment thereof. In some embodiments, an antibody can be a scFv-Fc, a VHH domain, a VNAR domain, a (scFv) 2, a minibody, or a BiTE. In some embodiments, an antibody can be a DVD-Ig, and a dual-affinity re-targeting antibody (DART), a triomab, kih IgG with a common LC, a crossmab, an ortho-Fab IgG, a 2-in-1-IgG, IgG-ScFv, scFv2-Fc, a bi-nanobody, tanden antibody, a DART-Fc, a scFv-HAS-scFv, DNL-Fab3, DAF (two-in-one or four-in-one), DutaMab, DT-IgG, knobs-in-holes common LC, knobs-in-holes assembly, charge pair antibody, Fab-arm exchange antibody, SEEDbody, Triomab, LUZ-Y, Fcab, kλ-body, orthogonal Fab, DVD-IgG, IgG (H)-scFv, scFv-(H)IgG, IgG (L)-scFv, scFv-(L)-IgG, IgG (L,H)-Fc, IgG (H)-V, V (H)-IgG, IgG (L)-V, V (L)-IgG, KIH IgG-scFab, 2scFv-IgG, IgG-2scFv, scFv4-Ig, Zybody, DVI-IgG, nanobody, nanobody-HSA, a diabody, a TandAb, scDiabody, scDiabody-CH3, Diabody-CH3, Triple Body, miniantibody, minibody, TriBi minibody, scFv-CH3 KIH, Fab-scFv, scFv-CH-CL-scFv, F(ab')2-scFV2, scFv-KIH, Fab-scFv-Fc, tetravalent HCAb, scDiabody-Fc, diabody-Fc, tandem scFv-Fc, intrabody, dock and lock bispecific antibody, ImmTAC, HSAbody, scDiabody-HAS, tandem scFv, IgG-IgG, Cov-X-Body, and scFv1-PEG-scFv2.

Non-limiting examples of an antigen-binding fragment of an antibody include an Fv fragment, a Fab fragment, a F(ab')2 fragment, and a Fab' fragment. Additional examples of an antigen-binding fragment of an antibody is an antigen-binding fragment of an IgG (e.g., an antigen-binding fragment of IgG1, IgG2, IgG3, or IgG4) (e.g., an antigen-binding fragment of a human or humanized IgG, e.g., human or humanized IgG1, IgG2, IgG3, or IgG4); an antigen-binding fragment of an IgA (e.g., an antigen-binding fragment of IgA1 or IgA2) (e.g., an antigen-binding fragment of a human or humanized IgA, e.g., a human or humanized IgA1 or IgA2); an antigen-binding fragment of an IgD (e.g., an antigen-binding fragment of a human or humanized IgD); an antigen-binding fragment of an IgE (e.g., an antigen-binding fragment of a human or humanized IgE); or an antigen-binding fragment of an IgM (e.g., an antigen-binding fragment of a human or humanized IgM).

In some embodiments, the IL-13 inhibitor is a monoclonal antibody (Bagnasco et al., *Int. Arch. Allergy Immunol.* 170:122-131, 2016). In some embodiments, the IL-13 inhibitor is QAX576 (Novartis) or an antigen-binding fragment thereof (see, e.g., Kariyawasam et al., *B92 New Treatment Approaches for Asthma and Allergery* San Diego, 2009; Rothenberg et al., *J. Allergy Clin. Immunol.* 135:500-507, 2015). In some embodiments, the IL-13 inhibitor is ABT-308 (Abbott) or an antigen-binding fragment thereof (see, e.g., Ying et al., American Thoracic Society 2010 International Conference, May 14-19, 2010, New Orleans; Abstract A6644). In some embodiments, the IL-13 inhibitor is CNTO-5825 (Centrocore) or an antigen-binding fragment thereof (see, e.g., van Hartingsveldt et al., *British J. Clin. Pharmacol.* 75:1289-1298, 2013). In some embodiments, the IL-13 inhibitor is dupilumab (REGN668/SAR231893) or an antigen-binding fragment thereof (see, e.g., Simpson et al., *N. Eng. J. Med.* 375:2335-2348, 2016; Thaci et al., *Lancet* 387:40-52, 2016). In some embodiments, the IL-13 inhibitor is AMG317 (Amgen) or an antigen-binding fragment thereof (Polosa et al., *Drug Discovery Today* 17:591-599, 2012; Holgate, British J. Clinical Pharmacol. 76:277-291, 2013). In some embodiments, the IL-13 inhibitor is an antibody that specifically binds to IL-13Rα1 (see, e.g., U.S. Pat. No. 7,807,158; WO 96/29417; WO 97/15663; and WO 03/080675).

In some embodiments, the IL-13 inhibitor is a humanized monoclonal antibody (e.g., lebrikizumab (TNX-650) (Thomson et al., *Biologics* 6:329-335, 2012; and Hanania et al., *Thorax* 70 (8): 748-756, 2015). In some embodiments, the IL-13 inhibitor is an anti-IL-13 antibody, e.g., GSK679586 or a variant thereof (Hodsman et al., *Br. J. Clin. Pharmacol.* 75 (1): 118-128, 2013; and De Boever et al., *J. Allergy Clin. Immunol.* 133 (4): 989-996, 2014). In some embodiments, the IL-13 inhibitor is tralokinumab (CAT-354) or a variant thereof (Brightling et al., *Lancet* 3 (9): 692-701, 2015; Walsh et al. (2010) *Curr. Opin. Investig. Drugs* 11 (11): 1305-1312, 2010; Piper et al., *Euro. Resp. J.* 41:330-338, 2013; May et al., *Br. J. Pharmacol.* 166 (1): 177-193, 2012; Singh et al., *BMC Pulm Med.* 10:3, 2010; Blanchard et al., *Clin. Exp. Allergy* 35 (8): 1096-1103, 2005). In some embodiments, the IL-13 inhibitor is anrukinzumab (IMA-638) (Hua et al., *Br. J. Clin. Pharmacol.* 80:101-109, 2015; Reinisch et al., Gut 64 (6): 894-900, 2015; Gauvreau et al., *Am. J. Respir. Crit. Care Med.* 183 (8): 1007-1014, 2011; Brec et al., *J. Allergy Clin. Immunol.* 119 (5): 1251-1257, 2007). Further teachings of IL-13 inhibitors that are antibodies or antigen-binding fragments thereof are described in U.S. Pat. Nos. 8,067,199; 7,910,708; 8,221,752; 8,388,965; 8,399,630; and 8,734,801; US 2014/0341913; US 2015/0259411; US 2016/0075777; US 2016/0130339, US 2011/0243928, and US 2014/0105897 each of which is incorporated by reference in its entirety.

In some embodiments, any of the antibodies or antigen-binding fragments described herein has a dissociation constant ($K_D$) of less than $1 \times 10^{-5}$ M (e.g., less than $0.5 \times 10^{-5}$ M, less than $1 \times 10^{-6}$ M, less than $0.5 \times 10^{-6}$ M, less than $1 \times 10^{-7}$ M, less than $0.5 \times 10^{-7}$ M, less than $1 \times 10^{-8}$ M, less than $0.5 \times 10^{-8}$ M, less than $1 \times 10^{-9}$ M, less than $0.5 \times 10^{-9}$ M, less than $1 \times 10^{-10}$ M, less than $0.5 \times 10^{-10}$ M, less than $1 \times 10^{-11}$ M, less than $0.5 \times 10^{-11}$ M, or less than $1 \times 10^{-12}$ M), e.g., as measured in phosphate buffered saline using surface plasmon resonance (SPR).

In some embodiments, any of the antibodies or antigen-binding fragments described herein has a $K_D$ of about $1 \times 10^{-12}$ M to about $1 \times 10^{5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$ M, about $0.5 \times 10^{-9}$ M, about $1 \times 10^{-10}$ M, about $0.5 \times 10^{-10}$ M, about $1 \times 10^{-11}$ M, or about $0.5 \times 10^{-11}$ M (inclusive); about $0.5 \times 10^{-11}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$ M, about $0.5 \times 10^{-9}$ M, about $1 \times 10^{-10}$ M, about $0.5 \times 10^{-10}$ M, or about $1 \times 10^{-11}$ M (inclusive); about $1 \times 10^{-11}$ M to about $1 \times 10^{-5}$ M, about $0.5 \times 10^{5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$ M, about $0.5 \times 10^{-9}$ M, about $1 \times 10^{-10}$ M, or about $0.5 \times 10^{-10}$ M (inclusive); about $0.5 \times 10^{-10}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$ M, about $0.5 \times 10^{-9}$ M, or about $1 \times 10^{-10}$ M (inclusive); about $1 \times 10^{-10}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$ M, or about $0.5 \times 10^{-9}$ M (inclusive); about $0.5 \times 10^{-9}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, or about $0.5 \times 10^{-8}$ M (inclusive); about $0.5 \times 10^{-8}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, or about $1 \times 10^{-8}$ M (inclusive); about $1 \times 10^{-8}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, or about $0.5 \times 10^{-7}$ M (inclusive); about $0.5 \times 10^{-7}$ M to about $1 \times 10^{-5}$ M, about $0.5 \times 10^{-5}$ M, about $1 \times 10^{-6}$ M, about $0.5 \times 10^{-6}$ M, or about $1 \times 10^{-7}$ M (inclusive); about $1 \times 10^{-7}$ M to about $1 \times 10^{5}$ M, about $0.5 \times 10^{-5}$ M, about $1 \times 10^{-6}$ M, or about $0.5 \times 10^{-6}$ M (inclusive); about $0.5 \times 10^{-6}$ M to about $1 \times 10^{-5}$ M, about $0.5 \times 10^{-5}$ M, or about $1 \times 10^{-6}$ M (inclusive); about $1 \times 10^{-6}$ M to about $1 \times 10^{-5}$ M or about $0.5 \times 10^{5}$ M (inclusive); or about $0.5 \times 10^{-5}$ M to about $1 \times 10^{-5}$ M (inclusive), e.g., as measured in phosphate buffered saline using surface plasmon resonance (SPR).

In some embodiments, any of the antibodies or antigen-binding fragments described herein has a $K_{off}$ of about $1 \times 10^{-6}$ s$^{-1}$ to about $1 \times 10^{-3}$ s$^{-1}$, about $0.5 \times 10^{-3}$ s$^{-1}$, about $1 \times 10^{-4}$ s$^{-1}$, about $0.5 \times 10^{-4}$ s$^{-1}$, about $1 \times 10^{-5}$ s$^{-1}$, or about $0.5 \times 10^{-5}$ s$^{-1}$ (inclusive); about $0.5 \times 10^{-5}$ s$^{-1}$ to about $1 \times 10^{-3}$ s$^{-1}$, about $0.5 \times 10^{-3}$ s$^{-1}$, about $1 \times 10^{-4}$ s$^{-1}$, about $0.5 \times 10^{-4}$ s$^{-1}$, or about $1 \times 10^{-5}$ s$^{-1}$ (inclusive); about $1 \times 10^{-5}$ s$^{-1}$ to about $1 \times 10^{-3}$ s$^{-1}$, about $0.5 \times 10^{-3}$ s$^{-1}$, about $1 \times 10^{-4}$ s$^{-1}$, or about $0.5 \times 10^{-4}$ s$^{-1}$ (inclusive); about $0.5 \times 10^{-4}$ s$^{-1}$ to about $1 \times 10^{-3}$ s$^{-1}$, about $0.5 \times 10^{-3}$ s$^{-1}$, or about $1 \times 10^{-4}$ s$^{-1}$ (inclusive); about $1 \times 10^{-4}$ s$^{-1}$ to about $1 \times 10^{-3}$ s$^{-1}$, or about $0.5 \times 10^{-3}$ s$^{-1}$ (inclusive); or about $0.5 \times 10^{-5}$ s$^{-1}$ to about $1 \times 10^{-3}$ s$^{-1}$ (inclusive), e.g., as measured in phosphate buffered saline using surface plasmon resonance (SPR).

In some embodiments, any of the antibodies or antigen-binding fragments described herein has a $K_{on}$ of about $1 \times 10^{2}$ M$^{-1}$s$^{-1}$ to about $1 \times 10^{6}$ M$^{-1}$s$^{-1}$, about $0.5 \times 10^{6}$ M$^{-1}$s$^{-1}$, about $1 \times 10^{5}$ M$^{-1}$s$^{-1}$, about $0.5 \times 10^{5}$ M$^{-1}$s$^{-1}$, about $1 \times 10^{4}$ M$^{1}$s$^{-1}$, about $0.5 \times 10^{4}$ M$^{-1}$s$^{-1}$, about $1 \times 10^{3}$ M$^{-1}$s$^{-1}$, or about $0.5 \times 10^{3}$ M$^{-1}$s$^{-1}$ (inclusive); about $0.5 \times 10^{3}$ M$^{-1}$s$^{-1}$ to about $1 \times 10^{6}$M$^{-1}$s$^{-1}$, about $0.5 \times 10^{6}$ M$^{-1}$s$^{-1}$, about $1 \times 10^{5}$ M$^{1}$s$^{-1}$, about $0.5 \times 10^{5}$ M$^{-1}$s$^{-1}$, about $1 \times 10^{4}$ M$^{-1}$s$^{-1}$, about $0.5 \times 10^{4}$ M$^{-1}$s$^{-1}$, or about $1 \times 10^{3}$ M$^{-1}$s$^{-1}$ (inclusive); about $1 \times 10^{3}$ M$^{-1}$s$^{-1}$ to about $1 \times 10^{6}$ M$^{-1}$s$^{-1}$, about $0.5 \times 10^{6}$ M$^{-1}$s$^{-1}$, about $1 \times 10^{5}$ M$^{-1}$s$^{-1}$, about $0.5 \times 10^{5}$ M$^{-1}$s$^{-1}$, about $1 \times 10^{4}$ M$^{-1}$s$^{-1}$, or about $0.5 \times 10^{4}$ M$^{-1}$s$^{-1}$ (inclusive); about $0.5 \times 10^{4}$ M$^{-1}$s$^{-1}$ to about $1 \times 10^{6}$ M$^{-1}$s$^{-1}$, about $0.5 \times 10^{6}$ M$^{-1}$s$^{-1}$, about $1 \times 10^{5}$ M$^{-1}$s$^{-1}$, about $0.5 \times 10^{5}$ M$^{-1}$s$^{-1}$, or about $1 \times 10^{4}$ M$^{-1}$s$^{-1}$ (inclusive); about $1 \times 10^{4}$ M$^{-1}$s$^{-1}$ to about $1 \times 10^{6}$ M$^{-1}$s$^{-1}$, about $0.5 \times 10^{6}$ M$^{-1}$s$^{-1}$, about $1 \times 10^{5}$ M$^{-1}$s$^{-1}$, or about $0.5 \times 10^{5}$ M$^{-1}$s$^{-1}$ (inclusive); about $0.5 \times 10^{5}$ M$^{-1}$s$^{-1}$ to about $1 \times 10^{6}$ M$^{-1}$s$^{-1}$, about $0.5 \times 10^{6}$ M$^{-1}$s$^{-1}$, or about $1 \times 10^{5}$ M$^{-1}$s$^{-1}$ (inclusive); about $1 \times 10^{5}$ M$^{-1}$s$^{-1}$ to about $1 \times 10^{6}$ M$^{-1}$s$^{-1}$, or about $0.5 \times 10^{6}$ M$^{-1}$s$^{-1}$ (inclusive); or about $0.5 \times 10^{6}$ M$^{-1}$s$^{-1}$ to about $1 \times 10^{6}$ M$^{-1}$s$^{-1}$ (inclusive), e.g., as measured in phosphate buffered saline using surface plasmon resonance (SPR).

Fusion Protein Inhibitors of IL-13

In some embodiments, the IL-13 inhibitor is a fusion protein or a soluble antagonist. In some embodiments, the fusion protein comprises a soluble fragment of a receptor of IL-13 (e.g., a soluble fragment of a complex including IL-13Rα1 and IL-4Ra, a soluble fragment of a complex including IL-13Rα1 and IL-13Rα2, a soluble fragment of IL-13Rα1, a soluble fragment of IL-13Rα2, or soluble fragment of IL-4Ra). In some embodiments, the fusion protein comprises an extracellular domain of a receptor of IL-13 (e.g., a fusion protein including an extracellular domain of both IL-13Rα1 and IL-4Ra, a fusion protein including an extracellular domain of both IL-13Rα1 and IL-13Rα2, a fusion protein including an extracellular domain of IL-13Rα1, a fusion protein including an extracellular domain of IL-13Ra2, or a fusion protein including an extracellular domain of IL-4Ra).

In some embodiments, the fusion protein comprises or consists of sIL-13Rα2-Fc (see, e.g., Chiaramonte et al., *J. Clin. Invest.* 104 (6): 777-785, 1999; Kasaian et al., *Am. J.Respir. Cell. Mol. Biol.* 36 (3): 368-376, 2007; Miyahara et al., *J. Allergy Clin. Immunol.* 118 (5): 1110-1116, 2006; Rahaman et al., *Cancer Res.* 62 (4): 1103-1109, 2002; incorporated by reference herein). In some embodiments, the fusion protein comprises or consists of an IL-13 fusion cytotoxin (e.g., IL-13/diphtheria toxin fusion protein (Li et al., *Protein Eng.* 15 (5): 419-427, 2002), IL-13-PE38QQR (IL-13-PE) (Blease et al. (2001) *J. Immunol.* 167 (11): 6583-6592, 2001; and Husain et al., *J. Neuro-Oncol.* 65 (1): 37-48, 2003)).

IL-10 Receptor Agonists

The term "IL-10 receptor agonist" is any molecule that binds to and activates a receptor for IL-10 expressed on a mammalian cell or a nucleic acid that encodes any such molecule. A receptor for IL-10 can include, e.g., a complex of two IL-10 receptor-1 (IL-10R1) proteins and two IL-10 receptor 2 (IL-10R2) proteins. In some examples, an IL-10 receptor agonist is an antibody or an antigen-binding antibody fragment that specifically binds to and activates a receptor for IL-10 (e.g., a human receptor for IL-10). In some examples, an IL-10 receptor agonist is a recombinant IL-10 (e.g., human recombinant IL-10). In some examples, an IL-10 receptor agonist is a pegylated recombinant IL-10 (e.g., pegylated recombinant human IL-10). In some examples, an IL-10 receptor agonist is a fusion protein. In some examples, an IL-10 receptor agonist is an IL-10 peptide mimetic.

In some embodiments, any of the devices or compositions described herein can contain a recombinant mammalian cell (e.g., a recombinant human cell) that secretes an IL-10 receptor agonist (e.g., a recombinant IL-10, e.g., a recombinant human IL-10). In some embodiments, any of the devices or compositions described herein can contain a mammalian cell (e.g., a human cell) that secretes IL-10 (e.g., human IL-10).

Activation of an IL-10 receptor in a mammalian cell can be determined by detecting an increase in the activation of downstream signaling proteins in a mammalian cell contacted with an IL-10 receptor agonist. For example, activation of an IL-10 receptor in a mammalian cell can be detected by an increase in the phosphorylation and activity of JAK1 and TYK2, phosphorylation and subsequent nuclear translocation of STAT3, and/or increased transcription of BCLXL, Cyclin-D1, Cyclin-D2, Cyclin-D3, Cyclin-A, Pim1, c-Myc, or p19 (INK4D) (see, e.g., Hu et al., *J. Leukoc. Biol.* 82 (2): 237-243, 2007; and Cavalcante et al., *J. Periodontol.* 83 (7): 926-935, 2012). Reagents for detecting these downstream events that indicate activation of an IL-10 receptor are available from, e.g., ThermoFisher Scientific.

Exemplary sequences of human IL-10 proteins and cDNA sequences are shown in SEQ ID Nos: 139-141.

```
Precursor Human IL-10 Protein (with signal sequence in bold)
                                                      (SEQ ID NO: 139)
   1 mhssallccl vlltgvrasp gqgtqsensc thfpgnlpnm lrdlrdafsr vktffqmkdq 61 ldnlllkesl ledfkgylgc qalsemiqfy leevmpqaen qdpdikahvn slgenlktlr 121 lrlrrchrfl pcenkskave qvknafnklq ekgiykamse fdtttnyiea ymtmkirn Mature Human IL-10 Protein
                                                      (SEQ ID NO: 140)
spgqgtqsensc thfpgnlpnm lrdlrdafsr vktffqmkdq ldnillkesl ledfkgylgc qalsemiqfy leevmpqaen qdpdikahvn slgenlktlr lrlrrchrfl pcenkskave qvknafnklq ekgiykamse fdtttnyiea ymtmkirn Human IL-10 cDNA
                                                      (SEQ ID NO: 141)
   1 acacatcagg ggcttgctct tgcaaaacca aaccacaaga cagacttgca aaagaaggca 61 tgcacagctc agcactgctc tgttgcctgg tcctcctgac tggggtgagg gccagcccag 121 gccagggcac ccagtctgag aacagctgca cccacttccc aggcaacctg cctaacatgc 181 ttcgagatct ccgagatgcc ttcagcagag tgaagacttt ctttcaaatg aaggatcagc 241 tggacaactt gttgttaaag gagtccttgc tggaggactt taagggttac ctgggttgcc 301 aagccttgtc tgagatgatc cagttttacc tggaggaggt gatgccccaa gctgagaacc 361 aagacccaga catcaaggcg catgtgaact cccttggggga gaacctgaag acctcaggc 421 tgaggctacg gctgctgtcat cgatttcttc cctgtgaaaa caagagcaag gccgtggagc 481 aggtgaagaa tgcctttaat aagctccaag agaaaggcat ctacaaagcc atgagtgagt
```

```
 541 ttgacatctt catcaactac atagaagcct acatgacaat gaagatacga aactgagaca 601 tcagggtggc gactctatag actctaggac ataaattaga ggtctccaaa atcggatctg 661 gggctctggg atagctgacc cagccccttg agaaacctta ttgtacctct cttatagaat 721 atttattacc tctgatacct caacccccat ttctatttat ttactgagct tctctgtgaa 781 cgatttagaa agaagcccaa tattataatt tttttcaata tttattattt tcacctgttt 841 ttaagctgtt tccatagggt gacacactat ggtatttgag tgttttaaga taaattataa 901 gttacataag ggaggaaaaa aaatgttctt tggggagcca acagaagctt ccattccaag 961 cctgaccacg ctttctagct gttgagctgt tttccctgac ctccctctaa tttatcttgt 1021 ctctgggctt ggggcttcct aactgctaca aatactctta ggaagagaaa ccagggagcc 1081 cctttgatga ttaattcacc ttccagtgtc tcggagggat tcccctaacc tcattcccca 1141 accacttcat tcttgaaagc tgtggccagc ttgttattta taacaaccta aatttggttc 1201 taggccgggc gcggtggctc acgcctgtaa tcccagcact tgggaggct gaggcgggtg 1261 gatcacttga ggtcaggagt tcctaaccag cctggtcaac atggtgaaac cccgtctcta 1321 ctaaaaatac aaaaattagc cgggcatggt ggcgcgcacc tgtaatccca gctacttggg 1381 aggctgaggc aagagaattg cttgaaccca ggagatggaa gttgcagtga gctgatatca 1441 tgcccctgta ctccagcctg ggtgacagag caagactctg tctcaaaaaa taaaaataaa 1501 aataaatttg gttctaatag aactcagttt taactagaat ttattcaatt cctctgggaa 1561 tgttacattg tttgtctgtc ttcatagcag attttaattt tgaataaata aatgtatctt 1621 attcacatc
```

The protein and cDNA sequences of exemplary non-human homologues of IL-10 are shown in SEQ ID NOs: 142-149.

```
Precursor Mouse IL-10 Protein (with signal sequence in bold)
                                                    (SEQ ID NO: 142)
   1 mpgsallccl llltgmrisr gqysrednnc thfpvgqshm llelrtafsq vktffqtkdq 61 ldnilltdsl mqdfkgylgc qalsemiqfy lvevmpqaek hgpeikehln slgeklktlr 121 mrlrrchrfl pcenkskave qvksdfnklq dqgvykamne fdtttnciea ymmikmks Mouse IL-10 cDNA
                                                    (SEQ ID NO: 143)
   1 acatttagag acttgctctt gcactaccaa agccacaagg cagccttgca gaaaagagag 61 ctccatcatg cctggctcag cactgctatg ctgcctgctc ttactgactg gcatgaggat 121 cagcaggggc cagtacagcc gggaagacaa taactgcacc cacttcccag tcggccagag 181 ccacatgctc ctagagctgc ggactgcctt cagccaggtg aagactttct ttcaaacaaa 241 ggaccagctg gacaacatac tgctaaccga ctccttaatg caggacttta agggttactt 301 gggttgccaa gccttatcgg aaatgatcca gttttacctg gtagaagtga tgccccaggc 361 agagaagcat ggcccagaaa tcaaggagca tttgaattcc ctgggtgaga gctgaagac 421 cctcaggatg cggctgaggc gctgtcatcg atttctcccc tgtgaaaata gagcaaggc 481 agtggagcag gtgaagagtg atttaataaa gctccaagac caaggtgtct acaaggccat 541 gaatgaattt gacatcttca tcaactgcat agaagcatac atgatgatca aaatgaaaag 601 ctaaaacacc tgcagtgtgt attgagtctg ctggactcca ggacctagac agagctctct 661 aaatctgatc cagggatctt agctaacgga acaactcct tggaaaacct cgtttgtacc 721 tctctccgaa atatttatta cctctgatac ctcagttccc attctatta ttcactgagc
```

```
 781 ttctctgtga actatttaga aagaagccca atattataat tttacagtat ttattatttt 841 taacctgtgt ttaagctgtt tccattgggg acactttata gtatttaaag ggagattata 901 ttatatgatg ggaggggttc ttccttggga agcaattgaa gcttctattc taaggctggc 961 cacacttgag agctgcaggg ccctttgcta tggtgtcctt tcaattgctc tcatccctga 1021 gttcagagct cctaagagag ttgtgaagaa actcatgggt cttgggaaga gaaaccaggg 1081 agatcctttg atgatcattc ctgcagcagc tcagagggtt cccctactgt catccccag 1141 ccgcttcatc cctgaaaact gtggccagtt tgttatttat aaccacctaa aattagttct 1201 aatagaactc attttaact agaagtaatg caattcctct gggaatggtg tattgtttgt 1261 ctgcctttgt agcagactct aattttgaat aaatggatct tattcg
```

Precursor Rat IL-10 Protein (with signal sequence in bold)
(SEQ ID NO: 144)

```
  1 mpgsallccl lllagvktsk ghsirgdnnc thfpvsqthm lrelraafsq vktffqkkdq 61 ldnilltdsl lqdfkgylgc qalsemikfy lvevmpqaen hgpeikehln slgeklktlw 121 iqlrrchrfl pcenkskave qvkndfnklq dkgvykamne fdtttnciea yvtlkmkn
```

Rat IL-10 cDNA
(SEQ ID NO: 145)

```
  1 catgcctggc tcagcactgc tatgttgcct gctcttactg gctggagtga agaccagcaa 61 aggccattcc atccggggtg acaataactg cacccacttc ccagtcagcc agacccacat 121 gctccgagag ctgagggctg ccttcagtca agtgaagact ttctttcaaa agaaggacca 181 gctggacaac atactgctga cagattcctt actgcaggac tttaagggtt acttgggttg 241 ccaagccttg tcagaaatga tcaagtttta cctggtagaa gtgatgcccc aggcagagaa 301 ccatggccca gaaatcaagg agcatttgaa ttccctggga gagaagctga gaccctctg 361 gatacagctg cgacgctgtc atcgatttct cccctgtgag aataaaagca aggcagtgga 421 gcaggtgaag aatgatttta ataagctcca agacaaaggt gtctacaagg ccatgaatga 481 gtttgacatc ttcatcaact gcatagaagc ctacgtgaca ctcaaaatga aaattgaac 541 cacccggcat ctactggact gcaggacata aatagagctt ctaaatctga tccagagatc 601 ttagctaacg ggagcaactc cttggaaaac ctcgtttgta cctctctcca aaatatttat 661 tacctctgat acctcagttc cc
```

Precursor Rabbit IL-10 Protein
(SEQ ID NO: 146)

```
  1 mlssallccl vflggtgasr gqdtpaensc ihfpgglphm lrelraafgr vktffqskdq 61 lnsmiltesl ledlkgylgc qalsemiqfy lkdvmpqaen hspairehvn slgenlktlr 121 lrlrqchrfl pcenkskave qvksafsklq eegvykamse fdtttnyiet ymtmkiks
```

Rabbit IL-10 cDNA
(SEQ ID NO: 147)

```
  1 aaagcaaacc acaaggcgga ctcgtagaag caggcagagt tccaccatgc tcagctcagc 61 tctgctatgt tgcctggtct tcctgggtgg cacaggggcc agccgaggcc aggacacccc 121 tgctgagaac agctgcattc actttccagg cggcctgccc cacatgctcc gcgagctccg 181 tgctgccttt ggcagggtga agactttctt tcaatcgaag gatcagctga acagcatgtt 241 gttaaccgag tccctgctgg aggacttaa gggttacctg ggatgccaag ccttgtcgga 301 gatgatccag ttttacctga aggacgtgat gccgcaagct gagaaccaca gtccagccat 361 cagggagcac gtgaactccc tggggaaaa cctgaagacc ctcaggctga ggctgcgaca 421 atgtcaccga tttctcccct gtgaaaacaa gagcaaggca gtggagcagg tgaagagcgc 481 cttcagcaag ctgcaagagg aaggcgtcta caaagccatg agtgagtttg acatcttcat 541 caactacata gaaacctaca tgacaatgaa gataaaaagc taaaagcccc aggatggcaa
```

-continued

```
 601 ctcggctaga gtctaggaca tcagttaggg acctgcacac cctgggtcag ctgacccagc 661 accttggaaa gctgttgtac ctctcaatat ttattacctc tgatacctca gctcccgatc 721 ctatttattt accgagcttc tctgtgaact ctttagaaag aagcccacta ttataatttt 781 ttcagtattt attattttca cctgcattta agctgtaccc atggggtgat gccctgtggg 841 atttgagtgt cttaggagaa attataattt atgtgaaagg gaaaatgtgc cttggggagc 901 cgactgaggc ttccattcct tctgtgcctg accacacttt ctaactccta agccgagctc 961 cctcttaccc tctggagccc ggacctgggt ctcgagtgtt ccagagactc ctagcctctt 1021 aggaagagag accggaagcc cttgggtggt gaccttccgg cagctcagag ggaggctcct 1081 gacctcgat
```

Precursor Monkey IL-10 Protein (with signal sequence in bold)
(SEQ ID NO: 148)

```
  1 mhssallccl vlltgyrasp gqgtqsensc trfpgnlphm lrdlrdafsr vktffqmkdq 61 ldnillkesl ledfkgylgc qalsemiqfy leevmpqaen hdpdikehvn slgenlktlr 121 lrlrrchrfl pcenkskave qvknafsklq ekgvykamse fdtttnyiea ymtmkiqn
```

Monkey IL-10 cDNA
(SEQ ID NO: 149)

```
  1 agaaggcatg cacagctcag cactgctctg ttgcctagtc ctcctgactg gggtgagggc 61 cagcccaggc cagggcaccc agtctgagaa cagctgcacc cgcttcccag caacctgcc 121 tcacatgctt cgagacctcc gagatgcctt cagcagagtg aagactttct ttcaaatgaa 181 ggatcagctg gacaacatat tgttaaagga gtccttgctg gaggacttta agggttacct 241 gggttgccaa gccttgtctg agatgatcca gttttacctg gaggaggtga tgccccaagc 301 tgagaaccac gacccagaca tcaaggagca tgtgaactcc ctgggggaga atctgaagac 361 cctcaggctg aggctgcggc gctgtcatcg atttcttccc tgtgaaaaca gagcaaggc 421 cgtggagcag gtgaagaatg cctttagtaa gctccaagag aaaggcgtct acaaagccat 481 gagtgagttt gacatcttca tcaactacat agaagcctac atgacaatga gatacaaaa 541 ctgagacatc agggtggcga ctctatagac tctaggacat aaattagagg tctccaaaat 601 cagatccagg gttctgggat agctgaccca gccccttgag aaa
```

Exemplary protein and cDNA sequences for human IL-10R-1 and human IL-10R-2 are shown in SEQ ID NOs: 150-154.

Precursor Human IL-10R-1 Protein (with signal sequence in bold)
(SEQ ID NO: 150)

```
  1 mlpclvvlla allslrlgsd ahgtelpspp svwfeaeffh hilhwtpipn qsestcyeva 61 llrygieswn sisncsqtls ydltavtldl yhsngyrary ravdgsrhsn wtvtntrfsv 121 devtltvgsv nleihngfil gkiqlprpkm apandtyesi fshfreyeia irkvpgnftf 181 thkkvkhenf slltsgevge fcvqvkpsva srsnkgmwsk eecisltrqy ftvtnviiff 241 afvlllsgal ayclalqlyv rrrkklpsvl lfkkpspfif isqrpspetq dtihpldeea 301 flkvspelkn ldlhgstdsg fgstkpslqt eepqfllpdp hpqadrtlgn reppvlgdsc 361 ssgssnstds giclqepsls pstgptweqq vgsnsrgqdd sgidlvqnse gragdtqggs 421 alghhsppep evpgeedpaa vafqgylrqt rcaeekatkt gcleeesplt dglgpkfgrc 481 lvdeaglhpp alakgylkqd plemtlassg aptgqwnqpt eewsllalss csdlgisdws 541 fandlaplgc vaapggllgs fnsdlvtlpl isslqsse
```

-continued

Human IL-10R-1 cDNA, transcript variant 1

(SEQ ID NO: 151)

```
   1 gtcagtccca gcccaagggt agctggaggc gcgcaggccg gctccgctcc ggccccggac
  61 gatgcggcgc gcccaggatg ctgccgtgcc tcgtagtgct gctggcggcg ctcctcagcc
 121 tccgtcttgg ctcagacgct catgggacag agctgcccag ccctccgtct gtgtggtttg
 181 aagcagaatt tttccaccac atcctccact ggacacccat cccaaatcag tctgaaagta
 241 cctgctatga agtggcgctc ctgaggtatg aatagagtc  ctggaactcc atctccaact
 301 gtagccagac cctgtcctat gaccttaccg cagtgacctt ggacctgtac cacagcaatg
 361 gctaccgggc cagagtgcgg gctgtggacg gcagccggca ctccaactgg accgtcacca
 421 acacccgctt ctctgtggat gaagtgactc tgacagttgg cagtgtgaac ctagagatcc
 481 acaatggctt catcctcggg aagattcagc tacccaggcc aagatggccc cccgcaaatg
 541 acacatatga aagcatcttc agtcacttcc gagagtatga gattgccatt cgcaaggtgc
 601 cgggaaactt cacgttcaca acaagaaag taaaacatga aaacttcagc ctcctaacct
 661 ctggagaagt gggagagttc tgtgtccagg tgaaaccatc tgtcgcttcc cgaagtaaca
 721 agggatgtg gtctaaagag gagtgcatct ccctcaccag gcagtatttc accgtgacca
 781 acgtcatcat cttctttgcc tttgtcctgc tgctctccgg agccctcgcc tactgcctgg
 841 ccctccagct gtatgtgcgg cgccgaaaga agctacccag tgtcctgctc ttcaagaagc
 901 ccagccccTT catcttcatc agccagcgtc cctccccaga gacccaagac accatccacc
 961 cgcttgatga ggaggccttt ttgaaggtgt ccccagagct aagaacttg acctgcacg
1021 gcagcacaga cagtggcttt gcagcacca agccatccct gcagactgaa gagccccagt
1081 tcctcctccc tgaccctcac ccccaggctg acagaacgct gggaaacagg agcccctg
1141 tgctggggga cagctgcagt agtggcagca gcaatagcac agacagcggg atctgcctgc
1201 aggagcccag cctgagccc agcacagggg ccacctggga gcaacaggtg gggagcaaca
1261 gcaggggcca ggatgacagt ggcattgact tagttcaaaa ctctgagggc cgggctgggg
1321 acacacaggg tggctcggcc ttgggccacc acagtccccc ggagcctgag gtgcctgggg
1381 aagaagaccc agctgctgtg gcattccagg gttacctgag gcagaccaga tgtgctgaag
1441 agaaggcaac caagacaggc tgcctggagg aagaatcgcc cttgacagat ggccttggcc
1501 ccaaattcgg gagatgcctg gttgatgagg caggcttgca tccaccagcc ctggccaagg
1561 gctatttgaa acaggatcct ctagaaatga ctctggcttc ctcaggggcc ccaacgggac
1621 agtggaacca gcccactgag gaatggtcac tcctggcctt gagcagctgc agtgacctgg
1681 gaatatctga ctggagcttt gcccatgacc ttgcccctct aggctgtgtg gcagccccag
1741 gtggtctcct gggcagcttt aactcagacc tggtcaccct gccctcatc tctagcctgc
1801 agtcaagtga gtgactcggg ctgagaggct gcttttgatt ttagccatgc ctgctcctct
1861 gcctggacca ggaggagggc ccctgggggca gaagttaggc acgaggcagt ctgggcactt
1921 ttctgcaagt ccactggggc tggccccagc caggccctgc agggctggtc agggtgtctg
1981 gggcaggagg aggccaactc actgaactag tgcagggtat gtgggtggca ctgacctgtt
2041 ctgttgactg gggccctgca gactctggca gagctgagaa gggcagggac cttctccctc
2101 ctaggaactc tttcctgtat cataaaggat tatttgctca ggggaaccat ggggctttct
2161 ggagttgtgg tgaggccacc aggctgaagt cagctcagac ccagacctcc ctgcttaggc
2221 cactcgagca tcagagcttc cagcaggagg aagggctgta ggaatggaag cttcagggcc
2281 ttgctgctgg ggtcattttt aggggaaaaa ggaggatatg atggtcacat ggggaacctc
```

-continued

```
2341 ccctcatcgg gcctctgggg caggaagctt gtcactggaa gatcttaagg tatatatttt 2401 ctggacactc aaacacatca taatggattc actgagggga gacaaaggga gccgagaccc 2461 tggatgggc ttccagctca gaacccatcc ctctggtggg tacctctggc acccatctgc 2521 aaatatctcc ctctctccaa caaatggagt agcatccccc tggggcactt gctgaggcca 2581 agccactcac atcctcactt tgctgcccca ccatcttgct gacaacttcc agagaagcca 2641 tggttttttg tattggtcat aactcagccc tttgggcggc ctctgggctt gggcaccagc 2701 tcatgccagc cccagagggt cagggttgga ggcctgtgct tgtgtttgct gctaatgtcc 2761 agctacagac ccagaggata agccactggg cactgggctg gggtccctgc cttgttggtg 2821 ttcagctgtg tgattttgga ctagccactt gtcagagggc ctcaatctcc catctgtgaa 2881 ataaggactc cacctttagg ggaccctcca tgtttgctgg gtattagcca agctggtcct 2941 gggagaatgc agatactgtc cgtggactac caagctggct tgtttcttat gccagaggct 3001 aacagatcca atgggagtcc atggtgtcat gccaagacag tatcagacac agccccagaa 3061 gggggcatta tgggccctgc ctccccatag gccatttgga ctctgccttc aaacaaaggc 3121 agttcagtcc acaggcatgg aagctgtgag gggacaggcc tgtgcgtgcc atccagagtc 3181 atctcagccc tgcctttctc tggagcattc tgaaaacaga tattctggcc cagggaatcc 3241 agccatgacc cccacccctc tgccaaagta ctcttaggtg ccagtctggt aactgaactc 3301 cctctggagg caggcttgag ggaggattcc tcagggttcc cttgaaagct ttatttattt 3361 attttgttca tttatttatt ggagaggcag cattgcacag tgaaagaatt ctggatatct 3421 caggagcccc gaaattctag ctctgacttt gctgtttcca gtggtatgac cttggagaag 3481 tcacttatcc tcttggagcc tcagtttcct catctgcaga ataatgactg acttgtctaa 3541 ttcgtaggga tgtgaggttc tgctgaggaa atgggtatga atgtgccttg aacacaaagc 3601 tctgtcaata agtgatacat gttttttatt ccaataaatt gtcaagacca caggaaaaaa 3661 aaaaaaaaaa aa
```

Human IL-10R-1 cDNA, transcript variant 2

(SEQ ID NO: 152)

```
  1 gtcagtccca gcccaagggt agctggaggc gcgcaggccg gctccgctcc ggccccggac 61 gatgcggcgc gcccaggatg ctgccgtgcc tcgtagtgct gctggcggcg ctcctcagcc 121 tccgtcttgg ctcagacgct catggctcac ctgttgtgga agtggaagag ctgaaaattg 181 acaggaactg acggattggg aaggatagag aagtatgcgc aaggccaaac ccccaacccg 241 caaacctcat catccaccca cttctagatg agccggacag agctgcccag ccctccgtct 301 gtgtggtttg aagcagaatt tttccaccac atcctccact ggacacccat cccaaatcag 361 tctgaaagta cctgctatga agtggcgctc ctgaggtatg aatagagtc ctggaactcc 421 atctccaact gtagccagac cctgtcctat gaccttaccg cagtgacctt ggacctgtac 481 cacagcaatg ctaccgggc cagagtgcgg gctgtggacg gcagccggca ctccaactgg 541 accgtcacca cacccgctt ctctgtggat gaagtgactc tgacagttgg cagtgtgaac 601 ctagagatcc acaatggctt catcctcggg aagattcagc tacccaggcc caagatggcc 661 cccgcaaatg acacatatga agcatcttc agtcacttcc gagagtatga gattgccatt 721 cgcaaggtgc cgggaaactt cacgttcaca cacaagaaag taaaacatga aaacttcagc 781 ctcctaacct ctgagaagt gggagagttc tgtgtccagg tgaaaccatc tgtcgcttcc 841 cgaagtaaca aggggatgtg gtctaaagag gagtgcatct ccctcaccag gcagtatttc 901 accgtgacca acgtcatcat cttctttgcc tttgtcctgc tgctctccgg agccctcgcc 961 tactgcctgg ccctccagct gtatgtgcgg cgccgaaaga agagctaccca gtgtcctgctc
```

-continued

```
1021 ttcaagaagc ccagcccctt catcttcatc agccagcgtc cctccccaga gacccaagac
1081 accatccacc cgcttgatga ggaggccttt ttgaaggtgt ccccagagct gaagaacttg
1141 gacctgcacg gcagcacaga cagtggcttt ggcagcacca agccatccct gcagactgaa
1201 gagccccagt tcctcctccc tgaccctcac ccccaggctg acagaacgct gggaaacagg
1261 gagcccctg tgctggggga cagctgcagt agtggcagca gcaatagcac agacagcggg
1321 atctgcctgc aggagcccag cctgagcccc agcacagggc ccacctggga gcaacaggtg
1381 gggagcaaca gcaggggcca ggatgacagt ggcattgact tagttcaaaa ctctgagggc
1441 cgggctgggg acacacaggg tggctcggcc ttgggccacc acagtccccc ggagcctgag
1501 gtgcctgggg aagaagaccc agctgctgtg gcattccagg gttacctgag gcagaccaga
1561 tgtgctgaag agaaggcaac caagacaggc tgcctggagg aagaatcgcc cttgacagat
1621 ggccttggcc ccaaattcgg gagatgcctg gttgatgagg caggcttgca tccaccagcc
1681 ctggccaagg gctatttgaa acaggatcct ctagaaatga ctctggcttc ctcaggggcc
1741 ccaacgggac agtggaacca gcccactgag gaatggtcac tcctggcctt gagcagctgc
1801 agtgacctgg gaatatctga ctggagcttt gcccatgacc ttgcccctct aggctgtgtg
1861 gcagcccag gtggtctcct gggcagcttt aactcagacc tggtcaccct gcccctcatc
1921 tctagcctgc agtcaagtga gtgactcggg ctgagaggct gcttttgatt ttagccatgc
1981 ctgctcctct gcctggacca ggaggagggc ccctggggca gaagttaggc acgaggcagt
2041 ctgggcactt ttctgcaagt ccactggggc tggcccagc caggccctgc agggctggtc
2101 agggtgtctg gggcaggagg aggccaactc actgaactag tgcagggtat gtgggtggca
2161 ctgacctgtt ctgttgactg gggccctgca gactctggca gagctgagaa gggcagggac
2221 cttctcccctc ctaggaactc tttcctgtat cataaaggat tatttgctca ggggaaccat
2281 ggggctttct ggagttgtgg tgaggccacc aggctgaagt cagctcagac ccagacctcc
2341 ctgcttaggc cactcgagca tcagagcttc agcaggagg aagggctgta ggaatggaag
2401 cttcagggcc ttgctgctgg ggtcattttt aggggaaaaa ggaggatatg atggtcacat
2461 ggggaacctc ccctcatcgg gcctctgggg caggaagctt gtcactggaa gatcttaagg
2521 tatatatttt ctggacactc aaacacatca taatggattc actgagggga gacaaaggga
2581 gccgagaccc tggatggggc ttccagctca gaacccatcc ctctggtggg tacctctggc
2641 acccatctgc aaatatctcc ctctctccaa caaatggagt agcatccccc tggggcactt
2701 gctgaggcca agccactcac atcctcactt tgctgcccca ccatcttgct gacaacttcc
2761 agagaagcca tggttttttg tattggtcat aactcagccc tttgggcggc ctctgggctt
2821 gggcaccagc tcatgccagc cccagagggt cagggttgga ggcctgtgct tgtgtttgct
2881 gctaatgtcc agctacagac ccagaggata agccactggg cactgggctg ggtccctgc
2941 cttgttggtg ttcagctgtg tgattttgga ctagccactt gtcagagggc ctcaatctcc
3001 catctgtgaa ataaggactc cacctttagg ggaccctcca tgtttgctgg gtattagcca
3061 agctggtcct gggagaatgc agatactgtc cgtggactac caagctggct tgtttcttat
3121 gccagaggct aacagatcca atgggagtcc atggtgtcat gccaagacag tatcagacac
3181 agccccagaa gggggcatta tgggccctgc ctccccatag gccatttgga ctctgccttc
3241 aaacaaaggc agttcagtcc acaggcatgg aagctgtgag gggacaggcc tgtgcgtgcc
3301 atccagagtc atctcagccc tgcctttctc tggagcattc tgaaaacaga tattctggcc
3361 cagggaatcc agccatgacc cccacccctc tgccaaagta ctcttaggtg ccagtctggt
```

-continued

```
3421 aactgaactc cctctggagg caggcttgag ggaggattcc tcagggttcc cttgaaagct
3481 ttatttattt attttgttca tttatttatt ggagaggcag cattgcacag tgaaagaatt
3541 ctggatatct caggagcccc gaaattctag ctctgacttt gctgtttcca gtggtatgac
3601 cttggagaag tcacttatcc tcttggagcc tcagtttcct catctgcaga ataatgactg
3661 acttgtctaa ttcgtaggga tgtgaggttc tgctgaggaa atgggtatga atgtgccttg
3721 aacacaaagc tctgtcaata agtgatacat gttttttatt ccaataaatt gtcaagacca
3781 caggaaaaaa aaaaaaaaa aa
```

Precursor Human IL-10R-2 Protein (with signal sequence in bold)
(SEQ ID NO: 153)

```
  1 mawslgswlg gcllvsalgm vpppenvrmn svnfknilqw espafakgnl tftaqylsyr
 61 ifqdkcmntt ltecdfssls kygdhtlrvr aefadehsdw vnitfcpvdd tiigppgmqv
121 evladslhmr flapkieney etwtmknvyn swtynvqywk ngtdekfqit pqydfevlrn
181 lepwttycvq vrgflpdrnk agewsepvce qtthdetvps wmvavilmas vfmvclallg
241 cfallwcvyk ktkyafsprn slpqhlkefl ghphhntllf fsfplsdend vfdklsviae
301 dsesgkqnpg dscslgtppg qgpqs
```

Human IL-10R-2 cDNA
(SEQ ID NO: 154)

```
   1 cccgcccatc tccgctggtt cccggaagcc gccgcggaca agctctcccg ggcgcgggcg
  61 ggggtcgtgt gcttggagga agccgcggaa ccccagcgt ccgtccatgg cgtggagcct
 121 tgggagctgg ctgggtggct gcctgctggt gtcagcattg gaatggtac cacctcccga
 181 aaatgtcaga atgaattctg ttaatttcaa gaacattcta cagtgggagt cacctgcttt
 241 tgccaaaggg aacctgactt tcacagctca gtacctaagt tataggatat ccaagataa
 301 atgcatgaat actaccttga cggaatgtga tttctcaagt cttccaagt atggtgacca
 361 caccttgaga gtcagggctg aatttgcaga tgagcattca gactgggtaa acatcacctt
 421 ctgtcctgtg gatgacacca ttattggacc ccctggaatg caagtagaag tacttgctga
 481 ttctttacat atgcgtttct tagcccctaa aattgagaat gaatacgaaa cttggactat
 541 gaagaatgtg tataactcat ggacttataa tgtgcaatac tggaaaaacg gtactgatga
 601 aaagtttcaa attactcccc agtatgactt tgaggtcctc agaaacctgg agccatggac
 661 aacttattgt gttcaagttc gagggttct tcctgatcgg aacaaagctg gggaatggag
 721 tgagcctgtc tgtgagcaaa caacccatga cgaaacggtc cctcctgga tggtggccgt
 781 catcctcatg gcctcggtct tcatggtctg cctggcactc ctcggctgct tcgccttgct
 841 gtggtgcgtt tacaagaaga caaagtacgc cttctcccct aggaattctc ttccacagca
 901 cctgaaagag tttttgggcc atcctcatca taacacactt ctgttttct cctttccatt
 961 gtcggatgag aatgatgttt tgacaagct aagtgtcatt gcagaagact ctgagagcgg
1021 caagcagaat cctggtgaca gctgcagcct cgggaccccg cctgggcagg gccccaaag
1081 ctaggctctg agaaggaaac acactcggct gggcacagtg acgtactcca tctcacatct
1141 gcctcagtga gggatcaggg cagcaaacaa gggccaagac catctgagcc agccccacat
1201 ctagaactcc cagaccctgg acttagccac cagagagcta cattttaaag gctgtcttgg
1261 caaaaatact ccatttggga actcactgcc ttataaaggc tttcatgatg ttttcagaag
1321 ttggccactg agagtgtaat tttcagcctt ttatatcact aaaataagat catgttttaa
1381 ttgtgagaaa cagggccgag cacagtggct cacgcctgta ataccagcac cttagaggtc
1441 gaggcaggcg gatcacttga ggtcaggagt tcaagaccag cctggccaat atggtgaaac
1501 ccagtctcta ctaaaaatac aaaaattagc taggcatgat ggcgcatgcc tataatccca
```

-continued

```
1561 gctactcgag tgcctgaggc aggagaattg catgaacccg ggaggaggag gaggaggttg 1621 cagtgagccg agatagcggc actgcactcc agcctgggtg acaaagtgag actccatctc 1681 aaaaaaaaaa aaaaaaaaaa ttgtgagaaa cagaaatact taaaatgagg aataagaatg 1741 gagatgttac atctggtaga tgtaacattc taccagatta tggatggact gatctgaaaa 1801 tcgacctcaa ctcaagggtg gtcagctcaa tgctacacag agcacggact tttggattct 1861 ttgcagtact ttgaatttat ttttctacct atatatgttt tatatgctgc tggtgctcca 1921 ttaaagtttt actctgtgtt gcactatatg tgttcatgat aaaaaa
```

Recombinant IL-10

In some examples, an IL-10 receptor agonist is a recombinant IL-10 protein. In some examples, a recombinant IL-10 protein has an amino acid sequence that is identical to a human IL-10 protein (e.g., SEQ ID NO: 140). Non-limiting commercial sources of recombinant human IL-10 protein are available from Peprotech (Rocky Hill, NJ), Novus Biologicals (Littleton, CO), Stemcell™ Technologies (Cambridge, MA), Millipore Sigma (Billerica, MA), and R&D Systems (Minneapolis, MN). In some examples, a recombinant human IL-10 protein can be Tenovil™ (Schering Corporation).

In some examples, a recombinant IL-10 protein is a functional fragment of human IL-10 protein (e.g., SEQ ID NO: 140). In some examples, a functional fragment of human IL-10 is a fragment of a human IL-10 protein (e.g., SEQ ID NO: 140) that is able to specifically bind to and activate a human receptor of IL-10. For example, a functional fragment of human IL-10 protein can have one, two, three, four, five, six, seven, eight, nine, ten, eleven, twelve, thirteen, fourteen, fifteen, sixteen, seventeen, eighteen, nineteen, or twenty amino acids from the N- and/or C-terminus of SEQ ID NO: 140.

In some examples, a recombinant human IL-10 includes a sequence at least 80% identical (e.g., at least 82% identical, at least 84% identical, at least 86% identical, at least 88% identical, at least 90% identical, at least 92% identical, at least 94% identical, at least 95% identical, at least 96% identical, at least 98% identical, or at least 99% identical) to SEQ ID NO: 140, and is able to specifically bind to and activate a human receptor of IL-10. Mutation of amino acids that are not conserved between different mammalian species less likely to have a negative effect on the activity of a recombinant IL-10 protein.

In some embodiments, the IL-10 receptor agonist is rhuIL-10 (Tenovil) or a variant thereof. See, e.g., McHutchison et al., J. Interferon Cytokine Res. 1:1265-1270, 1999; Rosenblum et al., Regul. Toxicol. Pharmacol. 35:56-71, 2002; Schreiber et al., Gastroenterology 119 (6): 1461-1472, 2000; Maini et al., Arthritis Rheum. 40 (Suppl): 224, 1997. Exemplary methods of making a recombinant human IL-10 are described in Pajkrt et al., J. Immunol. 158:3971-3977, 1997). Additional exemplary methods of making recombinant IL-10 are described herein and are known in the art.

In some embodiments, a recombinant IL-10 is a pegylated recombinant IL-10 (e.g., pegylated recombinant human IL-10) (e.g., a 5 kDa N-terminally PEGylated form of IL-10; AM0010) (Infante et al., ASCO Meeting Abstracts 33 (15_suppl): 3017, 2015; Chan et al., PLOS One 11 (6): e0156229, 2016; Mumm et al., Cancer Cell 20 (6): 781-796, 2011; Teng et al., Cancer Cell 20 (6): 691-693, 2011; U.S. Pat. Nos. 8,691,205; 8,865,652; 9,259,478; and 9,364,517; and U.S. Patent Application Publication Nos. 2008/0081031; 2009/0214471; 2011/0250163; 2011/0091419; 2014/0227223; 2015/0079031; 2015/0086505; 2016/0193352; 2016/0367689; 2016/0375101; and 2016/0166647).

In some embodiments, a recombinant IL-10 is a stabilized isoform of a recombinant IL-10. In some embodiments, the stabilized isoform of a recombinant IL-10 is a viral IL-10 protein (e.g., a human cytomegalovirus IL10 (e.g., cmv-IL10, LA-cmv-IL.-10 (e.g., Lin et al., Virus Res. 131 (2): 213-223, 2008; Jenkins et al., J. Virol. 78 (3): 1440-1447, 2004; Kotenko et al., Proc. Natl. Acad. Sci. U.S.A. 97 (4): 1695-1700, 2000; Jones et al., Proc. Natl. Acad. Sci. U.S.A. 99 (14): 9404-9409, 2002) or a latency-associated viral IL-10 protein (e.g., Poole et al., J. Virol. 88 (24): 13947-13955, 2014).

In some embodiments, the recombinant IL-10 is a mammalian IL-10 homolog (see, e.g., WO 00/073457). In some embodiments, a mammalian IL-10 homolog is BCRF1, an EBV homolog of human IL-10, also known as viral IL-10, or a variant thereof (Liu et al., J. Immunol. 158 (2): 604-613, 1997).

Fusion Protein Inhibitors of IL-10

In some embodiments, the IL-10 receptor agonist is a fusion protein. In some embodiments, the fusion protein comprises the amino acid sequence of an IL-10 protein (or a functional fragment thereof) and a fusion partner (e.g., an Fc region (e.g., human IgG Fc) or human serum albumin). In some embodiments the fusion partner can be an antibody or an antigen-binding antibody fragment (e.g., an scFv) that targets IL-10 receptor agonist to an inflamed tissue. In some embodiments, the antibody or antigen-binding fragment that is a fusion partner can bind specifically, or preferentially, to inflamed gastrointestinal cells by, e.g., CD69. In some embodiments, an IL-10 receptor agonist that is a fusion protein can be, e.g., F8-IL-10, such as Dekavil (Philogen).

In some embodiments, the fusion protein is a L19-IL-10 fusion protein, a HyHEL10-IL-10 fusion protein, or a variant thereof. See, e.g., Trachsel et al., Arthritis Res. Ther. 9 (1): R9, 2007, and Walmsley et al., Arthritis Rheum. 39:495-503, 1996.

IL-10 Peptide Mimetics

In some embodiments, the IL-10 receptor agonist is an IL-10 peptide mimetic. A non-limiting example of an IL-10 peptide mimetic is IT 9302 or a variant thereof (Osman et al., Surgery 124 (3): 584-92, 1998; Lopez et al., Immunobiology 216 (10): 1117-1126, 2011). Additional examples of IL-10 peptide mimetics are described in DeWitt, Nature Biotech. 17:214, 1999, and Reineke et al., Nature Biotech. 17:271-275, 1999.

Antibodies and Antigen-Binding Fragments

In some embodiments, the IL-10 receptor agonist is an antibody or an antigen-binding antibody fragment that binds to and activates an IL-10 receptor (e.g., a human IL-10 receptor). In some embodiments, the antibody or antigen-binding antibody fragment that specifically binds to an epitope on IL-10R-1 protein (e.g., human IL-10R-1 protein). In some embodiments, the antibody or antigen-binding antibody fragment that specifically binds to an epitope on IL-10R-2 protein (e.g., a human IL-10R-2 protein). In some embodiments, the antibody or the antigen-binding antibody fragment that specifically binds to an epitope on IL-10R-1 and IL-10R-2 proteins (e.g., human IL-10R-1 and human IL-10R-2 proteins).

In some embodiments, the antibody can be a humanized antibody, a chimeric antibody, a multivalent antibody, or a fragment thereof. In some embodiments, an antibody can be a scFv-Fc, a VHH domain, a VNAR domain, a (scFv) 2, a minibody, or a BiTE. In some embodiments, an antibody can be a DVD-Ig, and a dual-affinity re-targeting antibody (DART), a triomab, kih IgG with a common LC, a crossmab, an ortho-Fab IgG, a 2-in-1-IgG, IgG-ScFv, scFv2-Fc, a bi-nanobody, tanden antibody, a DART-Fc, a scFv-HAS-scFv, DNL-Fab3, DAF (two-in-one or four-in-one), Duta-Mab, DT-IgG, knobs-in-holes common LC, knobs-in-holes assembly, charge pair antibody, Fab-arm exchange antibody, SEEDbody, Triomab, LUZ-Y, Fcab, kx-body, orthogonal Fab, DVD-IgG, IgG (H)-scFv, scFv-(H) IgG, IgG (L)-scFv, scFv-(L)-IgG, IgG (L,H)-Fc, IgG (H)-V, V (H)-IgG, IgG (L)-V, V (L)-IgG, KIH IgG-scFab, 2scFv-IgG, IgG-2scFv, scFv4-Ig, Zybody, DVI-IgG, nanobody, nanobody-HSA, a diabody, a TandAb, scDiabody, scDiabody-CH3, Diabody-CH3, Triple Body, miniantibody, minibody, TriBi minibody, scFv-CH3 KIH, Fab-scFv, scFv-CH-CL-scFv, F(ab')$_2$-scFV2, scFv-KIH, Fab-scFv-Fc, tetravalent HCAb, scDiabody-Fc, diabody-Fc, tandem scFv-Fc, intrabody, dock and lock bispecific antibody, ImmTAC, HSAbody, scDiabody-HAS, tandem scFv, IgG-IgG, Cov-X-Body, and scFv1-PEG-scFv2.

Non-limiting examples of an antigen-binding fragment of an antibody include an Fv fragment, a Fab fragment, a F(ab')$_2$ fragment, and a Fab' fragment. Additional examples of an antigen-binding fragment of an antibody is an antigen-binding fragment of an IgG (e.g., an antigen-binding fragment of IgG1, IgG2, IgG3, or IgG4) (e.g., an antigen-binding fragment of a human or humanized IgG, e.g., human or humanized IgG1, IgG2, IgG3, or IgG4); an antigen-binding fragment of an IgA (e.g., an antigen-binding fragment of IgA1 or IgA2) (e.g., an antigen-binding fragment of a human or humanized IgA, e.g., a human or humanized IgA1 or IgA2); an antigen-binding fragment of an IgD (e.g., an antigen-binding fragment of a human or humanized IgD); an antigen-binding fragment of an IgE (e.g., an antigen-binding fragment of a human or humanized IgE); or an antigen-binding fragment of an IgM (e.g., an antigen-binding fragment of a human or humanized IgM).

In some embodiments, the IL-10 receptor agonist is an antibody (e.g., F8-IL10 (also known as DEKAVIL) or a variant thereof (see, e.g., Schwager et al., *Arthritis Res. Ther.* 11 (5): R142, 2009; Franz et al., *Int. J. Cardiol.* 195:311-322, 2015; Galeazzi et al., *Isr. Med. Assoc. J.* 16 (10): 666, 2014).

In some embodiments, any of the antibodies or antigen-binding fragments described herein has a dissociation constant ($K_D$) of less than $1\times10^{-5}$ M (e.g., less than $0.5\times10^{-5}$ M, less than $1\times10^{-6}$ M, less than $0.5\times10^{-6}$ M, less than $1\times10^{-7}$ M, less than $0.5\times10^{-7}$ M, less than $1\times10^{-8}$ M, less than $0.5\times10^{-8}$ M, less than $1\times10^{-9}$ M, less than $0.5\times10^{-9}$ M, less than $1\times10^{-10}$ M, less than $0.5\times10^{-10}$ M, less than $1\times10^{-11}$ M, less than $0.5\times10^{-11}$ M, or less than $1\times10^{-12}$ M), e.g., as measured in phosphate buffered saline using surface plasmon resonance (SPR).

In some embodiments, any of the antibodies or antigen-binding fragments described herein has a $K_D$ of about $1\times10^{-12}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, about $0.5\times10^{-9}$ M, about $1\times10^{-10}$ M, about $0.5\times10^{-10}$ M, about $1\times10^{-11}$ M, or about $0.5\times10^{-11}$ M (inclusive); about $0.5\times10^{-11}$ M to about $1\times10^{-5}$ M, about $0.5\times10^{5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, about $0.5\times10^{-9}$ M, about $1\times10^{-10}$ M, about $0.5\times10^{-10}$ M, or about $1\times10^{-11}$ M (inclusive); about $1\times10^{-11}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, about $0.5\times10^{-9}$ M, about $1\times10^{-10}$ M, or about $0.5\times10^{-10}$ M (inclusive); about $0.5\times10^{-10}$ M to about $1\times10^{5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, about $0.5\times10^{-9}$ M, or about $1\times10^{-10}$ M (inclusive); about $1\times10^{-10}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, or about $0.5\times10^{-9}$ M (inclusive); about $0.5\times10^{-9}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, or about $1\times10^{-9}$ M (inclusive); about $1\times10^{-9}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, or about $0.5\times10^{-8}$ M (inclusive); about $0.5\times10^{-8}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, or about $1\times10^{-8}$ M (inclusive); about $1\times10^{-8}$ M to about $1\times10^{-5}$ M, about $0.5\times10^{-5}$ M, about $1\times10^{-6}$ M, about $0.5\times10^{-6}$ M, about $1\times10^{-7}$ M, or about $0.5\times10^{-7}$ M (inclusive); about $0.5\times10^{-7}$ M to about $1\times10^{-5}$ M, about $0.5\times10^{-5}$ M, about $1\times10^{-6}$ M, about $0.5\times10^{-6}$ M, or about $1\times10^{-7}$ M (inclusive); about $1\times10^{-7}$ M to about $1\times10^{-5}$ M, about $0.5\times10^{-5}$ M, about $1\times10^{-6}$ M, or about $0.5\times10^{-6}$ M (inclusive); about $0.5\times10^{-6}$ M to about $1\times10^{-5}$ M, about $0.5\times10^{-5}$ M, or about $1\times10^{-6}$ M (inclusive); about $1\times10^{-6}$ M to about $1\times10^{-5}$ M or about $0.5\times10^{-5}$ M (inclusive); or about $0.5\times10^{-5}$ M to about $1\times10^{-5}$ M (inclusive), e.g., as measured in phosphate buffered saline using surface plasmon resonance (SPR).

In some embodiments, any of the antibodies or antigen-binding fragments described herein has a $K_{off}$ of about $1\times10^{-6}$ s$^{-1}$ to about $1\times10^{-3}$ s$^{-1}$, about $0.5\times10^{-3}$ s$^{-1}$, about $1\times10^{-4}$ s$^{-1}$, about $0.5\times10^{-4}$ s$^{-1}$, about $1\times10^{-5}$ s$^{-1}$, or about $0.5\times10^{-5}$ s$^{-1}$ (inclusive); about $0.5\times10^{-5}$ s$^{1}$ to about $1\times10^{-3}$ s$^{-1}$, about $0.5\times10^{-3}$ s$^{-1}$, about $1\times10^{-4}$ s$^{-1}$, about $0.5\times10^{-4}$ s$^{-1}$, or about $1\times10^{-5}$ s$^{-1}$ (inclusive); about $1\times10^{-5}$ s$^{-1}$ to about $1\times10^{-3}$ s$^{-1}$, about $0.5\times10^{-3}$ s$^{-1}$, about $1\times10^{-4}$ s$^{-1}$, or about $0.5\times10^{-4}$ s$^{-1}$ (inclusive); about $0.5\times10^{-4}$ s$^{-1}$ to about $1\times10^{-3}$ s$^{-1}$, about $0.5\times10^{-3}$ s$^{-1}$, or about $1\times10^{-4}$ s$^{-1}$ (inclusive); about $1\times10^{-4}$ s$^{-1}$ to about $1\times10^{-3}$ s$^{-1}$, or about $0.5\times10^{-3}$ s$^{-1}$ (inclusive); or about $0.5\times10^{-5}$ s$^{-1}$ to about $1\times10^{-3}$ s$^{-1}$ (inclusive), e.g., as measured in phosphate buffered saline using surface plasmon resonance (SPR).

In some embodiments, any of the antibodies or antigen-binding fragments described herein has a $K_{on}$ of about $1\times10^{2}$ M$^{-1}$s$^{-1}$ to about $1\times10^{6}$ M$^{-1}$s$^{-1}$, about $0.5\times10^{6}$ M$^{-1}$s$^{-1}$, about $1\times10^{5}$ M$^{-1}$s$^{-1}$, about $0.5\times10^{5}$ M$^{-1}$s$^{-1}$, about $1\times10^{4}$ M$^{-1}$s$^{-1}$, about $0.5\times10^{4}$ M$^{1}$s$^{-1}$, about $1\times10^{3}$ M$^{-1}$s$^{-1}$, or about $0.5\times10^{3}$ $M^{-1}s^{-1}$ (inclusive); about $0.5\times10^3$ $M^{-1}s^{-1}$ to about $1\times10^6$ $M^{-1}s^{-1}$, about $0.5\times10^6$ $M^{-1}s^{-1}$, about $1\times10^5$ $M^{-1}s^{-1}$, about $0.5\times10^5$ $M^{-1}s^{-1}$, about $1\times10^4$ $M^{-1}s^{-1}$, about $0.5\times10^4$ $M^{-1}s^{-1}$, or about $1\times10^3$ $M$-1s-| (inclusive); about $1\times10^3$ $M^{-1}s^{-1}$ to about $1\times10^6$ $M^{-1}s^{-1}$, about $0.5\times10^6$ $M^{-1}s^{-1}$, about $1\times10^5$ $M^{-1}s^{-1}$, about $0.5\times10^5$ $M^{-1}s^{-1}$, about $1\times10^4$ $M^{-1}s^{-1}$, or about $0.5\times10^4$ $M^{-1}s^{-1}$ (inclusive); about $0.5\times10^4$ $M^{-1}s^{-1}$ to about $1\times10^6$ $M^{-1}s^{-1}$, about $0.5\times10^6$ $M^{-1}s^{-1}$, about $1\times10^5$ $M^{-1}s^{-1}$, about $0.5\times10^5$ $M^{-1}s^{-1}$, or about $1\times10^4$ $M^{-1}s^{-1}$ (inclusive); about $1\times10^4$ $M^{-1}s^{-1}$ to about $1\times10^6$ $M^{-1}s^{-1}$, about $0.5\times10^6$ $M^{-1}s^{-1}$, about $1\times10^5$ $M^{-1}s^{-1}$, or about $0.5\times10^5$ $M^{-1}s^{-1}$ (inclusive); about $0.5\times10^5$ $M^{-1}s^{-1}$ to about $1\times10^6$ $M^{-1}s^{-1}$, about $0.5\times10^6$ $M^{-1}s^{-1}$, or about $1\times10^5$ $M^{-1}s^{-1}$ (inclusive); about $1\times10^5$ $M^{-1}s^{-1}$ to about $1\times10^6$ $M^{-1}s^{-1}$, or about $0.5\times10^6$ $M^{-1}s^{-1}$ (inclusive); or about $0.5\times10^6$ $M^{-1}s^{-1}$ to about $1\times10^6$ $M^{-1}s^{-1}$ (inclusive), e.g., as measured in phosphate buffered saline using surface plasmon resonance (SPR).

Cells Producing a Recombinant IL-10

In some embodiments, any of the devices or compositions described herein can include a recombinant cell (e.g., a recombinant mammalian cell) that secretes a recombinant IL-10 (e.g., any of the recombinant IL-10 proteins described herein). In some embodiments, any of the devices or compositions described herein can include a cell (e.g., a mammalian cell) that secretes IL-10 (e.g., human IL-10). In some embodiments, the mammalian cell can be a mammalian cell obtained from the subject, and after introduction of a nucleic acid encoding the recombinant IL-10 (e.g., any of the recombinant IL-10 proteins described herein) into the cell obtained from the subject, the cell is incorporated into any of the compositions or devices described herein.

A recombinant cell can be generated by introducing a vector including a nucleic acid sequence encoding a recombinant IL-10 protein (e.g., any of the recombinant IL-10 proteins described herein). In some embodiments, the vector or the nucleic acid sequence encoding a recombinant IL-10 protein is integrated into a chromosome of the recombinant mammalian cell. In some embodiments, the vector or the nucleic acid sequence encoding a recombinant IL-10 protein is not integrated into a chromosome of the recombinant mammalian cell.

A vector can be a viral vector. Non-limiting examples of viral vectors include adenovirus vectors, herpes virus vectors, baculovirus vectors, and retroviral vectors. An expression vector can also be a plasmid or a cosmid. Additional examples of vectors are known in the art.

A vector can include a promoter sequence operably linked to the nucleic acid sequence encoding a recombinant IL-10 protein (e.g., any of the recombinant IL-10 proteins described herein). Non-limiting examples of promoter sequences that can be operably linked to the sequence (e.g., cDNA) encoding a recombinant IL-10 protein (e.g., any of the recombinant IL-10 proteins described herein) include: Simian Virus 40 (SV40) early promoter, ribosomal protein 21 (rpS21) promoter, hamster β-actin promoter, cytomegalovirus (CMV) promoter (e.g., CMV immediate early promoter (see, e.g., Teschendorf et al., *Anticancer Res.* 22:3325-3330, 2002), ubiquitin C (UBC) promoter, elongation factor 1-α (EF1A) promoter, phosphoenolpyruvate carboxykinase (PCK) promoter, IE2 promoter/enhancer region from mouse CMV (see, e.g., Chatellard et al., *Biotechnol. Bioeng.* 96:106-117, 2007), and chicken β-actin promoter. Additional non-limiting examples of human gene promoters that can be used in any of the vectors described herein are described in the Mammalian Promoter Database (Wistar Institute website at mrpombdb.wister.upenn.edu). Additional examples of mammalian promoter sequences that can be used in the expression vectors are known in the art.

Non-limiting examples of methods that can be used to introduce a vector or a nucleic acid into a cell (e.g., a mammalian cell) include lipofection, transfection, electroporation, microinjection, calcium phosphate transfection, dendrimer-based transfection, cationic polymer transfection, cell squeezing, sonoporation, optical transfection, impalection, hydrodynamic delivery, magnetofection, viral transduction (e.g., adenoviral and lentiviral transduction), and nanoparticle transfection. These and other methods of introducing a vector or a nucleic acid into a cell are well known in the art.

In some examples, the recombinant mammalian cell can be a Chinese Hamster Ovary (CHO) cell, a B cell, a CD8' T cell, a dendritic cell, a keratinocyte or an epithelial cell. See, e.g., Mosser et al., *Immunol. Rev.* 226:205-218, 2009; Fillatreau et al., *Nat. Rev. Immunol.* 8:391-397, 2008; Ryan et al., *Crit. Rev. Immunol.* 27:15-32, 2007; Moore et al., *Annu. Rev. Immunol.* 19:683-765, 2001. In some embodiments, the recombinant mammalian cell can be a mesenchymal stem cell (e.g., Gupte et al., *Biomed. J.* 40 (1): 49-54, 2017).

Nucleic Acids and Vectors Encoding an IL-10 Receptor Agonist

In some examples, an IL-10 receptor agonist can be a nucleic acid (e.g., a vector) that includes a sequence encoding an IL-10 receptor agonist (e.g., any of the IL-10 proteins described herein). In some embodiments, the nucleic acid includes a sequence encoding IL-10 (e.g., human IL-10). In some embodiments, the nucleic acid includes a sequence encoding a recombinant IL-10 (e.g., a recombinant human IL-10). In some examples, the sequence encoding an IL-10 receptor agonist can be SEQ ID NO: 141. In some embodiments, the sequence encoding an IL-10 receptor agonist can include a sequence that is at least 80% (e.g., at least 82%, at least 84%, at least 86%, at least 88%, at least 90%, at least 92%, at least 94%, at least 95%, at least 96%, at least 98%, or at least 99%) identical to SEQ ID NO: 141.

The nucleic acid can be, e.g., a vector. In some embodiments, a vector can be a viral vector (e.g., an adenovirus vector, a herpes virus vector, a baculovirus vector, or a retrovirus vector). A vector can also be, e.g., a plasmid or a cosmid. Additional examples of vectors are known in the art.

A vector can include a promoter sequence operably linked to the sequence encoding an IL-10 receptor agonist (e.g., any of the recombinant IL-10 proteins described herein). Non-limiting examples of promoter sequences that can be operably linked to the sequence encoding an IL-10 receptor agonist (e.g., any of the recombinant IL-10 proteins described herein) include: Simian Virus 40 (SV40) early promoter, ribosomal protein 21 (rpS21) promoter, hamster β-actin promoter, cytomegalovirus (CMV) promoter (e.g., CMV immediate early promoter (see, e.g., Teschendorf et al., *Anticancer Res.* 22:3325-3330, 2002), ubiquitin C (UBC) promoter, elongation factor 1-α (EF1A) promoter, phosphoenolpyruvate carboxykinase (PCK) promoter, IF2 promoter/enhancer region from mouse CMV (see, e.g., Chatellard et al., *Biotechnol. Bioeng.* 96:106-117, 2007), and chicken β-actin promoter. Additional non-limiting examples of human gene promoters that can be used in any of the vectors described herein are described in the Mammalian Promoter Database (Wistar Institute website at mrpombdb.wister.upenn.edu). A promoter can be a constitutive promoter or an inducible promoter. Examples of constitutive promoters and inducible promoters are known in the art. Additional examples and features of mammalian promoter sequences that can be used in the expression vectors are known in the art.

A non-limiting example of a composition including a nucleic acid that encodes an IL-10 receptor agonist is XT-150 (Xalud Therapeutics).

Additional IL-10 Receptor Agonists

In some embodiments, the recombinant cell is a recombinant Gram-positive bacterial cell (e.g., a genetically modified *Lactococcus lactis* (LL-Thyl2) (see, e.g., Steidler et al., *Science* 289:1352-1355, 2000; Braat et al., *Clin. Gastroenterol. Heptal.* 4:754-759, 2006). In some embodiments, the recombinant cell is a recombinant Gram-negative bacterial cell (e.g., a *Shigella flexneri* cell) that secretes an IL-10 receptor agonist (e.g., a recombinant IL-10 protein) (Chamekh et al., *J. Immunol.* 180 (6): 4292-4298, 2008).

In some embodiments, the IL-10 receptor agonist is a cell (e.g., a *Clostridium butyricum* cell) that induces IL-10 production and secretion by a different cell (e.g., a macrophage) (e.g., Hayashi et al., *Cell Host Microbe* 13:711-722, 2013). In some embodiments, the IL-10 receptor agonist is a recombinant bacterial cell (e.g., a *Lactobacillus acidophilus* cell) that is deficient in lipoteichoic acid and induces IL-10 production and secretion by a different cell (e.g., a dendritic cell) (e.g., Mohamadzadch et al., *Proc. Natl. Acad. Sci. U.S.A.* 108 (suppl 1): 4623-4630, 2011; Konstantinov et al., *Proc. Natl. Acad. Sci. U.S.A.* 105 (49): 19474-9, 2008). In some embodiments, the IL-10 receptor agonist is a bacterial cell or a fragment of a bacterial cell that is maintained in the supernatant that induces IL-10 secretion in a different cell (e.g., an immune cell) (e.g., a *Faecalibacterium prausnitzii* cell or a *Faecalibacterium prausnitzii* supernatant) (see, e.g., Sokol et al., *Proc. Natl. Acad. Sci. U.S.A.* 105 (43): 16731-16736, 2008).

Additional examples of other IL-10 receptor agonists are described in, e.g., U.S. Pat. No. 6,936,586; WO 96/01318; WO 91/00349; WO 13/130913; each incorporated in its entirety herein.

Integrin Inhibitors

The term "integrin inhibitor" refers to an agent which decreases the expression of one or more integrins and/or decreases the binding of an integrin ligand to one or more integrins that play a role in the recruitment, extravasation, and/or activation of a leukocyte. In some embodiments, the integrin inhibitor specifically binds to at least a portion of a ligand binding site on a target integrin. In some embodiments, the integrin inhibitor specifically binds to a target integrin at the same site as an endogenous ligand. In some embodiments, the integrin inhibitor decreases the level of expression of the target integrin in a mammalian cell. In some embodiments, the integrin inhibitor specifically binds to an integrin ligand.

Non-limiting examples of integrins that can be targeted by any of the integrin inhibitors described herein include: $\alpha 2\beta 1$ integrin, $\alpha 1\beta 1$ integrin, $\alpha 4\beta 7$ integrin, integrin $\alpha 4\beta 1$ (VLA-4), E-selectin, ICAM-1, $\alpha 5\beta 1$ integrin, $\alpha 4\beta 1$ integrin, VLA-4, $\alpha 2\beta 1$ integrin, $\alpha 5\beta 3$ integrin, $\alpha 5\beta 5$ integrin, $\alpha IIb\beta 3$ integrin, and MAdCAM-1. A non-limiting example of integrin inhibitor that can decrease the expression and/or activity of $\alpha 4\beta 7$ integrin is FTY720. A non-limiting example of an integrin inhibitor that specifically targets MAdCAM is PF-547659 (Pfizer). Non-limiting examples of an integrin inhibitor that specifically targets $\alpha 4\beta 7$ is AJM300 (Ajinomoto), etrolizumab (Genentech), and vedolizumab (Millenium/Takeda).

In some embodiments, the integrin inhibitor is an $\alpha IIb\beta 3$ integrin inhibitor. In some embodiments, the $\alpha IIb\beta 3$ integrin inhibitor is abciximab (ReoPro®, c7E3; Kononczuk et al., *Curr. Drug Targets* 16 (13): 1429-1437, 2015; Jiang et al., *Appl. Microbiol. Biotechnol.* 98 (1): 105-114, 2014), eptifibatide (Integrilin®; Scarborough et al., *J. Biol. Chem.* 268: 1066-1073, 1993; Tcheng et al., *Circulation* 91:2151-2157, 1995) or tirofiban (Aggrastat®; Hartman et al., *J. Med. Chem.* 35:4640-4642, 1992; Pierro et al., *Eur. J. Ophthalmol.* 26 (4): e74-76, 2016; Guan et al., *Eur. J. Pharmacol* 761:144-152, 2015). In some embodiments, the integrin inhibitor is an $\alpha L$-selective integrin inhibitor. In some embodiments, the integrin inhibitor is a $\beta 2$ integrin inhibitor.

In some embodiments, the integrin inhibitor is an $\alpha 4$ integrin (e.g., an $\alpha 4\beta 1$ integrin (e.g., Very Late Antigen-4 (VLA-4), CD49d, or CD29)) inhibitor, an $\alpha 4\beta 7$ integrin inhibitor. In some embodiments, the integrin inhibitor targets endothelial VCAM1, fibronectin, mucosal addressin cellular adhesion molecule-1 (MAdCAM-1), vitronectin, tenascin-C, osteopontin (OPN), nephronectin, agiostatin, tissue-type transglutaminase, factor XIII, Von Willebrand factor (VWF), an ADAM protein, an ICAM protein, collagen, e-cadherin, laminin, fibulin-5, or TGFβ. In some embodiments, the $\alpha 4$ integrin inhibitor is natalizumab (Tysabri®; Targan et al., *Gastroenterology* 132 (5): 1672-1683, 2007; Sandborn et al., *N. Engl. J. Med.* 353 (18): 1912-1925, 2005*; Nakamura et al., Intern. Med.* 56 (2): 211-214, 2017; and Singh et al., *J. Pediatr. Gastroenterol. Nutr.* 62 (6): 863-866, 2016). In some embodiments, the integrin inhibitor is an endogenous integrin inhibitor (e.g., SHARPIN (Rantala et al., *Nat. Cell. Biol.* 13 (11): 1315-1324, 2011).

In some embodiments, the integrin inhibitor is an $\alpha v$ integrin (e.g., an $\alpha 5\beta 1$ integrin, an $\alpha 5\beta 3$ integrin, an $\alpha 5\beta 5$ integrin inhibitor, and/or an $\alpha 5\beta 6$ integrin) inhibitor.

In some embodiments, the integrin inhibitor is an $\alpha 5\beta 1$ integrin inhibitor.

In some embodiments, an integrin inhibitor is an inhibitory nucleic acid, an antibody or antigen-binding fragment thereof, a fusion protein, an integrin antagonist, a cyclic peptide, a disintegrin, a peptidomimetic, or a small molecule. In some embodiments, the inhibitory nucleic acid is a small hairpin RNA, a small interfering RNA, an antisense, an aptamer, or a microRNA.

Inhibitory Nucleic Acids

As described herein, inhibitory nucleic acids specifically bind (e.g., hybridize) to a nucleic acid encoding an integrin or an integrin ligand to treat inflammatory diseases (e.g., chronic inflammation, irritable bowel syndrome (IBS), rheumatoid arthritis, ulcerative colitis, Crohn's Disease, or autoinflammatory disease). In some embodiments, the inhibitory nucleic acid can be an antisense nucleic acid, a ribozyme, a small interfering RNA, a small hairpin RNA, or a microRNA. Examples of aspects of these different inhibitory nucleic acids are described below. Any of the examples of inhibitory nucleic acids that can decrease expression of a target integrin or a target integrin ligand (e.g., any of the exemplary target integrins or any of the exemplary integrin ligands described herein) in a mammalian cell can be synthesized in vitro.

Inhibitory nucleic acids that can decrease the expression of target integrin mRNA or a target integrin ligand mRNA (e.g., any of the exemplary integrins described herein or any of the exemplary integrin ligands described herein) in a mammalian cell include antisense nucleic acid molecules, i.e., nucleic acid molecules whose nucleotide sequence is complementary to all or part of target integrin mRNA or a target integrin ligand mRNA (e.g., complementary to all or a part of any one of SEQ ID NOs: 155-181).

Integrin α2 (ITGA) (NCBI Ref.: NM_002203.3)

(SEQ ID NO: 155)

```
   1 ttttccctgc tctcaccggg cggggagag aagccctctg acagcttct agagtgtgca
  61 ggttctcgta tccctcggcc aagggtatcc tctgcaaacc tctgcaaacc cagcgcaact
 121 acggtccccc ggtcagaccc aggatggggc cagaacggac aggggccgcg ccgctgccgc
 181 tgctgctggt gttagcgctc agtcaaggca ttttaaattg ttgtttggcc tacaatgttg
 241 gtctcccaga agcaaaaata ttttccggtc cttcaagtga acagtttggc tatgcagtgc
 301 agcagtttat aaatccaaaa ggcaactggt tactggttgg ttcaccctgg agtggctttc
 361 ctgagaaccg aatgggagat gtgtataaat gtcctgttga cctatccact gccacatgtg
 421 aaaaactaaa tttgcaaact tcaacaagca ttccaaatgt tactgagatg aaaaccaaca
 481 tgagcctcgg cttgatcctc accaggaaca tgggaactgg aggttttctc acatgtggtc
 541 ctctgtgggc acagcaatgt gggaatcagt attacacaac gggtgtgtgt tctgacatca
 601 gtcctgattt tcagctctca gccagcttct cacctgcaac tcagccctgc ccttccctca
 661 tagatgttgt ggttgtgtgt gatgaatcaa atagtattta tccttgggat gcagtaaaga
 721 atttttgga aaaatttgta caaggcctgg atataggccc cacaaagaca caggtggggt
 781 taattcagta tgccaataat ccaagagttg tgtttaactt gaacacatat aaaaccaaag
 841 aagaaatgat tgtagcaaca tcccagacat cccaatatgg tgggaccctc acaaacacat
 901 tcggagcaat tcaatatgca agaaaatatg cttattcagc agcttctggt gggcgacgaa
 961 gtgctacgaa agtaatggta gttgtaactg acggtgaatc acatgatggt tcaatgttga
1021 aagctgtgat tgatcaatgc aaccatgaca atatactgag gtttggcata gcagttcttg
1081 ggtacttaaa cagaaacgcc cttgatacta aaaatttaat aaaagaaata aaagcaatcg
1141 ctagtattcc aacagaaaga tactttttca atgtgtctga tgaagcagct ctactagaaa
1201 aggctgggac attaggagaa caaattttca gcattgaagg tactgttcaa ggaggagaca
1261 actttcagat ggaaatgtca caagtgggat tcagtgcaga ttactcttct caaaatgata
1321 ttctgatgct gggtgcagtg ggagcttttg gctggagtgg gaccattgtc agaagacat
1381 ctcatggcca tttgatcttt cctaaacaag ccttttgacca aattctgcag acagaaatc
1441 acagttcata tttaggttac tctgtggctg caatttctac tggagaaagc actcactttg
1501 ttgctggtgc tcctcgggca aattataccg gccagatagt gctatatagt gtgaatgaga
1561 atggcaatat cacggttatt caggctcacc gaggtgacca gattggctcc tattttggta
1621 gtgtgctgtg ttcagttgat gtggataaag acaccattac agacgtgctc ttggtaggtg
1681 caccaatgta catgagtgac ctaaagaaag aggaaggaag agtctacctg tttactatca
1741 aagagggcat tttgggtcag caccaatttc ttgaaggccc cgagggcatt gaaaacactc
1801 gatttggttc agcaattgca gctctttcag acatcaacat ggatggcttt aatgatgtga
1861 ttgttggttc accactagaa aatcagaatt ctggagctgt atacatttac aatggtcatc
1921 agggcactat ccgcacaaag tattcccaga aaatcttggg atccgatgga gcctttagga
1981 gccatctcca gtactttggg aggtcctgg atggctatgg agatttaaat ggggattcca
2041 tcaccgatgt gtctattggt gcctttggac aagtggttca actctggtca caaagtattg
2101 ctgatgtagc tatagaagct tcattcacac cagaaaaaat cactttggtc aacaagaatg
2161 ctcagataat tctcaaactc tgcttcagtg caaagttcag acctactaag caaaacaatc
2221 aagtggccat tgtatataac atcacacttg atgcagatgg attttcatcc agagtaacct
2281 ccagggggt atttaaagaa aacaatgaaa ggtgcctgca aagaatatg gtagtaaatc
2341 aagcacagag ttgccccgag cacatcattt atatacagga gccctctgat gttgtcaact
```

-continued

```
2401 ctttggattt gcgtgtggac atcagtctgg aaaaccctgg cactagccct gcccttgaag 2461 cctattctga gactgccaag gtcttcagta ttcctttcca caaagactgt ggtgaggacg 2521 gactttgcat ttctgatcta gtcctagatg tccgacaaat accagctgct caagaacaac 2581 cctttattgt cagcaaccaa aacaaaaggt taacattttc agtaacgctg aaaaataaaa 2641 gggaaagtgc atacaacact ggaattgttg ttgattttc agaaaacttg ttttttgcat 2701 cattctccct gccggttgat gggacagaag taacatgcca ggtggctgca tctcagaagt 2761 ctgttgcctg cgatgtaggc taccctgctt taaagagaga acaacaggtg acttttacta 2821 ttaactttga cttcaatctt caaaaccttc agaatcaggc gtctctcagt ttccaagcct 2881 taagtgaaag ccaagaagaa acaaggctg ataatttggt caacctcaaa attcctctcc 2941 tgtatgatgc tgaaattcac ttaacaagat ctaccaacat aaattttat gaaatctctt 3001 cggatgggaa tgttccttca atcgtgcaca gttttgaaga tgttggtcca aaattcatct 3061 tctccctgaa ggtaacaaca ggaagtgttc cagtaagcat ggcaactgta atcatccaca 3121 tccctcagta taccaaagaa aagaacccac tgatgtacct aactggggtg caaacagaca 3181 aggctggtga catcagttgt aatgcagata tcaatccact gaaaatagga caaacatctt 3241 cttctgtatc tttcaaaagt gaaaatttca ggcacaccaa agaattgaac tgcagaactg 3301 cttcctgtag taatgttacc tgctggttga aagacgttca catgaaagga gaatactttg 3361 ttaatgtgac taccagaatt tggaacggga ctttcgcatc atcaacgttc cagacagtac 3421 agctaacggc agctgcagaa atcaacacct ataaccctga gatatatgtg attgaagata 3481 acactgttac gattcccctg atgataatga aacctgatga gaaagccgaa gtaccaacag 3541 gagttataat aggaagtata attgctggaa tccttttgct gttagctctg gttgcaattt 3601 tatggaagct cggcttcttc aaaagaaaat atgaaaagat gaccaaaaat ccagatgaga 3661 ttgatgagac cacagagctc agtagctgaa ccagcagacc tacctgcagt gggaaccggc 3721 agcatcccag ccagggtttg ctgtttgcgt gaatggattt cttttaaat cccatatttt 3781 ttttatcatg tcgtaggtaa actaacctgg tattttaaga gaaaactgca ggtcagtttg 3841 gaatgaagaa attgtggggg gtgggggagg tgcgggggc aggtagggaa ataataggga 3901 aaatacctat tttatatgat gggggaaaaa aagtaatctt taaactggct ggcccagagt 3961 ttacattcta atttgcattg tgtcagaaac atgaaatgct tccaagcatg acaactttta 4021 aagaaaaata tgatactctc agattttaag ggggaaaact gttctcttta aaatatttgt 4081 ctttaaacag caactacaga agtggaagtg cttgatatgt aagtacttcc acttgtgtat 4141 atttaatga atattgatgt taacaagagg ggaaaacaaa acacaggttt tttcaattta 4201 tgctgctcat ccaaagttgc cacagatgat acttccaagt gataatttta tttataaact 4261 aggtaaaatt tgttgttggt tccttttaga ccacggctgc cccttccaca ccccatcttg 4321 ctctaatgat caaaacatgc ttgaataact gagcttagag tatacctcct atatgtccat 4381 ttaagttagg agaggggcg atatagagaa taaggcacaa aattttgttt aaaactcaga 4441 atataacatg taaaatccca tctgctagaa gcccatcctg tgccagagga aggaaaagga 4501 ggaaatttcc tttctctttt aggaggcaca acagttctct tctaggattt gtttggctga 4561 ctggcagtaa cctagtgaat ttctgaaaga tgagtaattt cttggcaac cttcctcctc 4621 ccttactgaa ccactctccc acctcctggt ggtaccatta ttatagaagc cctctacagc 4681 ctgactttct ctccagcggt ccaaagttat cccctccttt acccctcatc caaagttccc 4741 actccttcag gacagctgct gtgcattaga tattagggg gaaagtcatc tgtttaattt
```

-continued

```
4801 acacacttgc atgaattact gtatataaac tccttaactt cagggagcta ttttcattta
4861 gtgctaaaca agtaagaaaa ataagctcga gtgaatttct aaatgttgga atgttatggg
4921 atgtaaacaa tgtaaagtaa gacatctcag gatttcacca gaagttacag atgaggcact
4981 ggaagccacc aaattagcag gtgcaccttc tgtggctgtc ttgtttctga agtacttaaa
5041 cttccacaag agtgaatttg acctaggcaa gtttgttcaa aaggtagatc ctgagatgat
5101 ttggtcagat tgggataagg cccagcaatc tgcattttaa caagcacccc agtcactagg
5161 atgcagatgg accacacttt gagaaacacc acccatttct acttttttgca ccttatttc
5221 tctgttcctg agcccccaca ttctctagga gaaacttaga ggaaaagggc acagacacta
5281 catatctaaa gctttggaca agtccttgac ctctataaac ttcagagtcc tcattataaa
5341 atgggaagac tgagctggag ttcagcagtg atgcttttag ttttaaaagt ctatgatctg
5401 gacttcctat aatacaaata cacaatcctc caagaatttg acttggaaaa aaatgtcaaa
5461 ggaaaacagg ttatctgccc atgtgcatat ggacaacctt gactaccctg gcctggcccg
5521 tggtggcagt ccagggctat ctgtactgtt tacagaatta ctttgtagtt gacaacacaa
5581 aacaaacaaa aaaggcataa aatgccagcg gtttatagaa aaaacagcat ggtattctcc
5641 agttaggtat gccagagtcc aattcttta acagctgtga gaatttgctg cttcattcca
5701 acaaaatttt atttaaaaaa aaaaaaaaa gactggagaa actagtcatt agcttgataa
5761 agaatattta acagctagtg gtgctggtgt gtacctgaag ctccagctac ttgagagact
5821 gagacaggaa gatcgcttga gcccaggagt tcaagtccag cctaagcaac atagcaagac
5881 cctgtctcaa aaaatgact atttaaaaag acaatgtggc caggcacggt ggctcacacc
5941 tgtaatccca cactttggg aggctgaggc cggtggatca cgaggtcagg agtttgagac
6001 tagcctggcc aacatggtga acccccatct ctaataatat aaaaattagc tgggcgtagt
6061 agcaggtgcc tgtaatccca gttactcggg aagctgaggc aggagaatca cttgaacccg
6121 ggaggcagag gtttcagtga gccgagatcg cgccactgca ctccagcctg ggtgacaggg
6181 caagactctg tctcaaacaa acaaacaaaa aaaagttag tactgtatat gtaaatacta
6241 gcttttcaat gtgctataca aacaattata gcacatcctt ccttttactc tgtctcacct
6301 cctttaggtg agtacttcct taaataagtg ctaaacatac atatacggaa cttgaaagct
6361 ttggttagcc ttgccttagg taatcagcct agtttacact gtttccaggg agtagttgaa
6421 ttactataaa ccattagcca cttgtctctg caccatttat cacaccagga cagggtctct
6481 caacctgggc gctactgtca tttggggcca ggtgattctt ccttgcaggg gctgtcctgt
6541 accttgtagg acagcagccc tgtcctagaa ggtatgttta gcagcattcc tggcctctag
6601 ctacccgatg ccagagcatg ctcccccgc agtcatgaca atcaaaaaat gtctccagac
6661 attgtcaaat gcctcctggg gggcagtatt tctcaagcac ttttaagcaa aggtaagtat
6721 tcatacaaga aatttagggg gaaaaaacat tgtttaaata aaagctatgt gttcctattc
6781 aacaatattt ttgctttaaa agtaagtaga gggcataaaa gatgtcatat tcaaatttcc
6841 atttcataaa tggtgtacag acaaggtcta tagaatgtgg taaaaacttg actgcaacac
6901 aaggcttata aaatagtaag atagtaaaat agcttatgaa gaaactacag agatttaaaa
6961 ttgtgcatga ctcatttcag cagcaaaata agaactccta actgaacaga aattttttcta
7021 cctagcaatg ttattcttgt aaaatagtta cctattaaaa ctgtgaagag taaaactaaa
7081 gccaatttat tatagtcaca caagtgatta tactaaaaat tattataaag gttataattt
7141 tataatgtat ttacctgtcc tgatatatag ctataaccca atatatgaaa atctcaaaaa
7201 ttaagacatc atcatacaga aggcaggatt ccttaaactg agatccctga tccatcttta
```

-continued

```
7261 atatttcaat ttgcacacat aaaacaatgc cctttttgtgt acattcaggc atacccattt 7321 taatcaattt gaaaggttaa tttaaacctc tagaggtgaa tgagaaacat ggggggaaaag 7381 tatgaaatag gtgaaaatct taactatttc tttgaactct aaagactgaa actgtagcca 7441 ttatgtaaat aaagtttcat atgtacctgt ttattttggc agattaagtc aaaatatgaa 7501 tgtatatatt gcataactat gttagaattg tatatatttt aaagaaattg tcttggatat 7561 tttcctttat acataataga taagtctttt ttcaaatgtg gtgtttgatg ttttttgatta 7621 aatgtgtttt gcctctttcc acaaaaactg taaaaataaa tgcatgtttg tacaaaaagt 7681 tgcagaattc atttgattta tgagaaacaa aaattaaatt gtagtcaaca gttagtagtt 7741 tttctcatat ccaagtataa caaacagaaa agtttcatta ttgtaaccca cttttttcat 7801 accacattat tgaatattgt tacaattgtt ttgaaaataa agccattttc tttgggcttt 7861 tataagttaa aaaaaaaa
```

Integrin αIIb (α2b)

(NCBI Ref.: NM_000419.4; SEQ ID NO: 156)

```
   1 gctctgcccg ttgctcagca agttacttgg ggttccagtt tgataagaaa agacttcctg 61 tggaggaatc tgaagggaag gaggaggagc tggcccattc ctgcctggga ggttgtggaa 121 gaaggaagat ggccagagct ttgtgtccac tgcaagccct ctggcttctg gagtgggtgc 181 tgctgctctt gggaccttgt gctgcccctc cagcctgggc cttgaacctg acccagtgc 241 agctcacctt ctatgcaggc cccaatggca gccagtttgg attttcactg gacttccaca 301 aggacagcca tggagagtg gccatcgtgg tgggcgcccc gcggaccctg ggccccagcc 361 aggaggagac gggcggcgtg ttcctgtgcc cctggagggc cgagggcggc cagtgcccct 421 cgctgctctt tgacctccgt gatgagaccc gaaatgtagg ctcccaaact ttacaaacct 481 tcaaggcccg ccaaggactg ggggcgtcgg tcgtcagctg gagcgacgtc attgtggcct 541 gcgcccctg gcagcactgg aacgtcctag aaaagactga ggaggctgag aagacgcccg 601 taggtagctg cttttttggct cagccagaga gcggccgccg cgccgagtac tcccctgtc 661 gcgggaacac cctgagccgc atttacgtgg aaaatgattt tagctgggac aagcgttact 721 gtgaagcggg cttcagctcc gtggtcactc aggccggaga gctggtgctt ggggctcctg 781 gcggctatta tttcttaggt ctcctggccc aggctccagt tgcggatatt ttctcgagtt 841 accgcccagg catccttttg tggcacgtgt cctcccagag cctctccttt gactccagca 901 acccagagta cttcgacggc tactgggggt actcggtggc cgtgggcgag ttcgacgggg 961 atctcaacac tacagaatat gtcgtcggtg cccccacttg gagctggacc ctgggagcgg 1021 tggaaatttt ggattcctac taccagaggc tgcatcggct gcgcggagag cagatggcgt 1081 cgtatttttgg gcattcagtg gctgtcactg acgtcaacgg ggatgggagg catgatctgc 1141 tggtgggcgc tccactgtat atggagagcc gggcagaccg aaaactggcc gaagtggggc 1201 gtgtgtattt gttcctgcag ccgcgaggcc ccacgcgct gggtgccccc agcctcctgc 1261 tgactggcac acagctctat gggcgattcg gctctgccat cgcacccctg ggcgacctcg 1321 accgggatgg ctacaatgac attgcagtgg ctgcccccta cggggtccc agtgccgggg 1381 gccaagtgct ggtgttcctg ggtcagagtg aggggctgag gtcacgtccc tcccaggtcc 1441 tggacagccc cttccccaca ggctctgcct ttgggttctc ccttcgaggt gccgtagaca 1501 tcgatgacaa cggatacccca gacctgatcg tgggagctta cggggccaac caggtggctg 1561 tgtacagagc tcagccagtg gtgaaggcct ctgtccagct actggtgcaa gattcactga 1621 atcctgctgt gaagagctgt gtcctacctc agaccaagac acccgtgagc tgcttcaaca
```

-continued

```
1681 tccagatgtg tgttggagcc actgggcaca acattcctca gaagctatcc ctaaatgccg 1741 agctgcagct ggaccggcag aagccccgcc agggccggcg ggtgctgctg ctgggctctc 1801 aacaggcagg caccaccctg aacctggatc tgggcggaaa gcacagcccc atctgccaca 1861 ccaccatggc cttccttcga gatgaggcag acttccggga caagctgagc ccattgtgc 1921 tcagcctcaa tgtgtcccta ccgcccacgg aggctggaat ggcccctgct gtcgtgctgc 1981 atggagacac ccatgtgcag gagcagacac gaatcgtcct ggactgtggg gaagatgacg 2041 tatgtgtgcc ccagcttcag ctcactgcca gcgtgacggg ctccccgctc ctagttgggg 2101 cagataatgt cctggagctg cagatggacg cagccaacga gggcgagggg gcctatgaag 2161 cagagctggc cgtgcacctg ccccagggcg cccactacat gcgggcccta agcaatgtcg 2221 agggctttga gagactcatc tgtaatcaga agaaggagaa tgagaccagg gtggtgctgt 2281 gtgagctggg caacccatg aagaagaacg cccagatagg aatcgcgatg ttggtgagcg 2341 tggggaatct ggaagaggct ggggagtctg tgtccttcca gctgcagata cggagcaaga 2401 acagccagaa tccaaacagc aagattgtgc tgctggacgt gccggtccgg gcagaggccc 2461 aagtggagct gcgagggaac tcctttccag cctccctggt ggtggcagca gaagaaggtg 2521 agagggagca gaacagcttg gacagctggg gacccaaagt ggagcacacc tatgagctcc 2581 acaacaatgg ccctgggact gtgaatggtc ttcacctcag catccacctt ccgggacagt 2641 cccagccctc cgacctgctc tacatcctgg atatacagcc caggggggc cttcagtgct 2701 tcccacagcc tcctgtcaac cctctcaagg tggactgggg gctgcccatc cccagcccct 2761 cccccattca cccggcccat cacaagcggg atcgcagaca gatcttcctg ccagagcccg 2821 agcagccctc gaggcttcag gatccagttc tcgtaagctg cgactcggcg ccctgtactg 2881 tggtgcagtg tgacctgcag gagatggcgc gcgggcagcg ggccatggtc acggtgctgg 2941 ccttcctgtg gctgcccagc ctctaccaga ggcctctgga tcagtttgtg ctgcagtcgc 3001 acgcatggtt caacgtgtcc tccctcccct atgcggtgcc ccgctcagc ctgccccgag 3061 gggaagctca ggtgtggaca cagctgctcc gggccttgga ggagagggcc attccaatct 3121 ggtgggtgct ggtgggtgtg ctgggtggcc tgctgctgct caccatcctg gtcctggcca 3181 tgtggaaggt cggcttcttc aagcggaacc ggccacccct ggaagaagat gatgaagagg 3241 gggagtgatg gtgcagccta cactattcta gcaggagggt tgggcgtgct acctgcaccg 3301 cccttctcc aacaagttgc ctccaagctt tgggttggag ctgttccatt gggtcctctt 3361 ggtgtcgttt cctcccaac agagctgggc tacccccct cctgctgcct aataaagaga 3421 ctgagccctg aaaaaaaaaa aaaaaaaa
```

Integrin α4 (VLA-4)
(NCBI Ref.: NM_000885.5; SEQ ID NO: 157)

```
  1 ataacgtctt tgtcactaaa atgttcccca ggggccttcg gcgagtcttt ttgtttggtt 61 ttttgttttt aatctgtggc tcttgataat ttatctagtg gttgcctaca cctgaaaaac 121 aagacacagt gtttaactat caacgaaaga actggacggc tccccgccgc agtcccactc 181 cccgagtttg tggctggcat ttgggccacg ccgggctggg cggtcacagc gaggggcgcg 241 cagtttgggg tcacacagct ccgcttctag gccccaacca ccgttaaaag gggaagcccg 301 tgccccatca ggtccgctct tgctgagccc agagccatcc cgcgctctgc ggctgggag 361 gcccgggcca ggacgcgagt cctgcgcagc cgaggttccc cagcgccccc tgcagccgcg 421 cgtaggcaga acggagccc ggccctgcgc ctccgcacca cgcccgggac cccacccagc 481 ggcccgtacc cggagaagca gcgcgagcac ccgaagctcc cggctggcgg cagaaaccgg 541 gagtggggcc gggcgagtgc gcggcatccc aggccggccc gaacgctccg cccgcggtgg
```

-continued

```
 601 gccgacttcc cctcctcttc cctctctcct tcctttagcc cgctggcgcc ggacacgctg
 661 cgcctcatct cttggggcgt tcttccccgt tggccaaccg tcgcatcccg tgcaactttg
 721 gggtagtggc cgtttagtgt tgaatgttcc ccaccgagag cgcatggctt gggaagcgag
 781 gcgcgaaccc ggcccccgaa gggccgccgt ccgggagacg tgatgctgt tgctgtgcct
 841 gggggtcccg accggccgcc cctacaacgt ggacactgag agcgcgctgc tttaccaggg
 901 cccccacaac acgctgttcg gctactcggt cgtgctgcac agccacgggg cgaaccgatg
 961 gctcctagtg ggtgcgccca ctgccaactg gctcgccaac gcttcagtga tcaatcccgg
1021 ggcgatttac agatgcagga tcggaaagaa tcccggccag acgtgcgaac agctccagct
1081 gggtagccct aatggagaac cttgtggaaa gacttgtttg gaagagagag acaatcagtg
1141 gttggggtc acactttcca gacagccagg agaaaatgga tccatcgtga cttgtgggca
1201 tagatggaaa aatatatttt acataaagaa tgaaataag ctccccactg gtggttgcta
1261 tggagtgccc cctgatttac gaacagaact gagtaaaaga atagctccgt gttatcaaga
1321 ttatgtgaaa aaatttggag aaaattttgc atcatgtcaa gctggaatat ccagttttta
1381 cacaaaggat ttaattgtga tgggggcccc aggatcatct tactgactg gctctcttt
1441 tgtctacaat ataactacaa ataaatacaa ggctttttta gacaaacaaa atcaagtaaa
1501 atttggaagt tatttaggat attcagtcgg agctggtcat tttcggagcc agcatactac
1561 cgaagtagtc ggaggagctc ctcaacatga gcagattggt aaggcatata tattcagcat
1621 tgatgaaaaa gaactaaata tcttacatga aatgaaaggt aaaagcttg gatcgtactt
1681 tggagcttct gtctgtgctg tggacctcaa tgcagatggc ttctcagatc tgctcgtggg
1741 agcacccatg cagagcacca tcagagagga aggaagagtg tttgtgtaca tcaactctgg
1801 ctcgggagca gtaatgaatg caatggaaac aaacctcgtt ggaagtgaca aatatgctgc
1861 aagatttggg gaatctatag ttaatcttgg cgacattgac aatgatggct ttgaagatgt
1921 tgctatcgga gctccacaag aagatgactt gcaaggtgct atttatattt acaatggccg
1981 tgcagatggg atctcgtcaa ccttctcaca gagaattgaa ggacttcaga tcagcaaatc
2041 gttaagtatg tttggacagt ctatatcagg acaaattgat gcagataata atggctatgt
2101 agatgtagca gttggtgctt ttcggtctga ttctgctgtc ttgctaagga caagacctgt
2161 agtaattgtt gacgcttctt taagccaccc tgagtcagta aatagaacga aatttgactg
2221 tgttgaaaat ggatggcctt ctgtgtgcat agatctaaca ctttgtttct catataaggg
2281 caaggaagtt ccaggttaca ttgttttgtt ttataacatg agtttggatg tgaacagaaa
2341 ggcagagtct ccaccaagat tctatttctc ttctaatgga acttctgacg tgattacagg
2401 aagcatacag gtgtccagca gagaagctaa ctgtagaaca catcaagcat ttatgcggaa
2461 agatgtgcgg gacatcctca ccccaattca gattgaagct gcttaccacc ttggtcctca
2521 tgtcatcagt aaacgaagta cagaggaatt cccaccactt cagccaattc ttcagcagaa
2581 gaaagaaaaa gacataatga aaaaaacaat aaactttgca aggttttgtg cccatgaaaa
2641 ttgttctgct gatttacagg tttctgcaaa gattgggttt ttgaagcccc atgaaaataa
2701 aacatatctt gctgttggga gtatgaagac attgatgttg aatgtgtcct tgtttaatgc
2761 tggagatgat gcatatgaaa cgactctaca tgtcaaacta cccgtgggtc tttatttcat
2821 taagatttta gagctggaag agaagcaaat aaactgtgaa gtcacagata actctggcgt
2881 ggtacaactt gactgcagta ttggctatat atatgtagat catctctcaa ggatagatat
2941 tagctttctc ctggatgtga gctcactcag cagagcggaa gaggacctca gtatcacagt
```

```
3001 gcatgctacc tgtgaaaatg aagaggaaat ggacaatcta aagcacagca gagtgactgt 3061 agcaatacct ttaaaatatg aggttaagct gactgttcat gggtttgtaa acccaacttc 3121 atttgtgtat ggatcaaatg atgaaaatga gcctgaaacg tgcatggtgg agaaaatgaa 3181 cttaactttc catgttatca acactggcaa tagtatggct cccaatgtta gtgtggaaat 3241 aatggtacca aattctttta gcccccaaac tgataagctg ttcaacattt tggatgtcca 3301 gactactact ggagaatgcc actttgaaaa ttatcaaaga gtgtgtgcat tagagcagca 3361 aaagagtgca atgcagacct gaaaggcat agtccggttc ttgtccaaga ctgataagag 3421 gctattgtac tgcataaaag ctgatccaca ttgtttaaat ttcttgtgta attttgggaa 3481 aatggaaagt ggaaaagaag ccagtgttca tatccaactg gaaggccggc catccatttt 3541 agaaatggat gagacttcag cactcaagtt tgaaataaga gcaacaggtt ttccagagcc 3601 aaatccaaga gtaattgaac taaacaagga tgagaatgtt gcgcatgttc tactggaagg 3661 actacatcat caaagaccca aacgttattt caccatagtg attatttcaa gtagcttgct 3721 acttggactt attgtacttc tgttgatctc atatgttatg tggaaggctg gcttctttaa 3781 aagacaatac aaatctatcc tacaagaaga aaacagaaga gacagttgga gttatatcaa 3841 cagtaaaagc aatgatgatt aaggacttct ttcaaattga gagaatggaa aacagactca 3901 ggttgtagta aagaaattta aaagacactg tttacaagaa aaaatgaatt tgtttggac 3961 ttcttttact catgatcttg tgacatatta tgtcttcatg caaggggaaa atctcagcaa 4021 tgattactct ttgagataga agaactgcaa aggtaataat acagccaaag ataatctctc 4081 agcttttaaa tgggtagaga acactaaag cattcaattt attcaagaaa gtaagccct 4141 tgaagatatc ttgaaatgaa agtataactg agttaaatta tactggagaa gtcttagact 4201 tgaaatacta cttaccatat gtgcttgcct cagtaaaatg aaccccactg ggtgggcaga 4261 ggttcatttc aaatacatct ttgatacttg ttcaaaatat gttctttaaa aatataatt 4321 tttagagagc tgttcccaaa ttttctaacg agtggaccat tatcactta aagcccttta 4381 tttataatac atttcctacg ggctgtgttc caacaaccat tttttttcag cagactatga 4441 atattatagt attataggcc aaactggcaa acttcagact gaacatgtac actggtttga 4501 gcttagtgaa attacttctg gataattatt tttttataat tatggatttc accatctttc 4561 tttctgtata tacatgtg tttttatgta ggtatatatt taccattctt cctatctatt 4621 cttcctataa cacaccttta tcaagcatac ccaggagtaa tcttcaaatc ttttgttata 4681 ttctgaaaca aaagattgtg agtgttgcac tttacctgat acacgctgat ttagaaaata 4741 cagaaaccat acctcactaa taactttaaa atcaaagctg tgcaaagact agggggccta 4801 tacttcatat gtattatgta ctatgtaaaa tattgactat cacacaacta tttccttgga 4861 tgtaattctt tgttacccct tacaagtata agtgttacct tacatggaaa cgaagaaaca 4921 aaattcataa atttaaattc ataaatttag ctgaaagata ctgattcaat ttgtatacag 4981 tgaatataaa tgagacgaca gcaaaatttt catgaaatgt aaaatatttt tatagtttgt 5041 tcatactata tgaggttcta ttttaaatga ctttctggat tttaaaaaat ttctttaaat 5101 acaatcattt ttgtaatatt tattttatgc ttatgatcta gataattgca gaatatcatt 5161 ttatctgact ctgccttcat aagagagctg tggccgaatt ttgaacatct gttataggga 5221 gtgatcaaat tagaaggcaa tgtggaaaaa caattctggg aaagatttct ttatatgaag 5281 tccctgccac tagccagcca tcctaattga tgaaagttat ctgttcacag gcctgcagtg 5341 atggtgagga atgttctgag atttgcgaag gcatttgagt agtgaaatgt aagcacaaaa 5401 cctcctgaac ccagagtgtg tatacacagg aataaacttt atgacattta tgtattttta
```

-continued

```
5461 aaaaactttg tatcgttata aaaaggctag tcattctttc aggagaacat ctaggatcat 5521 agatgaaaaa tcaagccccg atttagaact gtcttctcca ggatggtctc taaggaaatt 5581 tacatttggt tctttcctac tcagaactac tcagaaacaa ctatatattt caggttatct 5641 gagcacagtg aaagcagagt actatggttg tccaacacag gcctctcaga tacaagggga 5701 acacaattac atattgggct agattttgcc cagttcaaaa tagtatttgt tatcaactta 5761 ctttgttact tgtatcatga attttaaaac cctaccactt taagaagaca gggatgggtt 5821 attcttttt ggcaggtagg ctatataact atgtgatttt gaaatttaac tgctctggat 5881 tagggagcag tgaatcaagg cagacttatg aaatctgtat tatatttgta acagaatata 5941 ggaaatttaa cataattgat gagctcaaat cctgaaaaat gaaagaatcc aaattatttc 6001 agaattatct aggttaaata ttgatgtatt atgatggttg caaagttttt ttgtgtgtcc 6061 aataaacaca ttgtaaaaaa aagaatttga attgatatct aaaaacagaa tttgaattga 6121 tatttcatct tgactttaa agccctagag gctaattgtt agtaacatca atttctatta 6181 ggatatccgt ttggccacac agcaggaggt tagagcaatg gagcattact gagttcctcc 6241 ccctgtcaga tcagcagcag cattagattc tcatagaagt gcgaaccata tggtgaactg 6301 gtatgtgagg gatctagagt gccatgttcc tcaagagaat ctaatgcctg atgatctgag 6361 gtggaacagt tcatcctgaa accattcccc catccacgga aaaattgtct tccatgaaac 6421 tggtcccaaa aagggtgggg accacaggtt taaagcatgg ccacatttct ttatattaaa 6481 attctagttt gtacatttct tttagaaaca attacatgtt actttggaat catttcttcc 6541 atgcttcctc cataaagact gataagtctt ggatgcaatc tgtaaagaaa atacattatt 6601 tcatcaactt attttgttgt ttttcacata cacctaataa gtatggtaca caatgccaat 6661 gccaaataca aattgataac aaacacagca ttcccaacag agctgtaatc tagaaaactg 6721 agaaggtctg attgataaat catcaacaac aataattgct ctaaaccctc cttaactgac 6781 ttccttgatt gtccaatgct ctccattacc tctgtaaaac agtcagttat gcctctagaa 6841 cacccatgtc tagtgggcac ccctgcatgc ttcttctaac cactgagtgt cacaatgcct 6901 accaagaatg cgtttgcagg ttcctaaacc tgtttatacc agttgctatg taaaattgtt 6961 cccaagggaa gttgaatgct ctgtaaaggc ctaataaaag caaattactg aacaaaacat 7021 gttacagtaa ttatgagtga gaggaaacta agatggaagg ataaaaatct aacactttac 7081 tattcagatg gctccactaa aagatttaag atcttgatcc attttaaaa atccaaaatg 7141 gaagttgtag acattatctg tagtttatgc acaacaataa attagaaagc caatgtagac 7201 acgcataacc aaagaaaatg ccttgggtct acataacagt tgaataaatg taaagttgct 7261 tttaaaaaaa aaaaaaaaa a
```

Integrin α5

(NCBI Ref.: NM_002205.4; SEQ ID NO: 158)

```
  1 attcgcctct gggaggttta ggaagcggct ccgggtcggt ggccccagga cagggaagag 61 cgggcgctat ggggagccgg acgccagagt cccctctcca cgccgtgcag ctgcgctggg 121 gcccccggcg ccgaccccg ctgctgccgc tgctgttgct gctgctgccg ccgccaccca 181 gggtcggggg cttcaactta gacgcggagg ccccagcagt actctcgggg ccccggggct 241 ccttcttcgg attctcagtg gagttttacc ggccgggaac agacggggtc agtgtgctgg 301 tgggagcacc caaggctaat accagccagc caggagtgct gcagggtggt gctgtctacc 361 tctgtccttg gggtgccagc cccacacagt gcacccccat tgaatttgac agcaaaggct 421 ctcggctcct ggagtcctca ctgtccagct cagagggaga ggagcctgtg gagtacaagt
```

-continued

```
 481 ccttgcagtg gttcggggca acagttcgag cccatggctc ctccatcttg gcatgcgctc
 541 cactgtacag ctggcgcaca gagaaggagc cactgagcga ccccgtgggc acctgctacc
 601 tctccacaga taacttcacc cgaattctgg agtatgcacc ctgccgctca gatttcagct
 661 gggcagcagg acagggttac tgccaaggag gcttcagtgc cgagttcacc aagactggcc
 721 gtgtggtttt aggtggacca ggaagctatt tctggcaagg ccagatcctg tctgccactc
 781 aggagcagat tgcagaatct tattaccccg agtacctgat caacctggtt caggggcagc
 841 tgcagactcg ccaggccagt tccatctatg atgacagcta cctaggatac tctgtggctg
 901 ttggtgaatt cagtggtgat gacacagaag actttgttgc tggtgtgccc aaagggaacc
 961 tcacttacgg ctatgtcacc atccttaatg gctcagacat tcgatccctc tacaacttct
1021 caggggaaca gatggcctcc tactttggct atgcagtggc cgccacagac gtcaatgggg
1081 acgggctgga tgacttgctg gtgggggcac ccctgctcat ggatcggacc cctgacgggc
1141 ggcctcagga ggtgggcagg gtctacgtct acctgcagca cccagccggc atagagccca
1201 cgcccaccct taccctcact ggccatgatg agtttggccg atttggcagc tccttgaccc
1261 ccctggggga cctggaccag gatggctaca atgatgtggc catcggggct cccttt ggtg
1321 gggagaccca gcagggagta gtgtttgtat ttcctggggg cccaggaggg ctgggctcta
1381 agccttccca ggttctgcag cccctgtggg cagccagcca caccccagac ttctttggct
1441 ctgcccttcg aggaggccga gacctggatg caatggata tcctgatctg attgtggggt
1501 cctttggtgt ggacaaggct gtggtataca ggggccgccc catcgtgtcc gctagtgcct
1561 ccctcaccat cttccccgcc atgttcaacc cagaggagcg gagctgcagc ttagagggga
1621 accctgtggc ctgcatcaac cttagcttct gcctcaatgc ttctggaaaa cacgttgctg
1681 actccattgg tttcacagtg gaacttcagc tggactggca gaagcagaag ggaggggtac
1741 ggcgggcact gttcctggcc tccaggcagg caaccctgac ccagaccctg ctcatccaga
1801 atggggctcg agaggattgc agagagatga agatctacct caggaacgag tcagaatttc
1861 gagacaaact ctcgccgatt cacatcgctc tcaacttctc cttggacccc caagccccag
1921 tggacagcca cggcctcagg ccagccctac attatcagag caagagccgg atagaggaca
1981 aggctcagat cttgctggac tgtggagaag acaacatctg tgtgcctgac ctgcagctgg
2041 aagtgtttgg ggagcagaac catgtgtacc tgggtgacaa gaatgccctg aacctcactt
2101 tccatgccca gaatgtgggt gagggtggcg cctatgaggc tgagcttcgg gtcaccgccc
2161 ctcagaggc tgagtactca ggactcgtca gacacccagg gaacttctcc agcctgagct
2221 gtgactactt tgccgtgaac cagagccgcc tgctggtgtg tgacctgggc aaccccatga
2281 aggcaggagc cagtctgtgg ggtggccttc ggtttacagt ccctcatctc cgggacacta
2341 agaaaaccat ccagtttgac ttccagatcc tcagcaagaa tctcaacaac tcgcaaagcg
2401 acgtggtttc ctttcggctc tccgtggagg ctcaggccca ggtcaccctg aacggtgtct
2461 ccaagcctga ggcagtgcta ttcccagtaa gcgactggca tccccgagac cagcctcaga
2521 aggaggagga cctggaccct gctgtccacc atgtctatga gctcatcaac caaggcccca
2581 gctccattag ccagggtgtg ctggaactca gctgtcccca ggctctggaa ggtcagcagc
2641 tcctatatgt gaccagagtt acgggactca actgcaccac caatcacccc attaacccaa
2701 agggcctgga gttggatccc gagggttccc tgcaccacca gcaaaaacgg gaagctccaa
2761 gccgcagctc tgcttcctcg ggacctcaga tcctgaaatg cccggaggct gagtgtttca
2821 ggctgcgctg tgagctcggg cccctgcacc aacaagagag ccaaagtctg cagttgcatt
2881 tccgagtctg ggccaagact ttcttgcagc gggagcacca gccatttagc ctgcagtgtg
```

-continued

```
2941 aggctgtgta caaagccctg aagatgccct accgaatcct gcctcggcag ctgccccaaa 3001 aagagcgtca ggtggccaca gctgtgcaat ggaccaaggc agaaggcagc tatggcgtcc 3061 cactgtggat catcatccta gccatcctgt ttggcctcct gctcctaggt ctactcatct 3121 acatcctcta caagcttgga ttcttcaaac gctccctccc atatggcacc gccatggaaa 3181 aagctcagct caagcctcca gccacctctg atgcctgagt cctcccaatt tcagactccc 3241 attcctgaag aaccagtccc cccaccctca ttctactgaa aaggaggggt ctgggtactt 3301 cttgaaggtg ctgacggcca gggagaagct cctctcccca gcccagagac atacttgaag 3361 ggccagagcc aggggggtga ggagctgggg atccctcccc ccatgcact gtgaaggacc 3421 cttgtttaca cataccctct tcatggatgg gggaactcag atccagggac agaggcccca 3481 gcctccctga agcctttgca ttttggagag tttcctgaaa caacttggaa agataactag 3541 gaaatccatt cacagttctt tgggccagac atgccacaag gacttcctgt ccagctccaa 3601 cctgcaaaga tctgtcctca gccttgccag agatccaaaa gaagccccca gctaagaacc 3661 tggaacttgg ggagttaaga cctggcagct ctggacagcc ccaccctggt gggccaacaa 3721 agaacactaa ctatgcatgg tgccccagga ccagctcagg acagatgcca cacaaggata 3781 gatgctggcc cagggcccag agcccagctc aaggggaat cagaactcaa atggggccag 3841 atccagcctg gggtctggag ttgatctgga acccagactc agacattggc acctaatcca 3901 ggcagatcca ggactatatt tgggcctgct ccagacctga tcctggaggc ccagttcacc 3961 ctgatttagg agaagccagg aatttcccag gaccctgaag gggccatgat ggcaacagat 4021 ctggaacctc agcctggcca gacacaggcc ctccctgttc cccagagaaa ggggagccca 4081 ctgtcctggg cctgcagaat ttgggttctg cctgccagct gcactgatgc tgcccctcat 4141 ctctctgccc aacccttccc tcaccttggc accagacacc caggacttat ttaaactctg 4201 ttgcaagtgc aataaatctg acccagtgcc cccactgacc agaactagaa aaaaaaaaa 4261 aaaaaaa
```

Integrin β1
(NCBI Ref.: NM_002211.3; SEQ ID NO: 159)

```
  1 atcagacgcg cagaggaggc ggggccgcgg ctggtttcct gccgggggc ggctctgggc 61 cgccgagtcc cctcctcccg cccctgagga ggaggagccg ccgccacccg ccgcgcccga 121 cacccgggag gccccgccag cccgcgggag aggcccagcg ggagtcgcgg aacagcaggc 181 ccgagcccac cgcgccgggc cccggacgcc gcgcggaaaa gatgaattta caaccaattt 241 tctggattgg actgatcagt tcagtttgct gtgtgtttgc tcaaacagat gaaaatagat 301 gtttaaaagc aaatgccaaa tcatgtggag aatgtataca agcagggcca aattgtgggt 361 ggtgcacaaa ttcaacattt ttacaggaag gaatgcctac ttctgcacga tgtgatgatt 421 tagaagcctt aaaaaagaag ggttgccctc cagatgacat agaaaatccc agaggctcca 481 aagatataaa gaaaaataaa aatgtaacca accgtagcaa aggaacagca gagaagctca 541 agccagagga tattactcag atccaaccac agcagttggt tttgcgatta agatcagggg 601 agccacagac atttacatta aaattcaaga gagctgaaga ctatcccatt gacctctact 661 accttatgga cctgtcttac tcaatgaaag acgatttgga gaatgtaaaa agtcttggaa 721 cagatctgat gaatgaaatg aggaggatta cttcggactt cagaattgga tttggctcat 781 ttgtggaaaa gactgtgatg ccttacatta gcacaacacc agctaagctc aggaaccctt 841 gcacaagtga acagaactgc accagcccat ttagctacaa aaatgtgctc agtcttacta 901 ataaaggaga agtatttaat gaacttgttg gaaaacagcg catatctgga aatttggatt
```

-continued

```
 961 ctccagaagg tggtttcgat gccatcatgc aagttgcagt tgtggatca ctgattggct
1021 ggaggaatgt tacacggctg ctggtgtttt ccacagatgc cgggtttcac tttgctggag
1081 atgggaaact tggtggcatt gttttaccaa atgatggaca atgtcacctg gaaaataata
1141 tgtacacaat gagccattat tatgattatc cttctattgc tcaccttgtc cagaaactga
1201 gtgaaaataa tattcagaca atttttgcag ttactgaaga atttcagcct gtttacaagg
1261 agctgaaaaa cttgatccct aagtcagcag taggaacatt atctgcaaat tctagcaatg
1321 taattcagtt gatcattgat gcatacaatt cccttcctc agaagtcatt ttggaaaacg
1381 gcaaattgtc agaaggcgta acaataagtt acaaatata ctgcaagaac ggggtgaatg
1441 gaacagggga aaatggaaga aaatgttcca atatttccat tggagatgag gttcaatttg
1501 aaattagcat aacttcaaat aagtgtccaa aaaaggattc tgacagcttt aaaattaggc
1561 ctctgggctt tacggaggaa gtagaggtta ttcttcagta catctgtgaa tgtgaatgcc
1621 aaagcgaagg catccctgaa agtcccaagt gtcatgaagg aaatgggaca tttgagtgtg
1681 gcgcgtgcag gtgcaatgaa gggcgtgttg gtagacattg tgaatgcagc acagatgaag
1741 ttaacagtga agacatggat gcttactgca ggaaagaaaa cagttcagaa atctgcagta
1801 acaatggaga gtgcgtctgc ggacagtgtg tttgtaggaa gagggataat acaaatgaaa
1861 tttattctgg caaattctgc gagtgtgata atttcaactg tgatagatcc aatggcttaa
1921 tttgtggagg aaatggtgtt tgcaagtgtc gtgtgtgtga gtgcaacccc aactacactg
1981 gcagtgcatg tgactgttct ttggatacta gtacttgtga agccagcaac ggacagatct
2041 gcaatggccg gggcatctgc gagtgtggtg tctgtaagtg tacagatccg aagtttcaag
2101 ggcaaacgtg tgagatgtgt cagacctgcc ttggtgtctg tgctgagcat aaagaatgtg
2161 ttcagtgcag agccttcaat aaaggagaaa agaaagacac atgcacacag gaatgttcct
2221 attttaacat taccaaggta gaaagtcggg acaaattacc ccagccggtc caacctgatc
2281 ctgtgtccca ttgtaaggag aaggatgttg acgactgttg gttctatttt acgtattcag
2341 tgaatgggaa caacgaggtc atggttcatg ttgtggagaa tccagagtgt cccactggtc
2401 cagacatcat tccaattgta gctggtgtgg ttgctggaat tgttcttatt ggccttgcat
2461 tactgctgat atggaagctt ttaatgataa ttcatgacag aagggagttt gctaaatttg
2521 aaaaggagaa aatgaatgcc aaatgggaca cgggtgaaaa tcctatttat aagagtgccg
2581 taacaactgt ggtcaatccg aagtatgagg gaaaatgagt actgcccgtg caaatcccac
2641 aacactgaat gcaaagtagc aatttccata gtcacagtta ggtagcttta gggcaatatt
2701 gccatggttt tactcatgtg caggifttga aaatgtacaa tatgtataat ttttaaaatg
2761 ttttattatt ttgaaaataa tgttgtaatt catgccaggg actgacaaaa gacttgagac
2821 aggatggtta ctcttgtcag ctaaggtcac attgtgcctt tttgaccttt tcttcctgga
2881 ctattgaaat caagcttatt ggattaagtg atatttctat agcgattgaa agggcaatag
2941 ttaaagtaat gagcatgatg agagtttctg ttaatcatgt attaaaactg attttagct
3001 ttacaaatat gtcagtttgc agttatgcag aatccaaagt aaatgtcctg ctagctagtt
3061 aaggattgtt ttaaatctgt tattttgcta tttgcctgtt agacatgact gatgacatat
3121 ctgaaagaca agtatgttga gagttgctgg tgtaaaatac gtttgaaata gttgatctac
3181 aaaggccatg ggaaaaattc agagagttag gaaggaaaaa ccaatagctt taaaacctgt
3241 gtgccatttt aagagttact taatgtttgg taacttttat gccttcactt tacaaattca
3301 agccttagat aaaagaaccg agcaattttc tgctaaaaag tccttgattt agcactattt
3361 acatacaggc catactttac aaagtatttg ctgaatgggg accttttgag ttgaatttat
```

-continued

```
3421 tttattattt ttattttgtt taatgtctgg tgctttctgt cacctcttct aatcttttaa
3481 tgtatttgtt tgcaatttg gggtaagact tttttatga gtacttttc tttgaagttt
3541 tagcggtcaa tttgcctttt taatgaacat gtgaagttat actgtggcta tgcaacagct
3601 ctcacctacg cgagtcttac tttgagttag tgccataaca gaccactgta tgtttacttc
3661 tcaccatttg agttgcccat cttgtttcac actagtcaca ttcttgtttt aagtgccttt
3721 agttttaaca gttcacttt tacagtgcta tttactgaag ttatttatta aatatgccta
3781 aaatacttaa atcggatgtc ttgactctga tgtatttat caggttgtgt gcatgaaatt
3841 tttatagatt aaagaagttg aggaaaagca aaaaaaaa
```

Integrin β3

(NCBI Ref.: NM_000212.2; SEQ ID NO: 160)

```
   1 cgccgcggga ggcggacgag atgcgagcgc ggccgcggcc ccggccgctc tgggcgactg
  61 tgctggcgct gggggcgctg gcgggcgttg cgtaggagg gcccaacatc tgtaccacgc
 121 gaggtgtgag ctcctgccag cagtgcctgg ctgtgagccc catgtgtgcc tggtgctctg
 181 atgaggccct gcctctgggc tcacctcgct gtgacctgaa ggagaatctg ctgaaggata
 241 actgtgcccc agaatccatc gagttcccag tgagtgaggc ccgagtacta gaggacaggc
 301 ccctcagcga caagggctct ggagacagct cccaggtcac tcaagtcagt ccccagagga
 361 ttgcactccg gctccggcca gatgattcga agaatttctc catccaagtg cggcaggtgg
 421 aggattaccc tgtggacatc tactacttga tggacctgtc ttactccatg aaggatgatc
 481 tgtggagcat ccagaacctg ggtaccaagc tggccaccca gatgcgaaag ctcaccagta
 541 acctgcggat tggcttcggg gcatttgtgg acaagcctgt gtcaccatac atgtatatct
 601 ccccaccaga ggccctcgaa aaccctgct atgatatgaa gaccacctgc ttgcccatgt
 661 ttggctacaa acacgtgctg acgctaactg accaggtgac ccgcttcaat gaggaagtga
 721 agaagcagag tgtgtcacgg aaccgagatg ccccagaggg tggctttgat gccatcatgc
 781 aggctacagt ctgtgatgaa aagattggct ggaggaatga tgcatcccac ttgctggtgt
 841 ttaccactga tgccaagact catatagcat tggacggaag gctggcaggc attgtccagc
 901 ctaatgacgg gcagtgtcat gttggtagtg acaatcatta ctctgcctcc actaccatgg
 961 attatccctc tttggggctg atgactgaga agctatccca gaaaaacatc aatttgatct
1021 ttgcagtgac tgaaaatgta gtcaatctct atcagaacta tagtgagctc atcccaggga
1081 ccacagttgg ggttctgtcc atggattcca gcaatgtcct ccagctcatt gttgatgctt
1141 atgggaaaat ccgttctaaa gtagagctgg aagtgcgtga cctccctgaa gagttgtctc
1201 tatccttcaa tgccacctgc ctcaacaatg aggtcatccc tggcctcaag tcttgtatgg
1261 gactcaagat tggagacacg tgagcttca gcattgaggc caaggtgcga ggctgtcccc
1321 aggagaagga gaagtccttt accataaagc ccgtgggctt caaggacagc ctgatcgtcc
1381 aggtcacctt tgattgtgac tgtgcctgcc aggcccaagc tgaacctaat agccatcgct
1441 gcaacaatgg caatgggacc tttgagtgtg gggtatgccg ttgtgggcct ggctggctgg
1501 gatcccagtg tgagtgctca gaggaggact atcgcccttc ccagcaggac gaatgcagcc
1561 cccgggaggg tcagcccgtc tgcagccagc ggggcgagtg cctctgtggt caatgtgtct
1621 gccacagcag tgactttggc aagatcacgg gcaagtactg cgagtgtgac gacttctcct
1681 gtgtccgcta caaggggggg agatgtgctc ag gccatggcca gtgcagctgt ggggactgcc
1741 tgtgtgactc cgactggacc ggctactact gcaactgtac cacgcgtact gacacctgca
1801 tgtccagcaa tgggctgctg tgcagcggcc gcggcaagtg tgaatgtggc agctgtgtct
```

-continued

```
1861 gtatccagcc gggctcctat ggggacacct gtgagaagtg ccccacctgc ccagatgcct
1921 gcacctttaa gaaagaatgt gtggagtgta agaagtttga ccggggagcc ctacatgacg
1981 aaaatacctg caaccgttac tgccgtgacg agattgagtc agtgaaagag cttaaggaca
2041 ctggcaagga tgcagtgaat tgtacctata gaatgagga tgactgtgtc gtcagattcc
2101 agtactatga agattctagt ggaaagtcca tcctgtatgt ggtagaagag ccagagtgtc
2161 ccaagggccc tgcatcctg gtggtcctgc tctcagtgat gggggccatt ctgctcattg
2221 gccttgccgc cctgctcatc tggaaactcc tcatcaccat ccacgaccga aaagaattcg
2281 ctaaatttga ggaagaacgc gccagagcaa aatgggacac agccaacaac ccactgtata
2341 aagaggccac gtctaccttc accaatatca cgtaccgggg cacttaatga taagcagtca
2401 tcctcagatc attatcagcc tgtgccacga ttgcaggagt ccctgccatc atgtttacag
2461 aggacagtat ttgtggggag ggatttgggg ctcagagtgg ggtaggttgg agaatgtca
2521 gtatgtggaa gtgtgggtct gtgtgtgtgt atgtgggggt ctgtgtgttt atgtgtgtgt
2581 gttgtgtgtg ggagtgtgta atttaaaatt gtgatgtgtc ctgataagct gagctcctta
2641 gcctttgtcc cagaatgcct cctgcaggga ttcttcctgc ttagcttgag ggtgactatg
2701 gagctgagca ggtgttcttc attacctcag tgagaagcca gattcctca tcaggccatt
2761 gtccctgaag agaagggcag ggctgaggcc tctcattcca gaggaaggga caccaagcct
2821 tggctctacc ctgagttcat aaatttatgg ttctcaggcc tgactctcag cagctatggt
2881 aggaactgct gggcttggca gcccgggtca tctgtacctc tgcctccttt cccctccctc
2941 aggccgaagg aggagtcagg gagagctgaa ctattagagc tgcctgtgcc ttttgccatc
3001 ccctcaaccc agctatggtt ctctcgcaag ggaagtcctt gcaagctaat tctttgacct
3061 gtttgggagtg aggatgtctg ggccactcag gggtcattca tggcctgggg gatgtaccag
3121 catctcccag ttcataatca caaccctcca gatttgcctt attggcagct ctactctgga
3181 ggtttgttta agaagtgt gtcacccctta ggccagcacc atctctttac ctcctaattc
3241 cacaccctca ctgctgtaga catttgctat gagctgggga tgtctctcat gaccaaatgc
3301 ttttcctcaa agggagagag tgctattgta gagccagagg tctggcccta tgcttccggc
3361 ctcctgtccc tcatccatag cacctccaca tacctggccc tgtgccttgg tgtgctgtat
3421 ccatccatgg ggctgattgt atttaccttc tacctcttgg ctgccttgtg aaggaattat
3481 tcccatgagt tggctgggaa taagtgccag gatggaatga tgggtcagtt gtatcagcac
3541 gtgtggcctg ttcttctatg ggttggacaa cctcatttta actcagtctt taatctgaga
3601 ggccacagtg caatttttatt ttatttttct catgatgagg ttttcttaac ttaaaagaac
3661 atgtatataa acatgcttgc attatatttg taaatttatg tgatggcaaa gaaggagagc
3721 ataggaaacc acacagactt gggcagggta cagacactcc cacttggcat cattcacagc
3781 aagtcactgg ccagtggctg gatctgtgag gggctctctc atgatagaag gctatgggga
3841 tagatgtgtg gacacattgg acctttcctg aggaagaggg actgttcttt tgtcccagaa
3901 aagcagtggc tccattggtg ttgacataca tccaacatta aaagccaccc ccaaatgccc
3961 aagaaaaaaa gaaagactta tcaacatttg ttccatgagc agaaaactgg agctctggcc
4021 tcagtgttac agctaaataa tctttaatta aggcaagtca ctttcttctt cttaaagctg
4081 ttttctagtt tgagaaatga tgggattta gcagccagtc ttgaaggtct ctttcagtat
4141 caacattcta agatgctggg acttactgtg tcatcaaatg tgcggttaag attctctggg
4201 atattgatac tgtttgtgtt tttagttggg agatctgaga gacctggctt tggcaagagc
4261 agatgtcatt ccatatcacc tttctcaatg aaagtctcat tctatcctct ctccaaaccc
```

-continued

```
4321 gttttccaac atttgttaat agttacgtct ctcctgatgt agcacttaag cttcatttag
4381 ttattatttc tttcttcact ttgcacacat ttgcatccac atattaggga agaggaatcc
4441 ataagtagct gaaatatcta ttctgtatta ttgtgttaac attgagaata agccttggaa
4501 ttagatatgg ggcaatgact gagccctgtc tcacccatgg attactcctt actgtaggga
4561 atggcagtat ggtagaggga taaataggg gcggggaggg atagtcatgg atccaagaag
4621 tccttagaaa tagtggcagg gaacaggtgt ggaagctcat gcctgtaatt ataaccttca
4681 gctactaaga caggtgtggt ggctcacgcc tgtgattata atcttcagtt actaagacag
4741 agtccatgag agtgttaatg ggacattttc tttagataag atgttttata tgaagaaact
4801 gtatcaaagg gggaagaaaa tgtatttaac aggtgaatca aatcaggaat cttgtctgag
4861 ctactggaat gaagttcaca ggtcttgaag acca
```

Integrin β5

(NCBI Ref.: NM_002213.4; SEQ ID NO: 161)

```
   1 gccgccgagc ggagccagcc cctccctac ccggagcagc ccgctggggc cgtcccgagc
  61 ggcgacacac taggagtccc ggccggccag ccagggcagc cgcggtcccg ggactcggcc
 121 gtgagtgctg cgggacggat ggtggcgcg gggcgcgggc cagcgcgggc gccgtgagcc
 181 ggagctgcgc gcggggcatg cggctgcggc ccccggccct cggccccgc gctccggccc
 241 cagccccggc cgccggcccc cgcggagtgc agcgaccgcg ccgccgctga gggaggcgcc
 301 ccaccatgcc gcgggccccg gcgccgctgt acgcctgcct cctgggctc tgcgcgctcc
 361 tgccccggct cgcaggtctc aacatatgca ctagtggaag tgccacctca tgtgaagaat
 421 gtctgctaat ccacccaaaa tgtgcctggt gctccaaaga ggacttcgga agcccacggt
 481 ccatcacctc tcggtgtgat ctgagggcaa accttgtcaa aaatggctgt ggaggtgaga
 541 tagagagccc agccagcagc ttccatgtcc tgaggagcct gccctcagc agcaagggtt
 601 cgggctctgc aggctggac gtcattcaga tgacaccaca ggagattgcc gtgaacctcc
 661 ggcccggtga caagaccacc ttccagctac aggttcgcca ggtggaggac tatcctgtgg
 721 acctgtacta cctgatggac ctctcctgt ccatgaagga tgacttggac aatatccgga
 781 gcctgggcac caaactcgcg gaggagatga ggaagctcac cagcaacttc cggttgggat
 841 ttgggtcttt tgttgataag gacatctctc ctttctccta cacggcaccg aggtaccaga
 901 ccaatccgtg cattggttac aagttgtttc caaattgcgt cccctccttt gggttccgcc
 961 atctgctgcc tctcacagac agagtggaca gcttcaatga ggaagttcgg aaacagaggg
1021 tgtcccggaa ccgagatgcc cctgaggggg gctttgatgc agtactccag gcagccgtct
1081 gcaaggagaa gattggctgg cgaaaggatg cactgcattt gctggtgttc acaacagatg
1141 atgtgcccca tcgcattg gatggaaaat tgggaggcct ggtgcagcca cacgatggcc
1201 agtgccacct gaacgaggcc aacgagtaca ctgcatccaa ccagatggac tatccatccc
1261 ttgccttgct tggagagaaa ttggcagaga acaacatcaa cctcatcttt gcagtgacaa
1321 aaaaccatta tgctgtac aagaattta cagccctgat acctggaaca acggtggaga
1381 ttttagatgg agactccaaa aatattattc aactgattat taatgcatac aatagtatcc
1441 ggtctaaagt ggagttgtca gtctgggatc agcctgagga tcttaatctc ttctttactg
1501 ctacctgcca agatggggta tcctatcctg tcagaggaa gtgtgagggt ctgaagattg
1561 gggacacggc atcttttgaa gtatcattgg aggcccgaag ctgtccagc agacacacgg
1621 agcatgtgtt tgccctgcgg ccggtgggat tccgggacag cctggaggtg gggggtcacct
1681 acaactgcac gtgcggctgc agcgtggggc tggaacccaa cagcgccagg tgcaacggga
```

-continued

```
1741 gcgggaccta tgtctgcggc ctgtgtgagt gcagccccgg ctacctgggc accaggtgcg 1801 agtgccagga tggggagaac cagagcgtgt accagaacct gtgccgggag gcagagggca 1861 agccactgtg cagcgggcgt ggggactgca gctgcaacca gtgctcctgc ttcgagagcg 1921 agtttggcaa gatctatggg cctttctgtg agtgcgacaa cttctcctgt gccaggaaca 1981 agggagtcct ctgctcaggc catggcgagt gtcactgcgg ggaatgcaag tgccatgcag 2041 gttacatcgg ggacaactgt aactgctcga cagacatcag cacatgccgg ggcagagatg 2101 gccagatctg cagcgagcgt gggcactgtc tctgtgggca gtgccaatgc acggagccgg 2161 gggcctttgg ggagatgtgt gagaagtgcc ccacctgccc ggatgcatgc agcaccaaga 2221 gagattgcgt cgagtgcctg ctgctccact ctgggaaacc tgacaaccag acctgccaca 2281 gcctatgcag ggatgaggtg atcacatggg tggacaccat cgtgaaagat gaccaggagg 2341 ctgtgctatg tttctacaaa accgccaagg actgcgtcat gatgttcacc tatgtggagc 2401 tccccagtgg gaagtccaac ctgaccgtcc tcagggagcc agagtgtgga aacaccccca 2461 acgccatgac catcctcctg gctgtggtcg gtagcatcct ccttgttggg cttgcactcc 2521 tggctatctg gaagctgctt gtcaccatca acgaccggag ggagtttgca aagtttcaga 2581 gcgagcgatc cagggcccgc tatgaaatgg cttcaaatcc attatacaga aagcctatct 2641 ccacgcacac tgtggacttc accttcaaca gttcaacaa atcctacaat ggcactgtgg 2701 actgatgttt ccttctccga ggggctggag cggggatctg atgaaaaggt cagactgaaa 2761 cgccttgcac ggctgctcgg cttgatcaca gctccctagg taggcaccac agagaagacc 2821 ttctagtgag cctgggccag gagcccacag tgcctgtaca ggaaggtgcc tggccatgtc 2881 acctggctgc taggccagag ccatgccagg ctgcgtccct ccgagcttgg gataaagcaa 2941 ggggaccttg gcgctctcag ctttccctgc cacatccagc ttgttgtccc aatgaaatac 3001 tgagatgctg ggctgtctct cccttccagg aatgctgggc cccagcctg gccagacaag 3061 aagactgtca ggaagggtcg gagtctgtaa accagcata cagtttggct ttttcacat 3121 tgatcattt tatatgaaat aaaaagatcc tgcatttatg gtgtagttct gagtcctgag 3181 acttttctgc gtgatggcta tgccttgcac acaggtgttg gtgatggggc tgttgagatg 3241 cctgttgaag gtacatcgtt tgcaaatgtc agtttcctct cctgtccgtg tttgtttagt 3301 acttttataa tgaaaagaaa caagattgtt tgggattgga agtaaagatt aaaaccaaaa 3361 gaatttgtgt ttgtctgata ctctctgtgt gtttctttct ttctgagcgg acttaaaatg 3421 gtgcccccag tggggattga agcggccgtg tacttcctca gggatgggac acaggctggt 3481 ctgatactcc agactgcagc ttgtcaagta agcatgaggt gctcggggca gtgagggctg 3541 tgcaagggg aacactgagc agatacctt ggccccttcc agcttttact gacagagagt 3601 tccaggctag acaccataaa aaccacccct tgttctgagg ggctgaggct ggaaatagat 3661 tgtacagaca agcaagggtt gagtggtggt tcccacacga agtcatctct taatcatcat 3721 tagcaatagc agttcccttc caaggcctcc cctcactccc gaaacactta cgtcccatgc 3781 aggcccaatg caaaaaaaca catttgagct ttttcccgc agggccatga agtcccctta 3841 agttcccata tctaagatgg ttgactgacc ctctcccctt atgtacagaa gaggaaactg 3901 attctcagag aggggaagtg gcttgcccga gtgtttgtta ggaggttact gaatgacaaa 3961 ctgttcctaa gaccccatct catgctggcc agagggccag cctcctcatt cctgcttgct 4021 cttagaaaat ctttcactga tcatttttg tcactggaat aacttcaagg ttattatgct 4081 ttcattccaa atggatctgt cctcagctct ggacccaatt cccttactt cattttggca 4141 aacactaagt caaatagtga aatgcctgtc actacataga acctattacc tggggcaaat
```

-continued

```
4201 acgaacagat tgagtttcct tcatcttgtg taaatatgat gaaacagaga cctggtaact
4261 tggtgacact gttaaaccct ttttgggata aagccaaatg taaatgaaaa cattaaacag
4321 ataaattgtg gtgttgagac ttttctgaat tgagaaaaat aaatgtaatt ttggaagaaa
4381 aaaaaaaaaa aa
```

Integrin β7

(NCBI Ref.: NM_000889.2; SEQ ID NO: 162)

```
   1 aaatcttccc caccctgggg agtgtcactt cctcctctgc cgtctcccag atcagtacac
  61 aaaggctgct gctgccgcca gaggaaggac tgctctgcac gcacctatgt ggaaactaaa
 121 gcccagagag aaagtctgac ttgccccaca gccagtgagt gactgcagca gcaccagaat
 181 ctggtctgtt tcctgtttgg ctcttctacc actacggctt gggatctcgg gcatggtggc
 241 tttgccaatg gtccttgttt tgctgctggt cctgagcaga ggtgagagtg aattggacgc
 301 caagatccca tccacagggg atgccacaga atggcggaat cctcacctgt ccatgctggg
 361 gtcctgccag ccagccccct cctgccagaa gtgcatcctc tcacacccca gctgtgcatg
 421 gtgcaagcaa ctgaacttca ccgcgtcggg agaggcggag gcgcggcgct gcgcccgacg
 481 agaggagctg ctggctcgag gctgcccgct ggaggagctg gaggagcccc gcggccagca
 541 ggaggtgctg caggaccagc cgctcagcca gggcgcccgc ggagagggtg ccacccagct
 601 ggcgccgcag cgggtccggg tcacgctgcg gcctggggag ccccagcagc tccaggtccg
 661 cttccttcgt gctgagggat acccggtgga cctgtactac cttatggacc tgagctactc
 721 catgaaggac gacctggaac gcgtgcgcca gctcggcac gctctgctgg tccggctgca
 781 ggaagtcacc cattctgtgc gcattggttt tggttccttt gtggacaaaa cggtgctgcc
 841 ctttgtgagc acagtaccct ccaaaactgcg ccacccctgc cccacccggc tggagcgctg
 901 ccagtcacca ttcagctttc accatgtgct gtccctgacg ggggacgcac aagccttcga
 961 gcgggaggtg gggcgccaga gtgtgtccgg caatctggac tcgcctgaag gtggcttcga
1021 tgccattctg caggctgcac tctgccagga gcagattggc tggagaaatg tgtcccggct
1081 gctggtgttc acttcagacg acacattcca tacagctggg gacgggaagt ggggcggcat
1141 tttcatgccc agtgatgggc actgccactt ggacagcaat ggcctctaca gtcgcagcac
1201 agagtttgac tacccttctg tgggtcaggt agcccaggcc ctctctgcag caaatatcca
1261 gcccatcttt gctgtcacca gtgccgcact gcctgtctac caggagctga gtaaactgat
1321 tcctaagtct gcagttgggg agctgagtga ggactccagc aacgtggtac agctcatcat
1381 ggatgcttat aatagcctgt cttccaccgt gacccttgaa cactcttcac tccctcctgg
1441 ggtccacatt tcttacgaat cccagtgtga gggtcctgag aagagggagg gtaaggctga
1501 ggatcgagga cagtgcaacc acgtccgaat caaccagacg gtgactttct gggtttctct
1561 ccaagccacc cactgcctcc cagagcccca tctcctgagg ctccgggccc ttggcttctc
1621 agaggagctg attgtggagt tgcacacgct gtgtgactgt aattgcagtg cacccagcc
1681 ccaggctccc cactgcagtg atggccaggg acacctacaa tgtggtgtat gcagctgtgc
1741 ccctggccgc ctaggtcggc tctgtgagtg ctctgtggca gagctgtcct ccccagacct
1801 ggaatctggg tgccgggctc ccaatggcac agggcccctg tgcagtggaa agggtcactg
1861 tcaatgtgga cgctgcagct gcagtggaca gagctctggg catctgtgcg agtgtgacga
1921 tgccagctgt gagcgacatg agggcatcct ctgcggaggc tttggtcgct gccaatgtgg
1981 agtatgtcac tgtcatgcca accgcacggg cagagcatgc gaatgcagtg gggacatgga
2041 cagttgcatc agtcccgagg gagggctctg cagtgggcat ggacgctgca aatgcaaccg
```

-continued

```
2101 ctgccagtgc ttggacggct actatggtgc tctatgcgac caatgcccag gctgcaagac 2161 accatgcgag agacaccggg actgtgcaga gtgtggggcc ttcaggactg gcccactggc 2221 caccaactgc agtacagctt gtgcccatac caatgtgacc ctggccttgg ccctatctt 2281 ggatgatggc tggtgcaaag agcggaccct ggacaaccag ctgttcttct tcttggtgga 2341 ggatgacgcc agaggcacgg tcgtgctcag agtgagaccc caagaaaagg gagcagacca 2401 cacgcaggcc attgtgctgg gctgcgtagg gggcatcgtg gcagtggggc tgggctggt 2461 cctggcttac cggctctcgg tggaaatcta tgaccgccgg gaatacagtc gctttgagaa 2521 ggagcagcaa caactcaact ggaagcagga cagtaatcct ctctacaaaa gtgccatcac 2581 gaccaccatc aatcctcgct tcaagaggc agacagtccc actctctgaa ggagggaggg 2641 acacttaccc aaggctcttc tccttggagg acagtgggaa ctggagggtg agaggaaggg 2701 tgggtctgta agaccttggt aggggactaa ttcactggcg aggtgcggcc accaccctac 2761 ttcattttca gagtgacacc caagagggct gcttcccatg cctgcaacct tgcatccatc 2821 tgggctaccc cacccaagta acaataaag tcttacctca gaccacaaaa aaaaaaaa
```

E-selectin (NCBI Ref.: NM_000450.2; SEQ ID NO: 163)

```
  1 agctgttctt ggctgacttc acatcaaaac tcctatactg acctgagaca gaggcagcag 61 tgatacccac ctgagagatc ctgtgtttga caactgctt cccaaaacgg aaagtatttc 121 aagcctaaac ctttgggtga aaagaactct tgaagtcatg attgcttcac agtttctctc 181 agctctcact ttggtgcttc tcattaaaga gagtggagcc tggtcttaca cacctccac 241 ggaagctatg acttatgatg aggccagtgc ttattgtcag caaaggtaca cacacctggt 301 tgcaattcaa acaaagaag agattgagta cctaaactcc atattgagct attcaccaag 361 ttattactgg attggaatca gaaaagtcaa caatgtgtgg gtctgggtag aacccagaa 421 acctctgaca gaagaagcca agaactgggc tccaggtgaa cccaacaata ggcaaaaaga 481 tgaggactgc gtggagatct acatcaagag agaaaaagat gtgggcatgt ggaatgatga 541 gaggtgcagc aagaagaagc ttgccctatg ctacacagct gcctgtacca atacatcctg 601 cagtggccac ggtgaatgtg tagagaccat caataattac acttgcaagt gtgaccctgg 661 cttcagtgga ctcaagtgtg agcaaattgt gaactgtaca gccctggaat cccctgagca 721 tggaagcctg gtttgcagtc acccactggg aaacttcagc tacaattctt cctgctctat 781 cagctgtgat aggggttacc tgccaagcag catggagacc atgcagtgta tgtcctctgg 841 agaatggagt gctcctattc cagcctgcaa tgtggttgag tgtgatgctg tgacaaatcc 901 agccaatggg ttcgtggaat gtttccaaaa ccctggaagc ttcccatgga cacaacctg 961 tacatttgac tgtgaagaag gatttgaact aatgggagcc cagagccttc agtgtacctc 1021 atctgggaat tgggacaacg agaagccaac gtgtaaagct gtgacatgca gggccgtccg 1081 ccagcctcag aatggctctg tgaggtgcag ccattcccct ggctggagt tcaccttcaa 1141 atcatcctgc aacttcacct gtgaggaagg cttcatgttg cagggaccag cccaggttga 1201 atgcaccact caagggcagt ggacacagca atcccagtt tgtgaagctt ccagtgcac 1261 agccttgtcc aaccccgagc gaggctacat gaattgtctt cctagtgctt ctggcagttt 1321 ccgttatggg tccagctgtg agttctcctg tgagcagggt tttgtgttga gggatccaa 1381 aaggctccaa tgtggcccca caggggagtg ggacaacgag aagcccacat gtgaagctgt 1441 gagatgcgat gctgtccacc agcccccgaa gggtttggtg aggtgtgctc attccccat 1501 tggagaattc acctacaagt cctcttgtgc cttcagctgt gaggagggat ttgaattaca 1561 tggatcaact caacttgagt gcacatctca gggacaatgg acagaagagg ttccttcctg
```

-continued

```
1621 ccaagtggta aaatgttcaa gcctggcagt tccgggaaag atcaacatga gctgcagtgg 1681 ggagcccgtg tttggcactg tgtgcaagtt cgcctgtcct gaaggatgga cgctcaatgg 1741 ctctgcagct cggacatgtg gagccacagg acactggtct ggcctgctac ctacctgtga 1801 agctcccact gagtccaaca ttcccttggt agctggactt tctgctgctg gactctccct 1861 cctgacatta gcaccatttc tcctctggct tcggaaatgc ttacgaaag caaagaaatt 1921 tgttcctgcc agcagctgcc aaagccttga atcagatgga agctaccaaa agccttctta 1981 catcctttaa gttcaaaaga atcagaaaca ggtgcatctg gggaactaga gggatacact 2041 gaagttaaca gagacagata actctcctcg ggtctctggc ccttcttgcc tactatgcca 2101 gatgccttta tggctgaaac cgcaacaccc atcaccactt caatagatca aagtccagca 2161 ggcaaggacg gccttcaact gaaaagactc agtgttccct ttcctactct caggatcaag 2221 aaagtgttgg ctaatgaagg gaaaggatat tttcttccaa gcaaaggtga agagaccaag 2281 actctgaaat ctcagaattc cttttctaac tctcccttgc tcgctgtaaa atcttggcac 2341 agaaacacaa tattttgtgg ctttctttct tttgcccttc acagtgtttc gacagctgat 2401 tacacagttg ctgtcataag aatgaataat aattatccag agtttagagg aaaaaaatga 2461 ctaaaaatat tataacttaa aaaatgaca gatgttgaat gcccacaggc aaatgcatgg 2521 agggttgtta atggtgcaaa tcctactgaa tgctctgtgc gagggttact atgcacaatt 2581 taatcacttt catccctatg ggattcagtg cttcttaaag agttcttaag gattgtgata 2641 tttttacttg cattgaatat attataatct tccatacttc ttcattcaat acaagtgtgg 2701 tagggactta aaaaacttgt aaatgctgtc aactatgata tggtaaaagt tacttattct 2761 agattacccc ctcattgttt attaacaaat tatgttacat ctgttttaaa tttatttcaa 2821 aaagggaaac tattgtcccc tagcaaggca tgatgttaac cagaataaag ttctgagtgt 2881 ttttactaca gttgttttt gaaaacatgg tagaattgga gagtaaaaac tgaatggaag 2941 gtttgtatat tgtcagatat tttttcagaa atatgtggtt tccacgatga aaaacttcca 3001 tgaggccaaa cgttttgaac taataaaagc ataaatgcaa acacacaaag gtataatttt 3061 atgaatgtct ttgttggaaa agaatacaga aagatggatg tgctttgcat tcctacaaag 3121 atgtttgtca gatatgatat gtaaacataa ttcttgtata ttatggaaga ttttaaattc 3181 acaatagaaa ctcaccatgt aaaagagtca tctggtagat ttttaacgaa tgaagatgtc 3241 taatagttat tccctatttg ttttcttctg tatgttaggg tgctctggaa gagaggaatg 3301 cctgtgtgag caagcattta tgtttattta aagcagatt taacaattcc aaaggaatct 3361 ccagttttca gttgatcact ggcaatgaaa aattctcagt cagtaattgc caaagctgct 3421 ctagccttga ggagtgtgag aatcaaaact ctcctacact tccattaact agcatgtgt 3481 tgaaaaaaaa gtttcagaga agttctggct gaacactggc aacaacaaag ccaacagtca 3541 aaacagagat gtgataagga tcagaacagc agaggttctt ttaaaggggc agaaaaactc 3601 tgggaaataa gagagaacaa ctactgtgat caggctatgt atggaataca gtgttatttt 3661 ctttgaaatt gtttaagtgt tgtaaatatt tatgtaaact gcattagaaa ttagctgtgt 3721 gaaataccag tgtggtttgt gtttgagttt tattgagaat tttaaattat aacttaaaat 3781 attttataat ttttaaagta tatatttatt taagcttatg tcagacctat ttgacataac 3841 actataaagg ttgacaataa atgtgcttat gttta
```

-continued

ICAM-1
(NCBI Ref.: NM_000201.2; SEQ ID NO: 164)

```
   1 caagcttagc ctggccggga aacgggaggc gtggaggccg ggagcagccc ccggggtcat
  61 cgccctgcca ccgccgcccg attgctttag cttggaaatt ccggagctga agcggccagc
 121 gagggaggat gaccctctcg gcccgggcac cctgtcagtc cggaaataac tgcagcattt
 181 gttccggagg ggaaggcgcg aggtttccgg gaaagcagca ccgccccttg gcccccaggt
 241 ggctagcgct ataaaggatc acgcgcccca gtcgacgctg agctcctctg ctactcagag
 301 ttgcaacctc agcctcgcta tggctcccag cagccccgg cccgcgctgc ccgcactcct
 361 ggtcctgctc ggggctctgt tcccaggacc tggcaatgcc cagacatctg tgtcccctc
 421 aaaagtcatc ctgccccggg gaggctccgt gctggtgaca tgcagcacct cctgtgacca
 481 gcccaagttg ttgggcatag agaccccgtt gcctaaaaag gagttgctcc tgcctgggaa
 541 caaccggaag gtgtatgaac tgagcaatgt gcaagaagat agccaaccaa tgtgctattc
 601 aaactgccct gatgggcagt caacagctaa aaccttcctc accgtgtact ggactccaga
 661 acgggtggaa ctggcacccc tcccctcttg gcagccagtg ggcaagaacc ttaccctacg
 721 ctgccaggtg gagggtgggg caccccgggc caacctcacc gtggtgctgc tccgtgggga
 781 gaaggagctg aaacgggagc cagctgtggg ggagcccgct gaggtcacga ccacggtgct
 841 ggtgaggaga gatcaccatg gagccaattt ctcgtgccgc actgaactgg acctgcggcc
 901 ccaagggctg gagctgtttg agaacaccctc ggcccctac cagctccaga cctttgtcct
 961 gccagcgact cccccacaac ttgtcagccc ccgggtccta gaggtggaca cgcaggggac
1021 cgtggtctgt tccctggacg ggctgttccc agtctcggag gcccaggtcc acctggcact
1081 gggggaccag aggttgaacc cacagtcac ctatggcaac gactccttct cggccaaggc
1141 ctcagtcagt gtgaccgcag aggacgaggg cacccagcgg ctgacgtgtg cagtaatact
1201 ggggaaccag agccaggaga cactgcagac agtgaccatc tacagctttc ggcgcccaa
1261 cgtgattctg acgaagccag aggtctcaga agggaccgag gtgacagtga gtgtgaggc
1321 ccacccctaga gccaaggtga cgctgaatgg ggttccagcc cagccactgg gcccgagggc
1381 ccagctcctg ctgaaggcca ccccagagga caacgggcgc agcttctcct gctctgcaac
1441 cctggaggtg gccggccagc ttatacacaa gaaccagacc cgggagcttc gtgtcctgta
1501 tggcccccga ctggacgaga gggattgtcc gggaaactgg acgtggccag aaaattccca
1561 gcagactcca atgtgccagg cttggggaa cccattgccc gagctcaagt gtctaaagga
1621 tggcactttc ccactgccca tcggggaatc agtgactgtc actcgagatc ttgagggcac
1681 ctacctctgt cgggccagga gcactcaagg ggaggtcacc cgcaaggtga ccgtgaatgt
1741 gctctccccc cggtatgaga ttgtcatcat cactgtggta gcagccgcag tcataatggg
1801 cactgcaggc ctcagcacgt acctctataa ccgccagcgg aagatcaaga aatacagact
1861 acaacaggcc caaaaaggga ccccccatgaa accgaacaca caagccacgc ctccctgaac
1921 ctatcccggg acagggcctc ttcctcggcc ttcccatatt ggtggcagtg gtgccacact
1981 gaacagagtg gaagacatat gccatgcagc tacacctacc ggccctggga cgccggagga
2041 cagggcattg tcctcagtca gatacaacag catttggggc catggtacct gcacacctaa
2101 aacactaggc cacgcatctg atctgtagtc acatgactaa gccaagagga aggagcaaga
2161 ctcaagacat gattgatgga tgttaaagtc tagcctgatg agaggggaag tggtggggga
2221 gacatagccc caccatgagg acatacaact gggaaatact gaaacttgct gcctattggg
2281 tatgctgagg ccccacagac ttacagaaga agtggccctc catagacatg tgtagcatca
```

```
2341 aaacacaaag gcccacactt cctgacggat gccagcttgg gcactgctgt ctactgaccc 2401 caacccttga tgatatgtat ttattcattt gttattttac cagctattta ttgagtgtct 2461 tttatgtagg ctaaatgaac ataggtctct ggcctcacgg agctcccagt cctaatcaca 2521 ttcaaggtca ccaggtacag ttgtacaggt tgtacactgc aggagagtgc ctggcaaaaa 2581 gatcaaatgg ggctgggact tctcattggc caacctgcct ttccccagaa ggagtgattt 2641 ttctatcggc acaaaagcac tatatggact ggtaatggtt acaggttcag agattaccca 2701 gtgaggcctt attcctccct tcccccaaa actgacacct ttgttagcca cctccccacc 2761 cacatacatt tctgccagtg ttcacaatga cactcagcgg tcatgtctgg acatgagtgc 2821 ccagggaata tgcccaagct atgccttgtc ctcttgtcct gtttgcattt cactgggagc 2881 ttgcactatg cagctccagt ttcctgcagt gatcagggtc ctgcaagcag tggggaaggg 2941 ggccaaggta ttggaggact ccctcccagc tttggaagcc tcatccgcgt gtgtgtgtgt 3001 gtgtatgtgt agacaagctc tcgctctgtc acccaggctg gagtgcagtg gtgcaatcat 3061 ggttcactgc agtcttgacc ttttgggctc aagtgatcct cccacctcag cctcctgagt 3121 agctgggacc ataggctcac aacaccacac ctggcaaatt tgattttttt tttttttcca 3181 gagacggggt ctcgcaacat tgcccagact cctttgtgt tagttaataa agctttctca 3241 actgccaaa
```

TGF-β

(NCBI Ref.: NM_000660.6; SEQ ID NO: 165)

```
   1 acctccctcc gcggagcagc cagacagcga gggccccggc cggggcaggg gggacgccc 61 cgtccgggc accccccgg ctctgagccg cccgcgggc cggcctcggc ccggagcgga 121 ggaaggagtc gccgaggagc agcctgaggc cccagagtct gagacgagcc gccgccgccc 181 ccgccactgc ggggaggagg gggaggagga gcggaggag ggacgagctg gtcgggagaa 241 gaggaaaaaa acttttgaga cttttccgtt gccgctggga gccggaggcg cggggacctc 301 ttggcgcgac gctgccccgc gaggaggcag gacttgggga ccccagaccg cctcccttg 361 ccgccgggga cgcttgctcc ctccctgccc cctacacggc gtccctcagg cgccccatt 421 ccggaccagc cctcgggagt cgccgacccg gcctcccgca aagacttttc cccagacctc 481 gggcgcaccc cctgcacgcc gccttcatcc ccggcctgtc tcctgagccc ccgcgcatcc 541 tagacccttt ctcctccagg agacggatct ctctccgacc tgccacagat ccccctattca 601 agaccaccca ccttctggta ccagatcgcg cccatctagg ttatttccgt gggatactga 661 gacaccccg gtccaagcct cccctccacc actgcgccct tctccctgag gacctcagct 721 ttccctcgag gccctcctac cttttgccgg gagacccca gccctgcag ggcgggggcc 781 tccccaccac accagccctg ttcgcgctct cggcagtgcc ggggggcgcc gcctccccca 841 tgccgccctc cgggctgcgg ctgctgccgc tgctgctacc gctgctgtgg ctactggtgc 901 tgacgcctgg ccggccggcc gcgggactat ccacctgcaa gactatcgac atggagctgg 961 tgaagcggaa gcgcatcgag gccatccgcg gccagatcct gtccaagctg cggctcgcca 1021 gccccccgag ccaggggag gtgccgcccg gccgctgcc cgaggccgtg ctcgccctgt 1081 acaacagcac ccgcgaccgg gtggccgggg agagtgcaga accggagccc gagcctgagg 1141 ccgactacta cgccaaggag gtcacccgcg tgctaatggt ggaaacccac aacgaaatct 1201 atgacaagtt caagcagagt acacacagca tatatatgtt cttcaacaca tcagagctcc 1261 gagaagcggt acctgaaccc gtgttgctct cccgggcaga gctgcgtctg ctgaggctca 1321 agttaaaagt ggagcagcac gtggagctgt accagaaata cagcaacaat tcctggcgat 1381 acctcagcaa ccggctgctg gcacccagcg actcgccaga gtggttatct tttgatgtca
```

-continued

```
1441 ccggagttgt gcggcagtgg ttgagccgtg gaggggaaat tgagggcttt cgccttagcg
1501 cccactgctc ctgtgacagc agggataaca cactgcaagt ggacatcaac gggttcacta
1561 ccggccgccg aggtgacctg gccaccattc atggcatgaa ccggccttc ctgcttctca
1621 tggccacccc gctggagagg gcccagcatc tgcaaagctc ccggcaccgc cgagccctgg
1681 acaccaacta ttgcttcagc tccacggaga gaactgctg cgtgcggcag ctgtacattg
1741 acttccgcaa ggacctcggc tggaagtgga tccacgagcc caagggctac catgccaact
1801 tctgcctcgg gcctgcccc tacatttgga gcctggacac gcagtacagc aaggtcctgg
1861 ccctgtacaa ccagcataac ccgggcgcct cggcggcgcc gtgctgcgtg ccgcaggcgc
1921 tggagccgct gcccatcgtg tactacgtgg gccgcaagcc caaggtggag cagctgtcca
1981 acatgatcgt gcgctcctgc aagtgcagct gaggtcccgc ccgccccgc ccgccccgg
2041 caggcccggc cccacccgc ccgccccg ctgccttgcc catggggct gtatttaagg
2101 acacccgtgc cccaagccca cctggggccc cattaaagat ggagagagga ctgcggatct
2161 ctgtgtcatt gggcgcctgc ctggggtctc catccctgac gttcccccac tcccactccc
2221 tctctctccc tctctgcctc ctcctgcctg tctgcactat tcctttgccc ggcatcaagg
2281 cacaggggac cagtggggaa cactactgta gttagatcta tttattgagc accttgggca
2341 ctgttgaagt gccttacatt aatgaactca ttcagtcacc atagcaacac tctgagatgc
2401 agggactctg ataacaccca ttttaaaggt gaggaaacaa gcccagagag gttaagggag
2461 gagttcctgc ccaccaggaa cctgctttag tgggggatag tgaagaagac aataaaagat
2521 agtagttcag gccaggcggg gtggctcacg cctgtaatcc tagcacttt gggaggcaga
2581 gatgggagga ttacttgaat ccaggcattt gagaccagcc tggtaacat agtgagaccc
2641 tatctctaca aaacactttt aaaaaatgta cacctgtggt cccagctact ctggaggcta
2701 aggtgggagg atcacttgat cctgggaggt caaggctgca g
```

MadCAM-1

(NCBI Ref.: NM_130760.2; SEQ ID NO: 166)

```
   1 gggactgagc atggatttcg gactggccct cctgctggcg gggcttctgg ggctcctcct
  61 cggccagtcc ctccaggtga agccctgca ggtggagccc ccggagccgg tggtggccgt
 121 ggccttgggc gcctcgcgcc agctcacctg ccgcctggcc tgcgcggacc gcggggcctc
 181 ggtgcagtgg cggggcctgg acaccagcct gggcgcggtg cagtcggaca cgggccgcag
 241 cgtcctcacc gtgcgcaacg cctcgctgtc ggcggccggg accgcgtgt gcgtgggctc
 301 ctgcgggggc cgcaccttcc agcacaccgt gcagctcctt gtgtacgcct tcccggacca
 361 gctgaccgtc tccccagcag ccctggtgcc tggtgacccg gaggtggcct gtacggccca
 421 caaagtcacg cccgtggacc caacgcgct ctccttctcc ctgctcgtcg ggggccagga
 481 actggagggg gcgcaagccc tgggcccgga ggtgcaggag gaggaggagg agccccaggg
 541 ggacgaggac gtgctgttca gggtgacaga gcgctggcgg ctgccgcccc tggggacccc
 601 tgtcccgccc gccctctact gccaggccac gatgaggctg cctggcttgg agctcagcca
 661 ccgccaggcc atccccgtcc tgcacagccc gacctcccg gagcctcccg acaccacctc
 721 cccggagtct cccgacacca cctccccgga gtctcccgac accacctccc aggagcctcc
 781 cgacaccacc tccccggagc ctcccgacaa gacctcccg gagcccgccc ccagcaggg
 841 ctccacacac accccccagga gcccaggctc caccaggact cgccgccctg agatctccca
 901 ggctgggccc acgcagggag aagtgatccc aacaggctcg tccaaacctg cgggtgacca
 961 gctgcccgcg gctctgtgga ccagcagtgc ggtgctggga ctgctgctcc tggccttgcc
```

-continued

```
1021 cacctatcac ctctggaaac gctgccggca cctggctgag gacgacaccc acccaccagc 1081 ttctctgagg cttctgcccc aggtgtcggc ctgggctggg ttaaggggga ccggccaggt 1141 cgggatcagc ccctcctgag tggccagcct ttcccctgt gaaagcaaaa tagcttggac 1201 cccttcaagt tgagaactgg tcagggcaaa cctgcctccc attctactca aagtcatccc 1261 tctgttcaca gagatggatg catgttctga ttgcctcttt ggagaagctc atcagaaact 1321 caaaagaagg ccactgtttg tctcacctac ccatgacctg aagcccctcc ctgagtggtc 1381 cccacctttc tggacggaac cacgtacttt ttacatacat tgattcatgt ctcacgtctc 1441 cctaaaaatg cgtaagacca agctgtgccc tgaccaccct gggcccctgt cgtcaggacc 1501 tcctgaggct ttggcaaata aacctcctaa aatgataaaa aaaaaa
```

VCAM-1
(NCBI Ref.: NM_001078.3; SEQ ID NO: 167)

```
   1 aaacttttt ccctggctct gccctgggtt tccccttgaa gggatttccc tccgcctctg 61 caacaagacc ctttataaag cacagacttt ctatttcact ccgcggtatc tgcatcgggc 121 ctcactggct tcaggagctg aatacccctcc caggcacaca caggtgggac acaaataagg 181 gttttggaac cactattttc tcatcacgac agcaacttaa aatgcctggg aagatggtcg 241 tgatccttgg agcctcaaat atactttgga taatgtttgc agcttctcaa gcttttaaaa 301 tcgagaccac cccagaatct agatatcttg ctcagattgg tgactccgtc tcattgactt 361 gcagcaccac aggctgtgag tccccatttt tctcttggag aacccagata gatagtccac 421 tgaatgggaa ggtgacgaat gagggggacca catctacgct gacaatgaat cctgttagtt 481 ttgggaacga acactcttac ctgtgcacag caacttgtga atctaggaaa ttggaaaaag 541 gaatccaggt ggagatctac tcttttccta aggatccaga gattcatttg agtggccctc 601 tggaggctgg gaagccgatc acagtcaagt gttcagttgc tgatgtatac ccatttgaca 661 ggctggagat agacttactg aaaggagatc atctcatgaa gagtcaggaa tttctggagg 721 atgcagacag gaagtccctg gaaaccaaga gtttggaagt aacctttact cctgtcattg 781 aggatattgg aaaagttctt gtttgccgag ctaaattaca cattgatgaa atggattctg 841 tgcccacagt aaggcaggct gtaaaagaat gcaagtcta catatcaccc aagaatacag 901 ttatttctgt gaatccatcc acaaagctgc aagaaggtgg ctctgtgacc atgacctgtt 961 ccagcgaggg tctaccagct ccagagattt ctggagtaa gaaattagat aatgggaatc 1021 tacagcacct ttctggaaat gcaactctca ccttaattgc tatgaggatg aagattctg 1081 gaatttatgt gtgtgaagga gttaatttga ttgggaaaaa cagaaaagag gtggaattaa 1141 ttgttcaaga gaaaccattt actgttgaga tctcccctgg accccggatt gctgctcaga 1201 ttggagactc agtcatgttg acatgtagtg tcatgggctg tgaatcccca tctttctcct 1261 ggagaaccca gatagacagc cctctgagcg ggaaggtgag gagtgagggg accaattcca 1321 cgctgacccet gagccctgtg agttttgaga acgaacactc ttatctgtgc acagtgactt 1381 gtggacataa gaaactggaa aagggaatcc aggtggagct ctactcattc cctagagatc 1441 cagaaatcga gatgagtggt ggcctcgtga atgggagctc tgtcactgta agctgcaagg 1501 ttcctagcgt gtacccccctt gaccggctgg agattgaatt acttaagggg gagactattc 1561 tggagaatat agagttttgt gaggatacgg atatgaaatc tctagagaac aaaagtttgg 1621 aaatgacctt catccctacc attgaagata ctggaaaagc tcttgtttgt caggctaagt 1681 tacatattga tgacatggaa ttcgaaccca aacaaggca gagtacgcaa acactttatg 1741 tcaatgttgc cccagagat acaaccgtct tggtcagccc ttcctccatc ctggaggaag 1801 gcagttctgt gaatatgaca tgcttgagcc agggctttcc tgctccgaaa atcctgtgga
```

-continued

```
1861 gcaggcagct ccctaacggg gagctacagc ctctttctga gaatgcaact ctcaccttaa
1921 tttctacaaa aatggaagat tctggggttt atttatgtga aggaattaac caggctggaa
1981 gaagcagaaa ggaagtggaa ttaattatcc aagttactcc aaaagacata aaacttacag
2041 cttttccttc tgagagtgtc aaagaaggag acactgtcat catctcttgt acatgtggaa
2101 atgttccaga acatggata atcctgaaga aaaagcgga gacaggagac acagtactaa
2161 aatctataga tggcgcctat accatccgaa aggcccagtt gaaggatgcg ggagtatatg
2221 aatgtgaatc taaaaacaaa gttggctcac aattaagaag tttaacactt gatgttcaag
2281 gaagagaaaa caacaaagac tattttttctc ctgagcttct cgtgctctat tttgcatcct
2341 ccttaataat acctgccatt ggaatgataa tttactttgc aagaaaagcc aacatgaagg
2401 ggtcatatag tcttgtagaa gcacagaagt caaaagtgta gctaatgctt gatatgttca
2461 actggagaca ctatttatct gtgcaaatcc ttgatactgc tcatcattcc ttgagaaaaa
2521 caatgagctg agaggcagac ttccctgaat gtattgaact tggaaagaaa tgcccatcta
2581 tgtcccttgc tgtgagcaag aagtcaaagt aaaacttgct gcctgaagaa cagtaactgc
2641 catcaagatg agagaactgg aggagttcct tgatctgtat atacaataac ataatttgta
2701 catatgtaaa ataaaattat gccatagcaa gattgcttaa aatagcaaca ctctatattt
2761 agattgttaa aataactagt gttgcttgga ctattataat ttaatgcatg ttaggaaaat
2821 ttcacattaa tatttgctga cagctgacct ttgtcatctt tcttctattt tattcccttt
2881 cacaaaattt tattcctata tagttttattg acaataattt caggttttgt aaagatgccg
2941 ggttttatat ttttatagac aaataataag caaagggagc actgggttga ctttcaggta
3001 ctaaatacct caacctatgg tataatggtt gactgggttt ctctgtatag tactggcatg
3061 gtacggagat gtttcacgaa gtttgttcat cagactcctg tgcaactttc ccaatgtggc
3121 ctaaaaatgc aacttctttt tatttctttt tgtaaatgtt taggttttttt tgtatagtaa
3181 agtgataatt tctggaatta gaaaaaaaaa aaaaaaaaa
```

Fibronectin (NCBI Ref.: NM_001306129.1; SEQ ID NO: 168)
```
  1 acgcccgcgc cggctgtgct gcacaggggg aggagaggga accccaggcg cgagcgggaa
 61 gaggggacct gcagccacaa cttctctggt cctctgcatc ccttctgtcc ctccacccgt
121 ccccttcccc accctctggc ccccaccttc ttggaggcga caaccccggg gaggcattag
181 aagggatttt tcccgcaggt tgcgaaggga agcaaacttg gtggcaactt gcctcccggt
241 gcggcgtctc ctcccccacc gtctcaacat gcttaggggt ccggggcccg ggctgctgct
301 gctggccgtc cagtgcctgg ggacagcggt gccctccacg ggagcctcga gagcaagag
361 gcaggctcag caaatggttc agccccagtc cccggtggct gtcagtcaaa gcaagcccgg
421 ttgttatgac aatggaaaac actatcagat aaatcaacag tgggagcgga cctacctagg
481 caatgcgttg gtttgtactt gttatggagg aagccgaggt tttaactgcg agagtaaacc
541 tgaagctgaa gagacttgct ttgacaagta cactgggaac acttaccgag tgggtgacac
601 ttatgagcgt cctaaagact ccatgatctg ggactgtacc tgcatcgggg ctgggcgagg
661 gagaataagc tgtaccatcg caaaccgctg ccatgaaggg ggtcagtcct acaagattgg
721 tgacacctgg aggagaccac atgagactgg tggttacatg ttagagtgtg tgtgtcttgg
781 taatggaaaa ggagaatgga cctgcaagcc catagctgag aagtgttttg atcatgctgc
841 tgggacttcc tatgtggtcg agaaacgtg ggagaagccc taccaaggct ggatgatggt
901 agattgtact tgcctgggag aaggcagcgg acgcatcact tgcacttcta gaaatagatg
```

-continued

```
 961 caacgatcag gacacaagga catcctatag aattggagac acctggagca agaaggataa
1021 tcgaggaaac ctgctccagt gcatctgcac aggcaacggc cgaggagagt ggaagtgtga
1081 gaggcacacc tctgtgcaga ccacatcgag cggatctggc cccttcaccg atgttcgtgc
1141 agctgtttac caaccgcagc ctcaccccca gcctcctccc tatggccact gtgtcacaga
1201 cagtggtgtg gtctactctg tggggatgca gtggctgaag acacaaggaa ataagcaaat
1261 gctttgcacg tgcctgggca acggagtcag ctgccaagag acagctgtaa cccagactta
1321 cggtggcaac tcaaatggag agccatgtgt cttaccattc acctacaatg gcaggacgtt
1381 ctactcctgc accacagaag ggcgacagga cggacatctt tggtgcagca caacttcgaa
1441 ttatgagcag gaccagaaat actctttctg cacagaccac actgttttgg ttcagactcg
1501 aggaggaaat tccaatggtg ccttgtgcca cttccccttc ctatacaaca accacaatta
1561 cactgattgc acttctgagg gcagaagaga caacatgaag tggtgtggga ccacacagaa
1621 ctatgatgcc gaccagaagt ttgggttctg ccccatggct gcccacgagg aaatctgcac
1681 aaccaatgaa ggggtcatgt accgcattgg agatcagtgg ataagcagc atgacatggg
1741 tcacatgatg aggtgcacgt gtgttgggaa tggtcgtggg aatggacat gcattgccta
1801 ctcgcagctt cgagatcagt gcattgttga tgacatcact tacaatgtga acgacacatt
1861 ccacaagcgt catgaagagg ggcacatgct gaactgtaca tgcttcggtc agggtcgggg
1921 caggtggaag tgtgatcccg tcgaccaatg ccaggattca gagactggga cgttttatca
1981 aattggagat tcatgggaga agtatgtgca tggtgtcaga taccagtgct actgctatgg
2041 ccgtggcatt ggggagtggc attgccaacc tttacagacc tatccaagct caagtggtcc
2101 tgtcgaagta tttatcactg agactccgag tcagcccaac tcccacccca tccagtggaa
2161 tgcaccacag ccatctcaca tttccaagta cattctcagg tggagaccta aaaattctgt
2221 aggccgttgg aaggaagcta ccataccagg ccacttaaac tcctacacca tcaaaggcct
2281 gaagcctggt gtggtatacg agggccagct catcagcatc cagcagtacg ccaccaaga
2341 agtgactcgc tttgacttca ccaccaccag caccagcaca cctgtgacca gcaacaccgt
2401 gacaggagag acgactccct tttctcctct tgtggccact tctgaatctg tgaccgaaat
2461 cacagccagt agctttgtgg tctcctgggt ctcagcttcc gacaccgtgt cgggattccg
2521 ggtggaatat gagctgagtg aggagggaga tgagccacag tacctggatc ttccaagcac
2581 agccacttct gtgaacatcc ctgacctgct tcctggccga aaatacattg taaatgtcta
2641 tcagatatct gaggatgggg agcagagttt gatcctgtct acttcacaaa caacagcgcc
2701 tgatgcccct cctgacccga ctgtggacca agttgatgac acctcaattg ttgttcgctg
2761 gagcagaccc caggctccca tcacagggta cagaatagtc tattcgccat cagtagaagg
2821 tagcagcaca gaactcaacc ttcctgaaac tgcaaactcc gtcaccctca gtgacttgca
2881 acctggtgtt cagtataaca tcactatcta tgctgtggaa gaaaatcaag aaagtacacc
2941 tgttgtcatt caacaagaaa ccactggcac cccacgctca gatacagtgc cctctcccag
3001 ggacctgcag tttgtggaag tgacagacgt gaaggtcacc atcatgtgga caccgcctga
3061 gagtgcagtg accggctacc gtgtggatgt gatccccgtc aacctgcctg cgagcacgg
3121 gcagaggctg cccatcagca ggaacaccct tgcagaagtc accgggctgt cccctggggt
3181 cacctattac ttcaaagtct ttgcagtgag ccatgggagg gagagcaagc ctctgactgc
3241 tcaacagaca accaaactgg atgctcccac taacctccag tttgtcaatg aaactgattc
3301 tactgtcctg gtgagatgga ctccacctcg ggcccagata acaggatacc gactgaccgt
3361 gggccttacc cgaagaggac agcccaggca gtacaatgtg ggtccctctg tctccaagta
```

-continued

```
3421 cccactgagg aatctgcagc ctgcatctga gtacaccgta tccctcgtgg ccataaaggg
3481 caaccaagag agcccaaag ccactggagt ctttaccaca ctgcagcctg ggagctctat
3541 tccaccttac aacaccgagg tgactgagac caccattgtg atcacatgga cgcctgctcc
3601 aagaattggt tttaagctgg gtgtacgacc aagccaggga ggagaggcac cacgagaagt
3661 gacttcagac tcaggaagca tcgttgtgtc cggcttgact ccaggagtag aatacgtcta
3721 caccatccaa gtcctgagag atggacagga aagagatgcg ccaattgtaa acaaagtggt
3781 gacaccattg tctccaccaa caaacttgca tctggaggca aaccctgaca ctggagtgct
3841 cacagtctcc tgggagagga gcaccacccc agacattact ggttatagaa ttaccacaac
3901 ccctacaaac ggccagcagg gaaattcttt ggaagaagtg gtccatgctg atcagagctc
3961 ctgcactttt gataacctga gtcccggcct ggagtacaat gtcagtgttt acactgtcaa
4021 ggatgacaag gaaagtgtcc ctatctctga taccatcatc ccagaggtgc cccaactcac
4081 tgacctaagc tttgttgata taccgattc aagcatcggc ctgaggtgga ccccgctaaa
4141 ctcttccacc attattgggt accgcatcac agtagttgcg gcaggagaag gtatccctat
4201 ttttgaagat tttgtggact cctcagtagg atactacaca gtcacagggc tggagccggg
4261 cattgactat gatatcagcg ttatcactct cattaatggc ggcgagagtg cccctactac
4321 actgacacaa caaacggctg ttcctcctcc cactgacctg cgattcacca acattggtcc
4381 agacaccatg cgtgtcacct gggctccacc cccatccatt gatttaacca acttcctggt
4441 gcgttactca cctgtgaaaa atgaggaaga tgttgcagag ttgtcaattt ctccttcaga
4501 caatgcagtg gtcttaacaa atctcctgcc tggtacagaa tatgtagtga gtgtctccag
4561 tgtctacgaa caacatgaga gcacacctct tagaggaaga cagaaaacag gtcttgattc
4621 cccaactggc attgactttt ctgatattac tgccaactct tttactgtgc actggattgc
4681 tcctcgagcc accatcactg gctacaggat ccgccatcat cccgagcact tcagtgggag
4741 acctcgagaa gatcgggtgc ccactctcg gaattccatc accctcacca acctcactcc
4801 aggcacagat tatgtggtca gcatcgttgc tcttaatggc agagaggaaa gtcccttatt
4861 gattggccaa caatcaacag tttctgatgt tccgagggac ctggaagttg ttgctgcgac
4921 ccccaccagc ctactgatca gctgggatgc tcctgctgtc acagtgagat attacaggat
4981 cacttacgga gagacaggag gaaatagccc tgtccaggag ttcactgtgc ctgggagcaa
5041 gtctacagct accatcagcg gccttaaacc tggagttgat tataccatca ctgtgtatgc
5101 tgtcactggc cgtggagaca gccccgcaag cagcaagcca atttccatta ttaccgaac
5161 agaaattgac aaaccatccc agatgcaagt gaccgatgtt caggacaaca gcattagtgt
5221 caagtggctg ccttcaagtt cccctgttac tggttacaga gtaaccacca ctcccaaaaa
5281 tggaccagga ccaacaaaaa ctaaaactgc aggtccagat caaacagaaa tgactattga
5341 aggcttgcag cccacagtgg agtatgtggt tagtgtctat gctcagaatc caagcggaga
5401 gagtcagcct ctggttcaga ctgcagtaac caacattgat cgccctaaag gactggcatt
5461 cactgatgtg gatgtcgatt ccatcaaaat tgcttgggaa agcccacagg ggcaagtttc
5521 caggtacagg gtgacctact cgagccctga ggatggaatc catgagctat ccctgcacc
5581 tgatggtgaa gaagacactg cagagctgca aggcctcaga ccgggttctg agtacacagt
5641 cagtgtggtt gccttgcacg atgatatgga gagccagccc ctgattggaa cccagtccac
5701 agctattcct gcaccaactg acctgaagtt cactcaggtc acaccacaa gcctgagcgc
5761 ccagtggaca ccacccaatg ttcagctcac tggatatcga gtgcgggtga cccccaagga
```

-continued

```
5821 gaagaccgga ccaatgaaag aaatcaacct tgctcctgac agctcatccg tggttgtatc 5881 aggacttatg gtggccacca aatatgaagt gagtgtctat gctcttaagg acactttgac 5941 aagcagacca gctcagggag ttgtcaccac tctggagaat gtcagccac caagaagggc 6001 tcgtgtgaca gatgctactg agaccaccat caccattagc tggagaacca agactgagac 6061 gatcactggc ttccaagttg atgccgttcc agccaatggc cagactccaa tccagagaac 6121 catcaagcca gatgtcagaa gctacaccat cacaggttta caaccaggca ctgactacaa 6181 gatctacctg tacaccttga atgacaatgc tcggagctcc cctgtggtca tcgacgcctc 6241 cactgccatt gatgcaccat ccaacctgcg tttcctggcc accacaccca attccttgct 6301 ggtatcatgg cagccgccac gtgccaggat taccggctac atcatcaagt atgagaagcc 6361 tgggtctcct cccagagaag tggtccctcg gccccgccct ggtgtcacag aggctactat 6421 tactggcctg gaaccgggaa ccgaatatac aatttatgtc attgccctga gaataatca 6481 gaagagcgag cccctgattg aaggaaaaa gacagacgag cttccccaac tggtaaccct 6541 tccacacccc aatcttcatg gaccagagat cttggatgtt ccttccacag ttcaaaagac 6601 ccctttcgtc acccaccctg ggtatgacac tggaaatggt attcagcttc ctggcacttc 6661 tggtcagcaa cccagtgttg ggcaacaaat gatctttgag gaacatggtt ttaggcggac 6721 cacaccgccc acaacggcca ccccataag gcataggcca agaccatacc cgccgaatgt 6781 aggacaagaa gctctctctc agacaaccat ctcatgggcc ccattccagg acacttctga 6841 gtacatcatt tcatgtcatc ctgttggcac tgatgaagaa cccttacagt tcagggttcc 6901 tggaacttct accagtgcca ctctgacagg cctcaccaga ggtgccacct acaacatcat 6961 agtggaggca ctgaaagacc agcagaggca taaggttcgg aagaggttg ttaccgtggg 7021 caactctgtc aacgaaggct tgaaccaacc tacggatgac tcgtgctttg accctacac 7081 agtttcccat tatgccgttg gagatgagtg ggaacgaatg tctgaatcag gctttaaact 7141 gttgtgccag tgcttaggct ttggaagtgg tcatttcaga tgtgattcat ctagatggtg 7201 ccatgacaat ggtgtgaact acaagattgg agagaagtgg gaccgtcagg gagaaaatgg 7261 ccagatgatg agctgcacat gtcttgggaa cggaaaagga gaattcaagt gtgaccctca 7321 tgaggcaacg tgttatgatg atgggaagac ataccacgta ggagaacagt ggcagaagga 7381 atatctcggt gccatttgct cctgcacatg ctttggaggc cagcggggct ggcgctgtga 7441 caactgccgc agacctgggg gtgaacccag tcccgaaggc actactggcc agtcctacaa 7501 ccagtattct cagagatacc atcagagaac aaacactaat gttaattgcc caattgagtg 7561 cttcatgcct ttagatgtac aggctgacag agaagattcc cgagagtaaa tcatctttcc 7621 aatccagagg aacaagcatg tctctctgcc aagatccatc taaactggag tgatgttagc 7681 agacccagct tagagttctt ctttctttct taagcccttt gctctggagg aagttctcca 7741 gcttcagctc aactcacagc ttctccaagc atcccctgg gagtttcctg agggttttct 7801 cataaatgag ggctgcacat tgcctgttct gcttcgaagt attcaatacc gctcagtatt 7861 ttaaatgaag tgattctaag atttggtttg ggatcaatag gaaagcatat gcagccaacc 7921 aagatgcaaa tgtttttgaaa tgatatgacc aaaattttaa gtaggaaagt cacccaaaca 7981 cttctgcttt cacttaagtg tctggcccgc aatactgtag gaacaagcat gatcttgtta 8041 ctgtgatatt ttaaatatcc acagtactca ctttttccaa atgatcctag taattgccta 8101 gaaatatctt tctcttacct gttatttatc aattttccc agtatttta tacggaaaaa 8161 attgtattga aaacacttag tatgcagttg ataagaggaa tttggtataa ttatggtggg 8221 tgattatttt ttatactgta tgtgccaaag ctttactact gtggaaagac aactgttta
```

-continued

```
8281 ataaaagatt tacattccac aacttgaagt tcatctattt gatataagac accttcgggg 8341 gaaataattc ctgtgaatat tcttttttcaa ttcagcaaac atttgaaaat ctatgatgtg 8401 caagtctaat tgttgatttc agtacaagat tttctaaatc agttgctaca aaaactgatt 8461 ggtttttgtc acttcatctc ttcactaatg gagatagctt tacactttct gctttaatag 8521 atttaagtgg accccaatat ttattaaaat tgctagttta ccgttcagaa gtataataga 8581 aataatctttt agttgctctt ttctaaccat tgtaattctt cccttcttcc ctccaccttt 8641 ccttcattga ataaacctct gttcaaagag attgcctgca agggaaataa aaatgactaa 8701 gatattaaaa gtatttgaat agtaaaaaaa aaaaaaaaaa aa
```

Vitronectin (NCBI Ref.: NM_000638.3; SEQ ID NO: 169)

```
   1 gagcaaacag agcagcagaa aaggcagttc ctcttctcca gtgccctcct tccctgtctc 61 tgcctctccc tcccttcctc aggcatcaga gcggagactt cagggagacc agagcccagc 121 ttgccaggca ctgagctaga agccctgcca tggcacccct gagacccctt ctcatactgg 181 ccctgctggc atgggttgct ctggctgacc aagagtcatg caagggccgc tgcactgagg 241 gcttcaacgt ggacaagaag tgccagtgtg acgagtctg ctcttactac cagagctgct 301 gcacagacta tacggctgag tgcaagcccc aagtgactcg cggggatgtg ttcactatgc 361 cggaggatga gtacacggtc tatgacgatg gcgaggagaa aaacaatgcc actgtccatg 421 aacaggtggg gggcccctcc ctgacctctg acctccaggc ccagtccaaa gggaatcctg 481 agcagacacc tgttctgaaa cctgaggaag aggcccctgc gcctgaggtg ggcgcctcta 541 agcctgaggg gatagactca aggcctgaga cccttcatcc agggagacct cagcccccag 601 cagaggagga gctgtgcagt gggaagccct tcgacgcctt caccgacctc aagaacggtt 661 ccctctttgc cttccgaggg cagtactgct atgaactgga cgaaaaggca gtgaggcctg 721 ggtaccccaa gctcatccga gatgtctggg gcatcgaggg ccccatcgat gccgccttca 781 cccgcatcaa ctgtcagggg aagacctacc tcttcaaggg tagtcagtac tggcgctttg 841 aggatggtgt cctggaccct gattaccccc gaaatatctc tgacggcttc gatggcatcc 901 cggacaacgt ggatgcagcc ttggccctcc ctgcccatag ctacagtggc cgggagcggg 961 tctacttctt caaggggaaa cagtactggg agtaccagtt ccagcaccag cccagtcagg 1021 aggagtgtga aggcagctcc ctgtcggctg tgtttgaaca cttggcatg atgcagcggg 1081 acagctggga ggacatcttc gagcttctct tctggggcag aacctctgct ggtaccagac 1141 agccccagtt cattagccgg gactggcacg gtgtgccagg gcaagtggac gcagccatgg 1201 ctggccgcat ctacatctca ggcatggcac ccgcccctc cttggccaag aaacaaaggt 1261 ttaggcatcg caaccgcaaa ggctaccgtt cacaacgagg ccacagccgt ggccgcaacc 1321 agaactcccg ccggccatcc cgcgccacgt ggctgtcctt gttctccagt gaggagagca 1381 acttgggagc caacaactat gatgactaca ggatggactg gcttgtgcct gccacctgtg 1441 aacccatcca gagtgtcttc ttcttctctg agacaagta ctaccgagtc aatcttcgca 1501 cacggcgagt ggacactgtg gaccctccct acccacgctc catcgctcag tactggctgg 1561 gctgcccagc tcctggccat ctgtaggagt cagagcccac atggccgggc cctctgtagc 1621 tccctcctcc catctccttc ccccagccca ataaaggtcc cttagccccg agtttaaa
```

Tenascin-C (NCBI Ref.: NM_002160.3; SEQ ID NO: 170)

```
  1 aattcgccaa ctgaaaaagt gggaaaggat gtctggaggc gaggcgtccc attacagagg 61 aaggagctcg ctatataagc cagccaaagt tggctgcacc ggccacagcc tgcctactgt
```

-continued

```
 121 cacccgcctc tcccgcgcgc agatacacgc ccccgcctcc gtgggcacaa aggcagcgct
 181 gctggggaac tcgggggaac gcgcacgtgg gaaccgccgc agctccacac tccaggtact
 241 tcttccaagg acctaggtct ctcgcccatc ggaaagaaaa taattctttc aagaagatca
 301 gggacaactg atttgaagtc tactctgtgc ttctaaatcc ccaattctgc tgaaagtgag
 361 atacccctaga gccctagagc cccagcagca cccagccaaa cccacctcca ccatggggc
 421 catgactcag ctgttggcag gtgtctttct tgctttcctt gccctcgcta ccgaaggtgg
 481 ggtcctcaag aaagtcatcc ggcacaagcg acagagtggg gtgaacgcca ccctgccaga
 541 agagaaccag ccagtggtgt ttaaccacgt ttacaacatc aagctgccag tgggatccca
 601 gtgttcggtg gatctggagt cagccagtgg ggagaaagac ctggcaccgc cttcagagcc
 661 cagcgaaagc tttcaggagc acacagtgga tggggaaaac cagattgtct tcacacatcg
 721 catcaacatc ccccgccggg cctgtggctg tgccgcagcc cctgatgtta aggagctgct
 781 gagcagactg gaggagctgg agaacctggt gtcttccctg agggagcaat gtactgcagg
 841 agcaggctgc tgtctccagc ctgccacagg ccgcttggac accaggccct tctgtagcgg
 901 tcggggcaac ttcagcactg aaggatgtgg ctgtgtctgc gaacctggct ggaaaggccc
 961 caactgctct gagcccgaat gtccaggcaa ctgtcacctt cgaggccggt gcattgatgg
1021 gcagtgcatc tgtgacgacg gcttcacggg cgaggactgc agccagctgg cttgccccag
1081 cgactgcaat gaccagggca gtgcgtaaa tggagtctgc atctgtttcg aaggctacgc
1141 cggggctgac tgcagccgtg aaatctgccc agtgccctgc agtgaggagc acggcacatg
1201 tgtagatggc ttgtgtgtgt ccacgatgg ctttgcaggc gatgactgca acaagcctct
1261 gtgtctcaac aattgctaca accgtggacg atgcgtggag aatgagtgcg tgtgtgatga
1321 gggtttcacg ggcgaagact gcagtgagct catctgcccc aatgactgct cgaccgggg
1381 ccgctgcatc aatggcacct gctactgcga agaaggcttc acaggtgaag actgcgggaa
1441 acccacctgc ccacatgcct gccacaccca gggccggtgt gaggagggc agtgtgtatg
1501 tgatgagggc tttgccggtg tggactgcag cgagaagagg tgtcctgctg actgtcacaa
1561 tcgtggccgt gtgtagacg ggcggtgtga gtgtgatgat ggtttcactg gagctgactg
1621 tgggagctc aagtgtccca atggctgcag tggccatggc cgctgtgtca atgggcagtg
1681 tgtgtgtgat gagggctata ctggggagga ctgcagccag ctacggtgcc ccaatgactg
1741 tcacagtcgg ggccgctgtg tcgagggcaa atgtgtatgt gagcaaggct tcaagggcta
1801 tgactgcagt gacatgagct gccctaatga ctgtcaccag cacggccgct gtgtgaatgg
1861 catgtgtgtt tgtgatgacg gctacacagg ggaagactgc cgggatcgcc aatgccccag
1921 ggactgcagc aacagggggcc tctgtgtgga cggacagtgc gtctgtgagg acggcttcac
1981 cggccctgac tgtgcagaac tctcctgtcc aaatgactgc catggccagg tcgctgtgt
2041 gaatgggcag tgcgtgtgcc atgaaggatt tatgggcaaa gactgcaagg agcaaagatg
2101 tcccagtgac tgtcatggcc agggccgctg cgtggacggc cagtgcatct gccacgaggg
2161 cttcacaggc ctggactgtg ccagcactc ctgccccagt gactgcaaca acttaggaca
2221 atgcgtctcg ggccgctgca tctgcaacga gggctacagc ggagaagact gctcagaggt
2281 gtctcctccc aaagacctcg ttgtgacaga agtgacggaa gagacggtca acctggcctg
2341 ggacaatgag atgcgggtca cagagtacct tgtcgtgtac acgcccaccc acgagggtgg
2401 tctggaaatg cagttccgtg tgcctgggga ccagacgtcc accatcatcc aggagctgga
2461 gcctggtgtg gagtacttta tccgtgtatt tgccatcctg gagaacaaga gagcattcc
2521 tgtcagcgcc agggtggcca cgtacttacc tgcacctgaa ggcctgaaat tcaagtccat
```

```
2581 caaggagaca tctgtggaag tggagtggga tcctctagac attgcttttg aaacctggga
2641 gatcatcttc cggaatatga ataaagaaga tgagggagag atcaccaaaa gcctgaggag
2701 gccagagacc tcttaccggc aaactggtct agctcctggg caagagtatg agatatctct
2761 gcacatagtg aaaaacaata cccgggggcc tggcctgaag agggtgacca ccacacgctt
2821 ggatgccccc agccagatcg aggtgaaaga tgtcacagac accactgcct tgatcacctg
2881 gttcaagccc ctggctgaga tcgatggcat tgagctgacc tacggcatca agacgtgcc
2941 aggagaccgt accaccatcg atctcacaga ggacgagaac cagtactcca tcgggaacct
3001 gaagcctgac actgagtacg aggtgtccct catctcccgc agaggtgaca tgtcaagcaa
3061 cccagccaaa gagaccttca acacaggcct cgatgctccc aggaatcttc gacgtgtttc
3121 ccagacagat aacagcatca ccctggaatg gaggaatggc aaggcagcta ttgacagtta
3181 cagaattaag tatgccccca tctctggagg ggaccacgct gaggttgatg ttccaaagag
3241 ccaacaagcc acaaccaaaa ccacactcac aggtctgagg ccgggaactg aatatgggat
3301 tggagttttct gctgtgaagg aagacaagga gagcaatcca gcgaccatca acgcagccac
3361 agagttggac acgcccaagg accttcaggt ttctgaaact gcagagacca gcctgaccct
3421 gctctggaag acaccgttgg ccaaatttga ccgctaccgc ctcaattaca gtctccccac
3481 aggccagtgg gtgggagtgc agcttccaag aaacaccact tcctatgtcc tgagaggcct
3541 ggaaccagga caggagtaca atgtcctcct gacagccgag aaaggcagac acaagagcaa
3601 gcccgcacgt gtgaaggcat ccactgaaca agcccctgag ctggaaaacc tcaccgtgac
3661 tgaggttggc tgggatggcc tcagactcaa ctggaccgca gctgaccagg cctatgagca
3721 ctttatcatt caggtgcagg aggccaacaa ggtggaggca gctcggaacc tcaccgtgcc
3781 tggcagcctt cgggctgtgg acataccggg cctcaaggct gctacgcctt atacagtctc
3841 catctatggg gtgatccagg ctatagaac accagtgctc tctgctgagg cctccacagg
3901 ggaaactccc aatttgggag aggtcgtggt ggccgaggtg ggctgggatg ccctcaaact
3961 caactggact gctccagaag gggcctatga gtacttttc attcaggtgc aggaggctga
4021 cacagtagag gcagcccaga acctcaccgt cccaggagga ctgaggtcca cagacctgcc
4081 tgggctcaaa gcagccactc attataccat caccatccgc ggggtcactc aggacttcag
4141 cacaacccct ctctctgttg aagtcttgac agaggaggtt ccagatatgg aaacctcac
4201 agtgaccgag gttagctggg atgctctcag actgaactgg accacgccag atggaaccta
4261 tgaccagttt actattcagg tccaggaggc tgaccaggtg gaagaggctc acaatctcac
4321 ggttcctggc agcctgcgtt ccatggaaat cccaggcctc agggctggca ctccttacac
4381 agtcacccctg cacggcgagg tcaggggcca cagcactcga ccccttgctg tagaggtcgt
4441 cacagaggat ctcccacagc tgggagattt agccgtgtct gaggttggct gggatggcct
4501 cagactcaac tggaccgcag ctgacaatgc ctatgagcac tttgtcattc aggtgcagga
4561 ggtcaacaaa gtggaggcag cccagaacct cacgttgcct ggcagcctca gggctgtgga
4621 catcccgggc ctcgaggctg ccacgcctta tagagtctcc atctatgggg tgatccgggg
4681 ctatagaaca ccagtactct ctgctgaggc ctccacagcc aaagaacctg aaattggaaa
4741 cttaaatgtt tctgacataa ctcccgagag cttcaatctc tcctggatgg ctaccgatgg
4801 gatcttcgag acctttacca ttgaaattat tgattccaat aggttgctgg agactgtgga
4861 atataatatc tctggtgctg aacgaactgc ccatatctca gggctacccc ctagtactga
4921 tttttattgtc tacctctctg gacttgctcc cagcatccgg accaaaacca tcagtgccac
```

-continued

```
4981 agccacgaca gaggccctgc cccttctgga aaacctaacc atttccgaca ttaatcccta
5041 cgggttcaca gtttcctgga tggcatcgga gaatgccttt gacagctttc tagtaacggt
5101 ggtggattct gggaagctgc tggaccccca ggaattcaca ctttcaggaa cccagaggaa
5161 gctggagatt agaggcctca taactggcat tggctatgag gttatggtct ctggcttcac
5221 ccaagggcat caaaccaagc ccttgagggc tgagattgtt acagaagccg aaccggaagt
5281 tgacaacctt ctggtttcag atgccacccc agacggtttc cgtctgtcct ggacagctga
5341 tgaaggggtc ttcgacaatt ttgttctcaa aatcagagat accaaaaagc agtctgagcc
5401 actggaaata accctacttg cccccgaacg taccagggac ataacaggtc tcagagaggc
5461 tactgaatac gaaattgaac tctatggaat aagcaaagga aggcgatccc agacagtcag
5521 tgctatagca acaacagcca tgggctcccc aaaggaagtc atttctcag acatcactga
5581 aaattcggct actgtcagct ggagggcacc cacagcccaa gtggagagct tccggattac
5641 ctatgtgccc attacaggag gtacaccctc catggtaact gtggacggaa ccaagactca
5701 gaccaggctg gtgaaactca tacctggcgt ggagtacctt gtcagcatca tcgccatgaa
5761 gggctttgag gaaagtgaac ctgtctcagg gtcattcacc acagctctgg atggcccatc
5821 tggcctggtg acagccaaca tcactgactc agaagccttg gccaggtggc agccagccat
5881 tgccactgtg gacagttatg tcatctccta cacaggcgag aaagtgccag aaattacacg
5941 cacggtgtcc gggaacacag tggagtatgc tctgaccgac ctcgagcctg ccacggaata
6001 cacactgaga atctttgcag agaaagggcc ccagaagagc tcaaccatca ctgccaagtt
6061 cacaacagac ctcgattctc caagagactt gactgctact gaggttcagt cggaaactgc
6121 cctccttacc tggcgacccc cccgggcatc agtcaccggt tacctgctgg tctatgaatc
6181 agtggatggc acagtcaagg aagtcattgt gggtccagat accacctcct acagcctggc
6241 agacctgagc ccatccaccc actacacagc caagatccag gcactcaatg gcccctgag
6301 gagcaatatg atccagacca tcttcaccac aaattggactc ctgtacccct tccccaagga
6361 ctgctcccaa gcaatgctga atggagacac gacctctggc ctctacacca tttatctgaa
6421 tggtgataag gctgaggcgc tggaagtctt ctgtgacatg acctctgatg gggtggatg
6481 gattgtgttc ctgagacgca aaaacggacg cgagaacttc taccaaaact ggaaggcata
6541 tgctgctgga tttggggacc gcagagaaga attctggctt gggctggaca acctgaacaa
6601 aatcacagcc caggggcagt acgagctccg ggtggacctg cgggaccatg gggagacagc
6661 ctttgctgtc tatgacaagt tcagcgtggg agatgccaag actcgctaca agctgaaggt
6721 ggaggggtac agtgggacag caggtgactc catggcctac cacaatggca gatccttctc
6781 cacctttgac aaggacacag attcagccat caccaactgt gctctgtcct acaaaggggc
6841 tttctggtac aggaactgtc accgtgtcaa cctgatgggg agatatgggg acaataacca
6901 cagtcagggc gttaactggt tccactggaa gggccacgaa cactcaatcc agtttgctga
6961 gatgaagctg agaccaagca acttcagaaa tcttgaaggc aggcgcaaac gggcataaat
7021 tccaggacc actgggtgag agaggaataa ggcccagagc gaggaaagga ttttaccaaa
7081 gcatcaatac aaccagccca accatcggtc cacacctggg catttggtga gagtcaaagc
7141 tgaccatgga tccctgggc caacggcaac agcatgggcc tcacctcctc tgtgatttct
7201 ttctttgcac caaagacatc agtctccaac atgtttctgt tttgttgttt gattcagcaa
7261 aaatctccca gtgacaacat cgcaatagtt ttttacttct cttaggtggc tctgggaatg
7321 ggagaggggt aggatgtaca gggtagtttt gtttagaac cagccgtatt ttacatgaag
7381 ctgtataatt aattgtcatt attttttgtta gcaaagatta aatgtgtcat tggaagccat
```

-continued

```
7441 ccctttttttt acatttcata caacagaaac cagaaaagca atactgtttc cattttaagg
7501 atatgattaa tattattaat ataataatga tgatgatgat gatgaaaact aaggattttt
7561 caagagatct ttcttttccaa aacatttctg dacagtacct gattgtattt tttttttaaa
7621 taaaagcaca agtactttgt agtttgttat tttgctttga attgttgagt ctgaatttca
7681 ccaaagccaa tcatttgaac aaagcgggga atgttgggat aggaaaggta agtagggata
7741 gtggtcaagt gggaggggtg gaaaggagac taaagactgg gagagaggga agcactttt
7801 ttaaataaag ttgaacacac ttgggaaaag cttacaggcc aggcctgtaa tcccaacact
7861 ttgggaggcc aaggtgggag gatagcttaa ccccaggagt ttgagaccag cctgagcaac
7921 atagtgagaa cttgtctcta cagaaaaaaa aaaaaaaaaa aatttaatta ggcaagcgtg
7981 gtagtgcgca cctgtcgtcc cagctactca ggaggctgag gtaggaaaat cactggagcc
8041 caggagttag aggttacagt gagctatgat cacactactg cactccagcc tgggcaacag
8101 agggagaccc tgtctctaaa taaaaaaaga aaagaaaaaa aaagcttaca acttgagatt
8161 cagcatcttg ctcagtatttt ccaagactaa tagattatgg tttaaaagat gcttttatac
8221 tcattttcta atgcaactcc tagaaactct atgatatagt tgaggtaagt attgttacca
8281 cacatgggct aagatcccca gaggcagact gcctgagttc aattcttggc tccaccattc
8341 ccaagttccc taacctctct atgcctcagt ttcctcttct gtaaagtagg gacactcata
8401 cttctcattt cagaacatt ttgtgaagaa taaattatgt tatccatttg aggcccttag
8461 aatggtaccc ggtgtatatt aagtgctagt acatgttagc tatcatcatt atcactttat
8521 atgagatgga ctggggttca tagaaaccca atgacttgat tgtggctact actcaataaa
8581 taatagaatt tggatttaaa aaaaa
```

Osteopontin
(NCBI Ref.: NM_000582.2; SEQ ID NO: 171)
```
   1 ctccctgtgt tggtggagga tgtctgcagc agcatttaaa ttctgggagg gcttggttgt
  61 cagcagcagc aggaggaggc agagcacagc atcgtcggga ccagactcgt ctcaggccag
 121 ttgcagcctt ctcagccaaa cgccgaccaa ggaaaactca ctaccatgag aattgcagtg
 181 atttgctttt gcctcctagg catcacctgt gccataccag ttaaacaggc tgattctgga
 241 agttctgagg aaaagcagct ttacaacaaa tacccagatg ctgtggccac atggctaaac
 301 cctgacccat ctcagaagca gaatctccta gccccacaga cccttccaag taagtccaac
 361 gaaagccatg accacatgga tgatatggat gatgaagatg atgatgacca tgtggacagc
 421 caggactcca ttgactcgaa cgactctgat gatgtagatg acactgatga ttctcaccag
 481 tctgatgagt ctcaccattc tgatgaatct gatgaactgg tcactgattt tcccacggac
 541 ctgccagcaa ccgaagtttt cactccagtt gtccccacag tagacacata tgatggccga
 601 ggtgatagtg tggtttatgg actgaggtca aaatctaaga agtttcgcag acctgacatc
 661 cagtaccctg atgctacaga cgaggacatc acctcacaca tggaaagcga ggagttgaat
 721 ggtgcataca aggccatccc cgttgcccag gacctgaacg cgccttctga ttgggacagc
 781 cgtgggaagg acagttatga aacgagtcag ctggatgacc agagtgctga accecacagc
 841 cacaagcagt ccagattata taagcggaaa gccaatgatg agagcaatga gcattccgat
 901 gtgattgata tccaggaact ttccaaagtc agccgtgaat tccacagcca tgaatttcac
 961 agccatgaag atatgctggt tgtagacccc aaaagtaagg aagaagataa acacctgaaa
1021 tttcgtattt ctcatgaatt agatagtgca tcttctgagg tcaattaaaa ggagaaaaaa
1081 tacaatttct cactttgcat ttagtcaaaa gaaaaaatgc tttatagcaa aatgaaagag
```

-continued

```
1141 aacatgaaat gcttctttct cagtttattg gttgaatgtg tatctatttg agtctggaaa 1201 taactaatgt gtttgataat tagtttagtt tgtggcttca tggaaactcc ctgtaaacta 1261 aaagcttcag ggttatgtct atgttcattc tatagaagaa atgcaaacta tcactgtatt 1321 ttaatatttg ttattctctc atgaatagaa atttatgtag aagcaaacaa aatactttta 1381 cccacttaaa aagagaatat aacattttat gtcactataa tcttttgttt tttaagttag 1441 tgtatatttt gttgtgatta tcttttttgtg gtgtgaataa atcttttatc ttgaatgtaa 1501 taagaatttg gtggtgtcaa ttgcttattt gttttcccac ggttgtccag caattaataa 1561 aacataacct tttttactgc ctaaaaaaaa aaaaaaaaa aaaaaaaaaa aaaaaa
```

Nephronectin (NCBI Ref.: NM_001033047.2; SEQ ID NO: 172)

```
   1 tagaagggag cgggaggggg ctccgggcgc cgcgcagcag acctgctccg gccgcgcgcc 61 tcgccgctgt cctccgggag cggcagcagt agcccgggcg gcgagggctg ggggttcctc 121 gagactctca gagggcgcc tcccatcggc gcccaccacc ccaacctgtt cctcgcgcgc 181 cactgcgctg cgcccagga cccgctgccc aacatggatt ttctcctggc gctggtgctg 241 gtatcctcgc tctacctgca ggcggccgcc gagttcgacg ggaggtggcc caggcaaata 301 gtgtcatcga ttggcctatg tcgttatggt gggaggattg actgctgctg gggctgggct 361 cgccagtctt ggggacagtg tcagcctgtg tgccaaccac gatgcaaaca tggtgaatgt 421 atcgggccaa acaagtgcaa gtgtcatcct ggttatgctg gaaaaacctg taatcaagat 481 ctaaatgagt gtggcctgaa gccccggccc tgtaagcaca ggtgcatgaa cacttacggc 541 agctacaagt gctactgtct caacggatat atgctcatgc cggatggttc ctgctcaagt 601 gccctgacct gctccatggc aaactgtcag tatggctgtg atgttgttaa aggacaaata 661 cggtgccagt gcccatcccc tggcctgcag ctggctcctg atgggaggac ctgtgtagat 721 gttgatgaat gtgctacagg aagagcctcc tgccctagat ttaggcaatg tgtcaacact 781 tttgggagct acatctgcaa gtgtcataaa ggcttcgatc tcatgtatat tggaggcaaa 841 tatcaatgtc atgacataga cgaatgctca cttggtcagt atcagtgcag cagctttgct 901 cgatgttata acatacgtgg gtcctacaag tgcaaatgta agaaggata ccagggtgat 961 ggactgactt gtgtgtatat cccaaaagtt atgattgaac cttcaggtcc aattcatgta 1021 ccaaagggaa atggtaccat tttaaagggt gacacaggaa ataataattg gattcctgat 1081 gttggaagta cttggtggcc tccgaagaca ccatatattc ctcctatcat taccaacagg 1141 cctacttcta agccaacaac aagacctaca ccaaagccaa caccaattcc tactccacca 1201 ccaccaccac ccctgccaac agagctcaga acacctctac cacctacaac cccagaaagg 1261 ccaaccaccg gactgacaac tatagcacca gctgccagta cacctccagg agggattaca 1321 gttgacaaca gggtacagac agaccctcag aaacccagag gagatgtgtt cattccacgg 1381 caaccttcaa atgacttgtt tgaaatattt gaaatagaaa gaggagtcag tgcagacgat 1441 gaagcaaagg atgatccagg tgttctggta cacagttgta attttgacca tggactttgt 1501 ggatggatca gggagaaaga caatgacttg cactgggaac caatcaggga cccagcaggt 1561 ggacaatatc tgacagtgtc ggcagccaaa gccccagggg gaaaagctgc acgcttggtg 1621 ctacctctcg gccgcctcat gcattcaggg gacctgtgcc tgtcattcag gcacaaggtg 1681 acggggctgc actctggcac actccaggtg tttgtgagaa acacggtgc ccacggagca 1741 gccctgtggg gaagaaatgg tggccatggc tggaggcaaa cacagatcac cttgcgaggg 1801 gctgacatca agagcgtcgt cttcaaaggt gaaaaaggc gtggtcacac tggggagatt 1861 ggattagatg atgtgagctt gaaaaaaggc cactgctctg aagaacgcta acaactccag
```

```
1921 aactaacaat gaactcctat gttgctctat cctctttttc caattctcat cttctctcct
1981 cttctccctt ttatcaggcc taggagaaga gtgggtcagt gggtcagaag gaagtctatt
2041 tggtgaccca ggttttttctg gcctgctttt gtgcaatccc aatgaacagt gataccctcc
2101 ttgaaataca ggggcatcgc agacacatca aagccatctg tgggtgttgc cttccatcct
2161 gtgtctcttt caggaaggca ttcagcatgc gtgagccata ccatcctcca tcctgattac
2221 aaggtgctcc ttgtagcaaa ttatgagagt gagttacggg agcagttttt aaaagaaatc
2281 tttgcagatg gctatgatgt tatgtgttcg gtgttgtacc atgagtagta ttgacttccc
2341 ttgagatatg atgtacaatg tgcttgtgaa attgacttac cctcttcact taagttagtt
2401 ctggcctgac ctgaactctg acttttactg ccattcactt tataaaataa gggtgtgtaa
2461 catatcaaga tacatttatt tttatctgtt ttttttttcc tgttaaagac aattatgtag
2521 agtgggcacg taatccctcc ttagtagtat tgtgttttgt gtaaatgtgc tattgatatt
2581 aagtatttac atgttccaaa tatttacaga ctctagttgc aaggtaaagg gcagcttgtg
2641 atctcaaaaa aatacatggt gaaatgtcat ccagttccat gaccttatat tggcagcagt
2701 aggaaattgg cagaagtgtt gggttgtggt aacggagtga tgaattttt tttaatggcc
2761 ttgagtttga tctctgcaaa ggataggaaa cctttaggaa gacaagaaac tgcagttaat
2821 ttagaactgt cactgtttca agttacactt taaaaccaca gcttttacca tcataacatg
2881 gctctggtaa tatgtaggaa gctttataaa agttttggtt gattcagaaa aaggatcctg
2941 ttgcagagtg agaggaagca tagggggaaa ctccattgga acagattttc acacaacgtt
3001 ttaaattgat ataagtttag gcagttgtag ttcataactt atgttgctca tgttgtgctg
3061 tgtcaggatg ggataggaag caagtcccat gcttagaggc atgggatgtg ttggaacggg
3121 atttacacac actggaggag cagggcaagt tggaattcta agatccatga acccccaact
3181 gtatttcctc cctgcatatt ttaccaatat attaaaaaac aatgtaactt ttaaaaggca
3241 tcattcctga ggtttgtctt aatttctgat taagtaatca gaatattttc tgctattttt
3301 gccaggaatc acaaagatga ttaaagggtt ggaaaaaag atctatgatg gaaaattaaa
3361 ggaactggga ttattgagcc tggagaagag aagactgagg ggcaaaccat tgatggtttt
3421 caagtatatg aagggttggc acagagaggg tggcgaccag ctgttctcca tatgcactaa
3481 gaatagaaca agaggaaact ggcttagact agagtataag ggagcatttc ttggcagggg
3541 ccattgttag aatacttcat aaaaaaagaa gtgtgaaaat ctcagtatct ctctctcttt
3601 ctaaaaaatt agataaaaat ttgtctattt aagatggtta aagatgttct tacccaagga
3661 aaagtaacaa attatagaat ttcccaaaag atgttttgat cctactagta gtatgcagtg
3721 aaaatcttta gaactaaata atttggacaa ggcttaattt aggcatttcc ctcttgacct
3781 cctaatggag agggattgaa aggggaagag cccaccaaat gctgagctca ctgaaatatc
3841 tctcccttat ggcaatccta gcagtattaa agaaaaaagg aaactattta ttccaaatga
3901 gagtatgatg gacagatatt ttagtatctc agtaatgtcc tagtgtggcg gtggttttca
3961 atgtttcttc atgttaaagg tataagccct tcatttgttc aatggatgat gtttcagatt
4021 ttttttttttt taagagatcc ttcaaggaac acagttcaga gagattttca tcgggtgcat
4081 tctctctgct tcgtgtgtga caagttatct tggctgctga gaaagagtgc cctgccccac
4141 accggcagac cttttccttca cctcatcagt atgattcagt ttctcttatc aattggactc
4201 tcccaggttc cacagaacag taatattttt tgaacaatag gtacaataga aggtcttctg
4261 tcatttaacc tggtaaaggc agggctggag ggggaaaata aatcattaag cctttgagta
```

-continued

```
4321 acggcagaat atatggctgt agatccattt ttaatggttc atttccttta tggtcatata
4381 actgcacagc tgaagatgaa agggaaaat aaatgaaaat tttacttttc gatgccaatg
4441 atacattgca ctaaactgat ggaagaagtt atccaaagta ctgtataaca tcttgtttat
4501 tatttaatgt tttctaaaat aaaaaatgtt agtggttttc caaatggcct aataaaaaca
4561 attatttgta aataaaaaca ctgttagtaa ta
```

Angiostatin (PLG)

(NCBI Ref.: NM_000301.3; SEQ ID NO: 173)

```
   1 gaatcattaa cttaatttga ctatctggtt tgtggatgcg tttactctca tgtaagtcaa
  61 caacatcctg ggattgggac ccactttctg ggcactgctg gccagtccca aaatggaaca
 121 taaggaagtg gttcttctac ttcttttatt tctgaaatca ggtcaaggag agcctctgga
 181 tgactatgtg aatacccagg gggcttcact gttcagtgtc actaagaagc agctgggagc
 241 aggaagtata gaagaatgtg cagcaaaatg tgaggaggac gaagaattca cctgcagggc
 301 attccaatat cacagtaaag agcaacaatg tgtgataatg gctgaaaaca ggaagtcctc
 361 cataatcatt aggatgagag atgtagtttt atttgaaaag aaagtgtatc tctcagagtg
 421 caagactggg aatggaaaga actacagagg gacgatgtcc aaaacaaaaa atggcatcac
 481 ctgtcaaaaa tggagttcca cttctcccca cagacctaga ttctcacctg ctacacaccc
 541 ctcagaggga ctggaggaga actactgcag gaatccagac aacgatccgc aggggccctg
 601 gtgctatact actgatccag aaaagagata tgactactgc gacattcttg agtgtgaaga
 661 ggaatgtatg cattgcagtg gagaaaacta tgacggcaaa atttccaaga ccatgtctgg
 721 actggaatgc caggcctggg actctcagag cccacacgct catggataca ttccttccaa
 781 atttccaaac aagaacctga aagaattac tgtcgtaac cccgataggg agctgcggcc
 841 ttggtgtttc accaccgacc ccaacaagcg ctgggaactt tgtgacatcc cccgctgcac
 901 aacacctcca ccatcttctg gtcccaccta ccagtgtctg aagggaacag gtgaaaacta
 961 tcgcgggaat gtggctgtta ccgtgtccgg gcacacctgt cagcactgga gtgcacagac
1021 ccctcacaca cataacagga caccagaaaa cttcccctgc aaaaatttgg atgaaaacta
1081 ctgccgcaat cctgacggaa aagggcccc atggtgccat acaaccaaca gccaagtgcg
1141 gtgggagtac tgtaagatac cgtcctgtga ctcctcccca gtatccacgg aacaattggc
1201 tcccacagca ccacctgagc taacccctgt ggtccaggac tgctaccatg gtgatggaca
1261 gagctaccga ggcacatcct ccaccaccac cacaggaaag aagtgtcagt cttggtcatc
1321 tatgacacca caccggcacc agaagacccc agaaaactac ccaaatgctg gcctgacaat
1381 gaactactgc aggaatccag atgccgataa aggccctg tgttttacca cagacccag
1441 cgtcaggtgg gagtactgca acctgaaaaa atgctcagga acagaagcga gtgttgtagc
1501 acctccgcct gttgtcctgc ttccagatgt agagactcct tccgaagaag actgtatgtt
1561 tgggaatggg aaaggatacc gaggcaagag ggcgaccact gttactggga cgccatgcca
1621 ggactgggct gcccaggagc cccatagaca cagcattttc actccagaga caatccacg
1681 ggcgggtctg gaaaaaaatt actgccgtaa ccctgatggt gatgtaggtg gtccctggtg
1741 ctacacgaca aatccaagaa aactttacga ctactgtgat gtccctcagt gtgcggcccc
1801 ttcatttgat tgtgggaagc ctcaagtgga gccgaagaaa tgtcctggaa gggttgtagg
1861 ggggtgtgtg gcccacccac attcctggcc ctggcaagtc agtcttagaa caaggtttgg
1921 aatgcacttc tgtggaggca cttgatatc cccagagtgg gtgttgactg ctgcccactg
1981 cttggagaag tccccaaggc cttcatccta caaggtcatc ctgggtgcac accaagaagt
2041 gaatctcgaa ccgcatgttc aggaaataga agtgtctagg ctgttcttgg agcccacacg
```

```
2101 aaaagatatt gccttgctaa agctaagcag tcctgccgtc atcactgaca aagtaatccc
2161 agcttgtctg ccatcccaa attatgtggt cgctgaccgg accgaatgtt tcatcactgg
2221 ctggggagaa acccaaggta cttttggagc tggccttctc aaggaagccc agctccctgt
2281 gattgagaat aaagtgtgca atcgctatga gtttctgaat ggaagagtcc aatccaccga
2341 actctgtgct gggcatttgg ccggaggcac tgacagttgc cagggtgaca gtggaggtcc
2401 tctggtttgc ttcgagaagg acaaatacat tttacaagga gtcacttctt ggggtcttgg
2461 ctgtgcacgc cccaataagc ctggtgtcta tgttcgtgtt tcaaggtttg ttacttggat
2521 tgagggagtg atgagaaata attaattgga cgggagacag agtgacgcac tgactcacct
2581 agaggctgga acgtgggtag ggatttagca tgctggaaat aactggcagt aatcaaacga
2641 agacactgtc cccagctacc agctacgcca aacctcggca ttttttgtgt tattttctga
2701 ctgctggatt ctgtagtaag gtgacatagc tatgacattt gttaaaaata aactctgtac
2761 ttaactttga tttgagtaaa ttttggtttt ggtcttcaac attttcatgc tctttgttca
2821 ccccaccaat ttttaaatgg gcagatgggg ggatttagct gcttttgata aggaacagct
2881 gcacaaagga ctgagcaggc tgcaaggtca cagaggggag agccaagaag ttgtccacgc
2941 atttacctca tcagctaacg agggcttgac atgcattttt actgtcttta ttcctgacac
3001 tgagatgaat gttttcaaag ctgcaacatg tatggggagt catgcaaacc gattctgtta
3061 ttgggaatga aatctgtcac cgactgcttg acttgagccc aggggacacg gagcagagag
3121 ctgtatatga tggagtgaac cggtccatgg atgtgtaaca caagaccaac tgagagtctg
3181 aatgttattc tggggcacac gtgagtctag gattggtgcc aagagcatgt aaatgaacaa
3241 caagcaaata ttgaaggtgg accacttatt tcccattgct aattgcctgc ccggttttga
3301 aacagtctgc agtacacacg gtcacaggag aatgacctgt gggagagata catgtttaga
3361 aggaagagaa aggacaaagg cacacgtttt accatttaaa atattgttac caaacaaaaa
3421 tatccattca aaatacaatt taacaatgca acagtcatct tacagcagag aaatgcagag
3481 aaaagcaaaa ctgcaagtga ctgtgaataa agggtgaatg tagtctcaaa tcctcaaa
```

Tissue transglutaminase factor XIII (F13A1)
(NCBI Ref.: NM_000129.3; SEQ ID NO: 174)
```
  1 atttaagagc caactgtctt gtctttcccg agtccgtttg aggaagtccc cgaggcgcac
 61 agagcaagcc cacgcgaggg cacctctgga ggggagcgcc tgcaggacct tgtaaagtca
121 aaaatgtcag aaacttccag gaccgccttt ggaggcagaa gagcagttcc acccaataac
181 tctaatgcag cggaagatga cctgcccaca gtggagcttc agggcgtggt gccccggggc
241 gtcaacctgc aagagtttct taatgtcacg agcgttcacc tgttcaagga gagatgggac
301 actaacaagg tggaccacca cactgacaag tatgaaaaca caagctgat tgtccgcaga
361 gggcagtctt tctatgtgca gattgacttc agtcgtccat atgacccag aagggatctc
421 ttcagggtgg aatacgtcat tggtcgctac ccacaggaga caagggaac ctacatccca
481 gtgcctatag tctcagagtt acaaagtgga aagtgggggg ccaagattgt catgagagag
541 gacaggtctg tgcggctgtc catccagtct tcccccaaat gtattgtggg gaaattccgc
601 atgtatgttg ctgtctggac tccctatggc gtacttcgaa ccagtcgaaa cccagaaaca
661 gacacgtaca ttctcttcaa tccttggtgt gaagatgatg ctgtgtatct ggacaatgag
721 aaagaaagag aagagtatgt cctgaatgac atcggggtaa ttttttatgg agaggtcaat
781 gacatcaaga ccagaagctg gagctatggt cagtttgaag atggcatcct ggacacttgc
841 ctgtatgtga tggacagagc acaaatggac ctctctggaa gagggaatcc catcaaagtc
```

-continued

```
 901 agccgtgtgg ggtctgcaat ggtgaatgcc aaagatgacg aaggtgtcct cgttggatcc
 961 tgggacaata tctatgccta tggcgtcccc ccatcggcct ggactggaag cgttgacatt
1021 ctattggaat accggagctc tgagaatcca gtccggtatg ccaatgctg gttttgct
1081 ggtgtcttta acacattttt acgatgcctt ggaataccag caagaattgt taccaattat
1141 ttctctgccc atgataatga tgccaatttg caaatggaca tcttcctgga agaagatggg
1201 aacgtgaatt ccaaactcac caaggattca gtgtggaact accactgctg gaatgaagca
1261 tggatgacaa ggcctgacct tcctgttgga tttggaggct ggcaagctgt ggacagcacc
1321 ccccaggaaa atagcgatgg catgtatcgg tgtggccccg cctcggttca agccatcaag
1381 cacggccatg tctgcttcca atttgatgca cctttgtttt tgcagaggt caacagcgac
1441 ctcatttaca ttacagctaa gaaagatggc actcatgtgg tggaaaatgt ggatgccacc
1501 cacattggga aattaattgt gaccaaacaa attggaggag atggcatgat ggatattact
1561 gatacttaca aattccaaga aggtcaagaa gaagagagat tggccctaga aactgccctg
1621 atgtacggag ctaaaaagcc cctcaacaca gaaggtgtca tgaaatcaag gtccaacgtt
1681 gacatggact ttgaagtgga aaatgctgtg ctgggaaaag acttcaagct ctccatcacc
1741 ttccggaaca acagccacaa ccgttacacc atcacagctt atctctcagc caacatcacc
1801 ttctacaccg gggtcccgaa ggcagaattc aagaaggaga cgttcgacgt gacgctggag
1861 cccttgtcct tcaagaaaga ggcggtgctg atccaagccg cgagtacat gggtcagctg
1921 ctggaacaag cgtccctgca cttctttgtc acagctcgca tcaatgagac cagggatgtt
1981 ctggccaagc aaaagtccac cgtgctaacc atccctgaga tcatcatcaa ggtccgtggc
2041 actcaggtag ttggttctga catgactgtg acagttgagt ttaccaatcc tttaaaagaa
2101 accctgcgaa atgtctgggt acacctggat ggtcctggag taacaagacc aatgaagaag
2161 atgttccgtg aaatccggcc caactccacc gtgcagtggg aagaagtgtg ccggccctgg
2221 gtctctgggc atcggaagct gatagccagc atgagcagtg actccctgag acatgtgtat
2281 ggcgagctgg acgtgcagat tcaaagacga ccttccatgt gaatgcacag gaagctgaga
2341 tgaaccctgg catttggcct cttgtagtct tggctaagga aattctaacg caaaatagc
2401 tcttgctttg acttaggtgt gaagacccag acaggactgc agagggctcc agagtggaga
2461 tcccacatat ttcaaaaaca tgcttttcca aacccaggct attcggcaag gaagttagtt
2521 tttaatctct ccaccttcca aagagtgcta agcattagct ttaattaagc tctcatagct
2581 cataagagta acagtcatca tttatcatca caaatggcta catctccaaa tatcagtggg
2641 ctctcttacc agggagattt gctcaatacc tggcctcatt taaaacaaga cttcagattc
2701 cccactcagc cttttgggaa taatagcaca tgatttgggc tctagaattc cagtcccctt
2761 tctcggggtc aggttctacc ctccatgtga aatattttt cccaggacta gagcacaaca
2821 taatttttat ttttggcaaa gccagaaaaa gatctttcat tttgcacctg cagccaagca
2881 aatgcctgcc aaatttaga tttaccttgt tagaagaggt ggccccatat taacaaattg
2941 catttgtggg aaacttaacc acctacaagg agataagaaa gcaggtgcaa cactcaagtc
3001 tattgaataa tgtagttttg tgatgcattt tatagaatgt gtcacactgt ggcctgatca
3061 gcaggagcca atatcccta ctttaaccct ttctgggatg caatactagg aagtaaagtg
3121 aagaatttat ctctttagtt agtgattata tttcacccat ctctcaggaa tcatctcctt
3181 tgcagaatga tgcaggttca ggtccccttt cagagatata ataagcccaa caagttgaag
3241 aagctggcga atctagtgac cagatatata gaaggactgc agccactgat tctctcttgt
3301 ccttcacatc acccatgttg agacctcagc ttggcactca ggtgctgaag ggtaatatgg
```

-continued

```
3361 actcagcctt gcaaatagcc agtgctagtt ctgacccaac cacagaggat gctgacatca
3421 tttgtattat gttccaaggc tactacagag aaggctgcct gctatgtatt tgcaaggctg
3481 atttatggtc agaatttccc tctgatatgt ctagggtgtg atttaggtca gtagactgtg
3541 attcttagca aaaaatgaac agtgataagt atactggggg caaaatcaga atggaatgct
3601 ctggtctata taaccacatt tctaagcctt tgagactgtt cctgagcctt cagcactaac
3661 ctatgagggt gagctggtcc cctctatata tacatcatac ttaactttac taagtaatct
3721 cacagcattt gccaagtctc ccaatatcca attttaaaat gaatgcatt ttgctagaca
3781 gttaaactgg cttaacttag tatattatta ttaattacaa tgtaatagaa gcttaaaata
3841 aagttaaact gattatattt gca
```

Von Willebrand Factor (NCBI Ref.: NM_000552.4; SEQ ID NO: 175)

```
   1 gtggcagctc acagctattg tggtgggaaa gggagggtgg ttggtggatg tcacagcttg
  61 ggctttatct cccccagcag tggggactcc acagcccctg ggctacataa cagcaagaca
 121 gtccggagct gtagcagacc tgattgagcc tttgcagcag ctgagagcat ggcctagggt
 181 gggcggcacc attgtccagc agctgagttt cccaggacc ttggagatag ccgcagccct
 241 catttgcagg ggaagatgat tcctgccaga tttgccgggg tgctgcttgc tctggccctc
 301 attttgccag ggaccctttg tgcagaagga actcgcggca ggtcatccac ggcccgatgc
 361 agccttttcg gaagtgactt cgtcaacacc tttgatggga gcatgtacag ctttgcggga
 421 tactgcagtt acctcctggc aggggctgc cagaaacgct ccttctcgat tattggggac
 481 ttccagaatg caagagagt gagcctctcc gtgtatcttg ggaatttttt tgacatccat
 541 ttgtttgtca atggtaccgt gacacagggg gaccaaagag tctccatgcc ctatgcctcc
 601 aaagggctgt atctagaaac tgaggctggg tactacaagc tgtccggtga ggcctatggc
 661 tttgtggcca ggatcgatgg cagcggcaac tttcaagtcc tgctgtcaga cagatacttc
 721 aacaagacct gcgggctgtg tggcaacttt aacatctttg ctgaagatga ctttatgacc
 781 caagaaggga ccttgacctc ggacccttat gactttgcca actcatgggc tctgagcagt
 841 ggagaacagt ggtgtgaacg ggcatctcct cccagcagct catgcaacat ctcctctggg
 901 gaaatgcaga agggcctgtg ggagcagtgc cagcttctga agagcacctc ggtgtttgcc
 961 cgctgccacc ctctggtgga ccccgagcct tttgtggccc tgtgtgagaa actttgtgt
1021 gagtgtgctg gggggctgga gtgcgcctgc cctgccctcc tggagtacgc ccggacctgt
1081 gcccaggagg aatggtgct gtacggctgg accgaccaca gcgcgtgcag cccagtgtgc
1141 cctgctggta tggagtatag gcagtgtgtg tccccttgcg ccaggacctg ccagagcctg
1201 cacatcaatg aaatgtgtca ggagcgatgc gtggatggct gcagctgccc tgagggacag
1261 ctcctggatg aaggcctctg cgtggagagc accgagtgtc cctgcgtgca ttccggaaag
1321 cgctacccctc ccggcacctc cctctctcga gactgcaaca cctgcatttg ccgaaacagc
1381 cagtggatct gcagcaatga agaatgtcca ggggagtgcc ttgtcacagg tcaatcacac
1441 ttcaagagct tgacaacag atacttcacc ttcagtggga tctgccagta cctgctggcc
1501 cgggattgcc aggaccactc cttctccatt gtcattgaga ctgtccagtg tgctgatgac
1561 cgcgacgctg tgtgcacccg ctccgtcacc gtccggctgc ctggcctgca aacagccttt
1621 gtgaaactga agcatgggc aggagttgcc atggatggcc aggacgtcca gctccccctc
1681 ctgaaaggtg acctccgcat ccagcataca gtgacggcct ccgtgcgcct cagctacggg
1741 gaggacctgc agatggactg ggatggccgc gggaggctgc tggtgaagct gtcccccgtc
```

```
-continued
1801 tatgccggga agacctgcgg cctgtgtggg aattacaatg caaccaggg cgacgacttc
1861 cttaccccct ctgggctggc ggagccccgg gtgaggact tcgggaacgc ctggaagctg
1921 cacggggact gccaggacct gcagaagcag cacagcgatc cctgcgccct caacccgcgc
1981 atgaccaggt tctccgagga ggcgtgcgcg gtcctgacgt cccccacatt cgaggcctgc
2041 catcgtgccg tcagcccgct gccctacctg cggaactgcc gctacgacgt gtgctcctgc
2101 tcggacggcc gcgagtgcct gtgcggcgcc ctggccagct atgccgcggc ctgcgcgggg
2161 agaggcgtgc gcgtcgcgtg gcgcgagcca ggccgctgtg agctgaactg cccgaaaggc
2221 caggtgtacc tgcagtgcgg gacccccctgc aacctgacct gccgctctct ctcttacccg
2281 gatgaggaat gcaatgaggc ctgcctggag ggctgcttct gccccccagg gctctacatg
2341 gatgagaggg gggactgcgt gcccaaggcc cagtgcccct gttactatga cggtgagatc
2401 ttccagccag aagacatctt ctcagaccat cacaccatgt gctactgtga ggatggcttc
2461 atgcactgta ccatgagtgg agtccccgga agcttgctgc ctgacgctgt cctcagcagt
2521 cccctgtctc atcgcagcaa aaggagccta tcctgtcggc cccccatggt caagctggtg
2581 tgtcccgctg acaacctgcg ggctgaaggg ctcgagtgta ccaaaacgtg ccagaactat
2641 gacctggagt gcatgagcat gggctgtgtc tctggctgcc tctgccccc gggcatggtc
2701 cggcatgaga acagatgtgt ggccctggaa aggtgtccct gcttccatca gggcaaggag
2761 tatgcccctg gagaaacagt gaagattggc tgcaacactt gtgtctgtcg ggaccggaag
2821 tggaactgca cagaccatgt gtgtgatgcc acgtgctcca cgatcggcat ggcccactac
2881 ctcaccttcg acgggctcaa atacctgttc cccggggagt gccagtacgt tctggtgcag
2941 gattactgcg gcagtaaccc tgggacccttt cggatcctag tggggaataa gggatgcagc
3001 cacccctcag tgaaatgcaa gaaacgggtc accatcctgg tggagggagg agagattgag
3061 ctgtttgacg gggaggtgaa tgtgaagagg cccatgaagg atgagactca ctttgaggtg
3121 gtggagtctg gccggtacat cattctgctg ctgggcaaag ccctctccgt ggtctgggac
3181 cgccacctga gcatctccgt ggtcctgaag cagacatacc aggagaaagt gtgtggcctg
3241 tgtgggaatt ttgatggcat ccagaacaat gacctcacca gcagcaacct ccaagtggag
3301 gaagaccctg tggactttgg gaactcctgg aaagtgagct cgcagtgtgc tgacaccaga
3361 aaagtgcctc tggactcatc ccctgccacc tgccataaca acatcatgaa gcagacgatg
3421 gtggattcct cctgtagaat ccttaccagt gacgtcttcc aggactgcaa caagctggtg
3481 gaccccgagc catatctgga tgtctgcatt tacgacacct gctcctgtga gtccattggg
3541 gactgcgcct gcttctgcga caccattgct gcctatgccc acgtgtgtgc ccagcatggc
3601 aaggtggtga cctggaggac ggccacattg tgccccagg ctgcgagga gaggaatctc
3661 cgggagaacg ggtatgagtg tgagtggcgc tataacagct gtgcacctgc ctgtcaagtc
3721 acgtgtcagc ccctgagcc actggcctgc cctgtgcagt gtgtggaggg ctgccatgcc
3781 cactgccctc cagggaaaat cctggatgag cttttgcaga cctgcgttga ccctgaagac
3841 tgtccagtgt gtgaggtggc tggccggcgt tttgcctcag gaaagaaagt caccttgaat
3901 cccagtgacc ctgagcactg ccagatttgc cactgtgatt ttgtcaacct cacctgtgaa
3961 gcctgccagg agccgggagg cctggtggtg cctcccacag atgccccggt gagccccacc
4021 actctgtatg tggaggacat ctcggaaccg ccgttcacg atttctactg cagcaggcta
4081 ctggacctgg tcttcctgct ggatggctcc tccaggctgt ccgaggctga gtttgaagtg
4141 ctgaaggcct ttgtggtgga catgatggag cggctgcgca tctcccagaa gtgggtccgc
4201 gtggccgtgg tggagtacca cgacggctcc cacgcctaca tcgggctcaa ggaccggaag
```

-continued

```
4261 cgaccgtcag agctgcggcg cattgccagc caggtgaagt atgcgggcag ccaggtggcc
4321 tccaccagcg aggtcttgaa atacacactg ttccaaatct tcagcaagat cgaccgccct
4381 gaagcctccc gcatcaccct gctcctgatg gccagccagg agcccaacg atgtcccgg
4441 aactttgtcc gctacgtcca gggcctgaag aagaagaagg tcattgtgat cccggtgggc
4501 attgggcccc atgccaacct caagcagatc cgcctcatcg agaagcaggc ccctgagaac
4561 aaggccttcg tgctgagcag tgtggatgag ctggagcagc aaagggacga gatcgttagc
4621 tacctctgtg accttgcccc tgaagcccct cctcctactc tgcccccga catggcacaa
4681 gtcactgtgg gcccggggct cttggggggtt tcgaccctgg ggcccaagag gaactccatg
4741 gttctggatg tggcgttcgt cctggaagga tcggacaaaa ttggtgaagc cgacttcaac
4801 aggagcaagg agttcatgga ggaggtgatt cagcggatgg atgtgggcca ggacagcatc
4861 cacgtcacgg tgctgcagta ctcctacatg gtgactgtgg agtaccccctt cagcgaggca
4921 cagtccaaag gggacatcct gcagcgggtg cgagagatcc gctaccaggg cggcaacagg
4981 accaacactg gctggccct gcggtacctc tctgaccaca gcttcttggt cagccagggt
5041 gaccgggagc aggcgcccaa cctggtctac atggtcaccg gaaatcctgc ctctgatgag
5101 atcaagaggc tgcctggaga catccaggtg gtgcccattg gagtgggccc taatgccaac
5161 gtgcaggagc tggagaggat tggctggccc aatgccccta tcctcatcca ggactttgag
5221 acgctccccc gagaggctcc tgacctggtg ctgcagaggt gctgctccgg agaggggctg
5281 cagatcccca ccctctcccc tgcacctgac tgcagccagc ccctggacgt gatccttctc
5341 ctggatggct cctccagttt cccagcttct tattttgatg aaatgaagag tttcgccaag
5401 gctttcattt caaaagccaa tatagggcct cgtctcactc aggtgtcagt gctgcagtat
5461 ggaagcatca ccaccattga cgtgccatgg aacgtggtcc cggagaaagc ccatttgctg
5521 agccttgtgg acgtcatgca gcgggaggga ggccccagcc aaatcgggga tgccttgggc
5581 tttgctgtgc gatacttgac ttcagaaatg catggtgcca ggccgggagc ctcaaaggcg
5641 gtggtcatcc tggtcacgga cgtctctgtg gattcagtgg atgcagcagc tgatgccgcc
5701 aggtccaaca gagtgacagt gttccctatt ggaattggag atcgctacga tgcagcccag
5761 ctacggatct tggcaggccc agcaggcgac tccaacgtgg tgaagctcca gcgaatcgaa
5821 gacctcccta ccatggtcac cttgggcaat tccttcctcc acaaactgtg ctctggattt
5881 gttaggattt gcatggatga ggatgggaat gagaagaggc ccggggacgt ctggaccttg
5941 ccagaccagt gccacaccgt gacttgccag ccagatggcc agaccttgct gaagagtcat
6001 cgggtcaact gtgaccgggg gctgaggcct tcgtgcccta acagccagtc ccctgttaaa
6061 gtggaagaga cctgtggctg ccgctggacc tgccccctgcg tgtgcacagg cagctccact
6121 cggcacatcg tgacctttga tgggcagaat ttcaagctga ctggcagctg ttcttatgtc
6181 ctatttcaaa acaaggagca ggacctggag gtgattctcc ataatggtgc ctgcagccct
6241 ggagcaaggc agggctgcat gaaatccatc gaggtgaagc acagtgccct ctccgtcgag
6301 ctgcacagtg acatggaggt gacggtgaat gggagactgg tctctgttcc ttacgtgggt
6361 gggaacatgg aagtcaacgt ttatggtgcc atcatgcatg aggtcagatt caatcacctt
6421 ggtcacatct tcacattcac tccacaaaac aatgagttcc aactgcagct cagccccaag
6481 acttttgctt caaagacgta tggtctgtgt gggatctgtg atgagaacgg agccaatgac
6541 ttcatgctga gggatggcac agtcaccaca gactggaaaa cacttgttca ggaatggact
6601 gtgcagcggc cagggcagac gtgccagccc atcctggagg agcagtgtct tgtccccgac
```

-continued

```
6661 agctcccact gccaggtcct cctcttacca ctgtttgctg aatgccacaa ggtcctggct 6721 ccagccacat tctatgccat ctgccagcag gacagttgcc accaggagca agtgtgtgag 6781 gtgatcgcct cttatgccca cctctgtcgg accaacgggg tctgcgttga ctggaggaca 6841 cctgatttct gtgctatgtc atgcccacca tctctggtct acaaccactg tgagcatggc 6901 tgtccccggc actgtgatgg caacgtgagc tcctgtgggg accatccctc cgaaggctgt 6961 ttctgccctc cagataaagt catgttggaa ggcagctgtg tccctgaaga ggcctgcact 7021 cagtgcattg gtgaggatgg agtccagcac cagttcctgg aagcctgggt cccggaccac 7081 cagccctgtc agatctgcac atgcctcagc gggcggaagg tcaactgcac aacgcagccc 7141 tgccccacgg ccaaagctcc cacgtgtggc ctgtgtgaag tagcccgcct ccgccagaat 7201 gcagaccagt gctgccccga gtatgagtgt gtgtgtgacc cagtgagctg tgacctgccc 7261 ccagtgcctc actgtgaacg tggcctccag cccacactga ccaaccctgg cgagtgcaga 7321 cccaacttca cctgcgcctg caggaaggag gagtgcaaaa gagtgtcccc accctcctgc 7381 cccccgcacc gtttgcccac ccttcggaag acccagtgct gtgatgagta tgagtgtgcc 7441 tgcaactgtg tcaactccac agtgagctgt ccccttgggt acttggcctc aactgccacc 7501 aatgactgtg gctgtaccac aaccacctgc cttcccgaca aggtgtgtgt ccaccgaagc 7561 accatctacc ctgtgggcca gttctgggag gagggctgcg atgtgtgcac ctgcaccgac 7621 atggaggatg ccgtgatggg cctccgcgtg gcccagtgct cccagaagcc ctgtgaggac 7681 agctgtcggt cgggcttcac ttacgttctg catgaaggcg agtgctgtgg aaggtgcctg 7741 ccatctgcct gtgaggtggt gactggctca ccgcgggggg actcccagtc ttcctggaag 7801 agtgtcggct cccagtgggc ctccccggag aacccctgcc tcatcaatga gtgtgtccga 7861 gtgaaggagg aggtctttat acaacaaagg aacgtctcct gcccccagct ggaggtccct 7921 gtctgcccct cgggctttca gctgagctgt aagacctcag cgtgctgccc aagctgtcgc 7981 tgtgagcgca tggaggcctg catgctcaat ggcactgtca ttgggcccgg gaagactgtg 8041 atgatcgatg tgtgcacgac ctgccgctgc atggtgcagg tgggggtcat ctctggattc 8101 aagctggagt gcaggaagac cacctgcaac ccctgccccc tgggttacaa ggaagaaaat 8161 aacacaggtg aatgttgtgg gagatgtttg cctacggctt gcaccattca gctaagagga 8221 ggacagatca tgacactgaa gcgtgatgag acgctccagg atggctgtga tactcacttc 8281 tgcaaggtca atgagagagg agagtacttc tgggagaaga gggtcacagg ctgcccaccc 8341 tttgatgaac acaagtgtct ggctgaggga ggtaaaatta tgaaaattcc aggcacctgc 8401 tgtgacacat gtgaggagcc tgagtgcaac gacatcactg ccaggctgca gtatgtcaag 8461 gtgggaagct gtaagtctga agtagaggtg gatatccact actgccaggg caaatgtgcc 8521 agcaaagcca tgtactccat tgacatcaac gatgtgcagg accagtgctc ctgctgctct 8581 ccgacacgga cggagcccat gcaggtggcc ctgcactgca ccaatggctc tgttgtgtac 8641 catgaggttc tcaatgccat ggagtgcaaa tgctccccca ggaagtgcag caagtgaggc 8701 tgctgcagct gcatgggtgc ctgctgctgc ctgccttggc ctgatggcca ggccagagtg 8761 ctgccagtcc tctgcatgtt ctgctcttgt gcccttctga gcccacaata aaggctgagc 8821 tcttatcttg caaaaggc ADAM2
                    (NCBI Ref.: NM_001278113.1; SEQ ID NO: 176)
   1 gcctacctct tccaggctgc gtggccgggg cgtcatctcg cgcttccaac tgccctgtaa 61 ccaccaactg ccattattcc ggctgggacc caggacttca agccatgtgg cgcgtcttgt 121 ttctgctcag cgggctcggc gggctgcgga tggacagtaa ttttgatagt ttacctgtgc
```

-continued

```
 181 aaattacagt tccggagaaa atacggtcaa taataaagga aggaattgaa tcgcaggcat
 241 cctacaaaat tgtaattgaa gggaaaccat atactgtgaa tttaatgcaa aaaaactttt
 301 taccccataa ttttagagtt tacagttata gtggcacagg aattatgaaa ccacttgacc
 361 aagattttca gaatttctgc cactaccaag ggtatattga aggttatcca aaatctgtgg
 421 tgatggttag cacatgtact ggactcaggg gcgtactaca gtttgaaaat gttagttatg
 481 gaatagaacc cctggagtct tcagttggct ttgaacatgt aatttaccaa gtaaaacata
 541 agaaagcaga tgtttcctta tataatgaga aggatattga atcaagagat ctgtccttta
 601 aattacaaag cgtagagtat aatcatatgg ggtctgatac aactgttgtc gctcaaaaag
 661 ttttccagtt gattggattg acgaatgcta tttttgtttc atttaatatt acaattattc
 721 tgtcttcatt ggagctttgg atagatgaaa ataaaattgc aaccactgga gaagctaatg
 781 agttattaca cacattttta agatggaaaa catcttatct tgttttacgt cctcatgatg
 841 tggcattttt acttgtttac agagaaaagt caaattatgt tggtgcaacc tttcaaggga
 901 agatgtgtga tgcaaactat gcaggaggtg ttgttctgca ccccagaacc ataagtctgg
 961 aatcacttgc agttatttta gctcaattat tgagccttag tatgggggatc acttatgatg
1021 acattaacaa atgccagtgc tcaggagctg tctgcattat gaatccagaa gcaattcatt
1081 tcagtggtgt gaagatcttt agtaactgca gcttcgaaga ctttgcacat tttatttcaa
1141 agcagaagtc ccagtgtctt cacaatcagc ctcgcttaga tcctttttc aaacagcaag
1201 cagtgtgtgg taatgcaaag ctggaagcag gagaggagtg tgactgtggg actgaacagg
1261 attgtgccct tattggagaa acatgctgtg atattgccac atgtagattt aaagccggtt
1321 caaactgtgc tgaaggacca tgctgcgaaa actgtctatt tatgtcaaaa gaaagaatgt
1381 gtaggccttc ctttgaagaa tgcgacctcc ctgaatattg caatggatca tctgcatcat
1441 gcccagaaaa ccactatgtt cagactgggc atccgtgtgg actgaatcaa tggatctgta
1501 tagatggagt ttgtatgagt ggggataaac aatgtacaga cacatttggc aaagaagtag
1561 agtttggccc ttcagaatgt tattctcacc ttaattcaaa gactgatgta tctggaaaact
1621 gtggtataag tgattcagga tacacacagt gtgaagctga caatctgcag tgcggaaaat
1681 taatatgtaa atatgtaggt aaattttat tacaaattcc aagagccact attatttatg
1741 ccaacataag tggacatctc tgcattgctg tggaatttgc cagtgatcat gcagacagcc
1801 aaaagatgtg gataaaagat ggaacttctt gtggttcaaa taaggtttgc aggaatcaaa
1861 gatgtgtgag ttcttcatac ttgggttatg attgtactac tgacaaatgc aatgatagag
1921 gtgtatgcaa taacaaaaag cactgtcact gtagtgcttc atatttacct ccagattgct
1981 cagttcaatc agatctatgg cctggtggga gtattgacag tggcaatttt ccacctgtag
2041 ctataccagc cagactccct gaaaggcgct acattgagaa catttaccat tccaaaccaa
2101 tgagatggcc attttttctta ttcattcctt tctttattat tttctgtgta ctgattgcta
2161 taatggtgaa agttaatttc caaaggaaaa aatggagaac tgaggactat tcaagcgatg
2221 agcaacctga aagtgagagt gaacctaaag ggtagtctgg acaacagaga tgccatgata
2281 tcacttcttc tagagtaatt atctgtgatg gatggacaca aaaaaatgga aagaaaagaa
2341 tgtacattac ctggtttcct gggattcaaa cctgcatatt gtgattttaa tttgaccaga
2401 aaatatgata tatatgtata atttcacaga taatttactt atttaaaaat gcatgataat
```

-continued

```
2461 gagttttaca ttacaaattt ctgttttttt aaagttatct tacgctattt ctgttggtta 2521 gtagacacta attctgtcag taggggcatg gtataaggaa atatcataat gtaatgaggt 2581 ggtactatga ttaaaagcca ctgttacatt tcaaaaaaaa aaaaaaa
```

ICAM1

(NCBI Ref.: NM_000201.2; SEQ ID NO: 177)

```
   1 caagcttagc ctggccggga acgggaggc gtggaggccg ggagcagccc ccggggtcat 61 cgccctgcca ccgccgcccg attgctttag cttggaaatt ccggagctga agcggccagc 121 gagggaggat gaccctctcg gcccgggcac cctgtcagtc cggaaataac tgcagcattt 181 gttccggagg ggaaggcgcg aggtttccgg gaaagcagca ccgcccttg gcccccaggt 241 ggctagcgct ataaaggatc acgcgcccca gtcgacgctg agctcctctg ctactcagag 301 ttgcaacctc agcctcgcta tggctcccag cagcccccgg cccgcgctgc cgcactcct 361 ggtcctgctc ggggctctgt tcccaggacc tggcaatgcc cagacatctg tgtccccctc 421 aaaagtcatc ctgccccggg gaggctccgt gctggtgaca tgcagcacct cctgtgacca 481 gcccaagttg ttgggcatag agaccccgtt gcctaaaaag gagttgctcc tgcctgggaa 541 caaccggaag gtgtatgaac tgagcaatgt gcaagaagat agccaaccaa tgtgctattc 601 aaactgccct gatgggcagt caacagctaa accttcctc accgtgtact ggactccaga 661 acgggtggaa ctggcacccc tccctcttg gcagccagtg ggcaagaacc ttaccctacg 721 ctgccaggtg gagggtgggg caccccgggc caacctcacc gtggtgctgc tccgtgggga 781 gaaggagctg aaacgggagc cagctgtggg ggagcccgct gaggtcacga ccacggtgct 841 ggtgaggaga gatcaccatg gagccaattt ctcgtgccgc actgaactgg acctgcggcc 901 ccaagggctg gagctgtttg agaacacctc ggccccctac cagctccaga cctttgtcct 961 gccagcgact cccccacaac ttgtcagccc ccgggtccta gaggtggaca cgcaggggac 1021 cgtggtctgt tccctggacg gctgttccc agtctcggag gcccaggtcc acctggcact 1081 gggggaccag aggttgaacc ccacagtcac ctatggcaac gactccttct cggccaaggc 1141 ctcagtcagt gtgaccgcag aggacgaggg cacccagcgg ctgacgtgtg cagtaatact 1201 ggggaaccag agccaggaga cactgcagac agtgaccatc tacagctttc cggcgcccaa 1261 cgtgattctg acgaagccag aggtctcaga agggaccgag gtgacagtga agtgtgaggc 1321 ccaccctaga gccaaggtga cgctgaatgg ggttccagcc cagccactgg ccccgagggc 1381 ccagctcctg ctgaaggcca ccccagagga caacgggcgc agcttctcct gctctgcaac 1441 cctggaggtg gccggccagc ttatacacaa gaaccagacc cgggagcttc gtgtcctgta 1501 tggccccga ctggacgaga gggattgtcc gggaaactgg acgtggccag aaaattccca 1561 gcagactcca atgtgccagg cttggggaa cccattgccc gagctcaagt gtctaaagga 1621 tggcactttc ccactgccca tcgggaatc agtgactgtc actcgagatc ttgagggcac 1681 ctacctctgt cgggccagga gcactcaagg ggaggtcacc cgcaaggtga ccgtgaatgt 1741 gctctccccc cggtatgaga ttgtcatcat cactgtggta gcagccgcag tcataatggg 1801 cactgcaggc ctcagcacgt acctctataa ccgccagcgg aagatcaaga aatacagact 1861 acaacaggcc caaaaaggga cccccatgaa accgaacaca caagccacgc ctccctgaac 1921 ctatcccggg acagggcctc ttcctcggcc ttcccatatt ggtggcagtg gtgccacact 1981 gaacagagtg gaagacatat gccatgcagc tacacctacc ggccctggga cgccggagga 2041 cagggcattg tcctcagtca gatacaacag catttgggc catggtacct gcacacctaa 2101 aacactaggc cacgcatctg atctgtagtc acatgactaa gccaagagga aggagcaaga
```

```
2161 ctcaagacat gattgatgga tgttaaagtc tagcctgatg agaggggaag tggtgggga
2221 gacatagccc caccatgagg acatacaact gggaaatact gaaacttgct gcctattggg
2281 tatgctgagg ccccacagac ttacagaaga agtggccctc catagacatg tgtagcatca
2341 aaacacaaag gcccacactt cctgacggat gccagcttgg gcactgctgt ctactgaccc
2401 caaccctyga tgatatgtat ttattcattt gttattttac cagctattta ttgagtgtct
2461 tttatgtagg ctaaatgaac ataggtctct ggcctcacgg agctcccagt cctaatcaca
2521 ttcaaggtca ccaggtacag ttgtacaggt tgtacactgc aggagagtgc ctggcaaaaa
2581 gatcaaatgg ggctgggact tctcattggc caacctgcct ttccccagaa ggagtgattt
2641 ttctatcggc acaaaagcac tatatggact ggtaatggtt acaggttcag agattaccca
2701 gtgaggcctt attcctccct tccccccaaa actgacacct tgttagcca cctccccacc
2761 cacatacatt tctgccagtg ttcacaatga cactcagcgg tcatgtctgg acatgagtgc
2821 ccagggaata tgcccaagct atgccttgtc ctcttgtcct gtttgcattt cactgggagc
2881 ttgcactatg cagctccagt ttcctgcagt gatcagggtc ctgcaagcag tggggaaggg
2941 ggccaaggta ttggaggact ccctcccagc tttggaagcc tcatccgcgt gtgtgtgtgt
3001 gtgtatgtgt agacaagctc tcgctctgtc acccaggctg gagtgcagtg gtgcaatcat
3061 ggttcactgc agtcttgacc ttttgggctc aagtgatcct cccacctcag cctcctgagt
3121 agctgggacc ataggctcac aacaccacac ctggcaaatt tgattttttt ttttttttcca
3181 gagacggggt ctcgcaacat tgcccagact tcctttgtgt tagttaataa agctttctca
3241 actgccaaa
```

Collagen (NCBI Ref.: NM_000088.3; SEQ ID NO: 178)

```
  1 tcgtcggagc agacgggagt ttctcctcgg ggtcggagca ggaggcacgc ggagtgtgag
 61 gccacgcatg agcggacgct aaccccctcc ccagccacaa agagtctaca tgtctagggt
121 ctagacatgt tcagctttgt ggacctccgg ctcctgctcc tcttagcggc caccgccctc
181 ctgacgcacg gccaagagga aggccaagtc gagggccaag acgaagacat cccaccaatc
241 acctgcgtac agaacggcct caggtaccat gaccgagacg tgtggaaacc cgagccctgc
301 cggatctgcg tctgcgacaa cggcaaggtg ttgtgcgatg acgtgatctg tgacgagacc
361 aagaactgcc ccggcgccga agtccccgag ggcgagtgct gtccgtctg ccccgacggc
421 tcagagtcac ccaccgacca agaaaccacc ggcgtcgagg acccaagggg agacactggc
481 ccccgaggcc caaggggacc cgcaggcccc cctggccgag atggcatccc tggacagcct
541 ggacttcccg gaccccccgg accccccgga cctcccggac ccctggcct cggaggaaac
601 tttgctcccc agctgtctta tggctatgat gagaaatcaa ccggaggaat ttccgtgcct
661 ggccccatgg gtcctctg tcctcgtggt ctccctggcc cccctggtgc acctggtccc
721 caaggcttcc aaggtccccc tggtgagcct ggcgagcctg gagcttcagg tcccatgggt
781 ccccgaggtc ccccaggtcc ccctggaaag aatggagatg atgggaagc tggaaaacct
841 ggtcgtcctg gtgagcgtgg gcctcctggg cctcagggtg ctcgaggatt gccggaaca
901 gctggcctcc ctggaatgaa gggacacaga ggtttcagtg gtttggatgg tgccaaggga
961 gatgctggtc ctgctggtcc taagggtgag cctggcagcc ctggtgaaaa tggagctcct
1021 ggtcagatgg gccccgtgg cctgctggt gagagaggtc gccctggagc cctggccct
1081 gctggtgctc gtgaaatga tggtgctact ggtgctgccg gccccctgg tcccaccggc
1141 cccgctggtc ctcctggctt ccctggtgct gttggtgcta agggtgaagc tggtccccaa
1201 gggccccgag gctctgaagg tccccagggt gtgcgtggtg agcctggccc cctggccct
```

-continued

```
1261 gctggtgctg ctggccctgc tggaaaccct ggtgctgatg acagcctgg tgctaaaggt
1321 gccaatggtg ctcctggtat tgctggtgct cctggcttcc ctggtgcccg aggcccctct
1381 ggaccccagg gccccggcgg ccctcctggt cccaagggta acagcggtga acctggtgct
1441 cctggcagca aaggagacac tggtgctaag ggagagcctg gccctgttgg tgttcaagga
1501 cccccctggcc ctgctggaga ggaaggaaag cgaggagctc gaggtgaacc cggacccact
1561 ggcctgcccg accccctgg cgagcgtggt ggacctggta gccgtggttt ccctggcgca
1621 gatggtgttg ctggtcccaa gggtcccgct ggtgaacgtg ttctcctgg ccctgctggc
1681 cccaaaggat ctcctggtga agctggtcgt cccggtgaag ctggtctgcc tggtgccaag
1741 ggtctgactg gaagccctgg cagccctggt cctgatggca aaactggccc cctggtccc
1801 gccggtcaag atggtcgccc cggaccccca ggcccacctg gtgcccgtgg tcaggctggt
1861 gtgatgggat tccctggacc taaaggtgct gctggagagc ccggcaaggc tggagagcga
1921 ggtgttcccg accccctgg cgctgtcggt cctgctggca aagatggaga ggctggagct
1981 cagggacccc ctggccctgc tggtcccgct ggcgagagag gtgaacaagg ccctgctggc
2041 tcccccggat ccagggtct ccctggtcct gctggtcctc caggtgaagc aggcaaacct
2101 ggtgaacagg gtgttcctgg agaccttggc gcccctggcc cctctggagc aagaggcgag
2161 agaggtttcc ctggcgagcg tggtgtgcaa ggtcccctg gtcctgctgg tccccgaggg
2221 gccaacggtg ctcccggcaa cgatggtgct aagggtgatg ctggtgcccc tggagctccc
2281 ggtagccagg gcgcccctgg ccttcaggga atgcctggtg aacgtggtgc agctggtctt
2341 ccagggccta agggtgacag aggtgatgct ggtcccaaag gtgctgatgg ctctcctggc
2401 aaagatggcg tccgtggtct gactggcccc attggtcctc ctggccctgc tggtgcccct
2461 ggtgacaagg gtgaaagtgg tcccagcggc cctgctggtc ccactggagc tcgtggtgcc
2521 cccggagacc gtggtgagcc tggtcccccc ggccctgctg gctttgctgg cccccctggt
2581 gctgacggcc aacctggtgc taaaggcgaa cctggtgatc ctggtgctaa aggcgatgct
2641 ggtccccctg gccctgccgg accgctgga ccccctggcc ccattggtaa tgttggtgct
2701 cctggagcca aaggtgctcg cggcagcgct ggtccccctg gtgctactgg tttccctggt
2761 gctgctggcc gagtcggtcc tcctggcccc tctggaaatg ctggaccccc tggccctcct
2821 ggtcctgctg gcaaagaagg cggcaaaggt ccccgtggtg agactggccc tgctggacgt
2881 cctggtgaag ttggtccccc tggtccccct ggccctgctg gcgagaaagg atcccctggt
2941 gctgatggtc ctgctggtgc tcctggtact cccgggcctc aaggtattgc tggacagcgt
3001 ggtgtggtcg gcctgcctgg tcagagagga gagagaggct tccctggtct tcctggcccc
3061 tctggtgaac ctggcaaaca aggtcccctct ggagcaagtg gtgaacgtgg tccccctggt
3121 cccatgggcc ccctggatt ggctggaccc ctggtgaat ctggacgtga ggggctcct
3181 ggtgccgaag ttcccctgg acgagacggt tctcctggcg ccaagggtga ccgtggtgag
3241 accggccccg ctggaccccc tggtgctcct ggtgctcctg gtgccctgg cccgttggc
3301 cctgctggca gagtggtga tcgtggtgag actggtcctg ctggtccgc cggtcctgtc
3361 ggccctgttg gcgcccgtgg ccccgccgga ccccaaggcc ccgtggtga caagggtgag
3421 acaggcgaac agggcgacag aggcataaag ggtcaccgtg gcttctctgg cctccaggt
3481 ccccctggcc ctcctggctc tcctggtgaa caaggtccct ctggagcctc tggtcctgct
3541 ggtccccgag gtcccctgg ctctgctggt gctcctggca aagatggact caacggtctc
3601 cctggccca ttgggccccc tggtcctcgc ggtcgcactg tgatgctgg tcctgttggt
```

-continued

```
3661 ccccccggcc ctcctggacc tcctggtccc cctggtcctc ccagcgctgg tttcgacttc
3721 agcttcctgc cccagccacc tcaagagaag gctcacgatg gtggccgcta ctaccgggct
3781 gatgatgcca atgtggttcg tgaccgtgac ctcgaggtgg acaccaccct caagagcctg
3841 agccagcaga tcgagaacat ccggagccca gagggcagcc gcaagaaccc cgcccgcacc
3901 tgccgtgacc tcaagatgtg ccactctgac tggaagagtg gagagtactg gattgacccc
3961 aaccaaggct gcaacctgga tgccatcaaa gtcttctgca acatggagac tggtgagacc
4021 tgcgtgtacc ccactcagcc cagtgtggcc cagaagaact ggtacatcag caagaacccc
4081 aaggacaaga ggcatgtctg gttcggcgag agcatgaccg atggattcca gttcgagtat
4141 ggcggccagg gctccgaccc tgccgatgtg gccatccagc tgaccttcct gcgcctgatg
4201 tccaccgagg cctcccagaa catcacctac cactgcaaga acagcgtggc ctacatggac
4261 cagcagactg gcaacctcaa gaaggccctg ctcctccagg gctccaacga gatcgagatc
4321 cgcgccgagg gcaacagccg cttcacctac agcgtcactg tcgatggctg cacgagtcac
4381 accggagcct ggggcaagac agtgattgaa tacaaaacca ccaagacctc ccgcctgccc
4441 atcatcgatg tggccccctt ggacgttggt gccccagacc aggaattcgg cttcgacgtt
4501 ggccctgtct gcttcctgta aactccctcc atcccaacct ggctccctcc cacccaacca
4561 actttccccc caacccggaa acagacaagc aacccaaact gaaccccctc aaaagccaaa
4621 aaatgggaga caatttcaca tggactttgg aaaatatttt tttcctttgc attcatctct
4681 caaacttagt ttttatcttt gaccaaccga acatgaccaa aaaccaaaag tgcattcaac
4741 cttaccaaaa aaaaaaaaaa aaaaagaata aataaataac tttttaaaaa aggaagcttg
4801 gtccacttgc ttgaagaccc atgcgggggt aagtcccttt ctgcccgttg ggcttatgaa
4861 accccaatgc tgccctttct gctcctttct ccacaccccc cttggggcct cccctccact
4921 ccttcccaaa tctgtctccc cagaagacac aggaaacaat gtattgtctg cccagcaatc
4981 aaaggcaatg ctcaaacacc caagtggccc ccaccctcag cccgctcctg cccgcccagc
5041 acccccaggc cctgggggac ctggggttct cagactgcca aagaagcctt gccatctggc
5101 gctcccatgg ctcttgcaac atctcccctt cgtttttgag gggtcatgc cgggggagcc
5161 accagcccct cactgggttc ggaggagagt caggaagggc cacgacaaag cagaaacatc
5221 ggatttgggg aacgcgtgtc aatcccttgt gccgcagggc tgggcgggag agactgttct
5281 gttccttgtg taactgtgtt gctgaaagac tacctcgttc ttgtcttgat gtgtcaccgg
5341 ggcaactgcc tgggggcggg gatgggggca gggtggaagc ggctccccat tttataccaa
5401 aggtgctaca tctatgtgat gggtggggtg gggagggaat cactggtgct atagaaattg
5461 agatgccccc ccaggccagc aaatgttcct ttttgttcaa agtctatttt tattccttga
5521 tatttttctt tttttttttt tttttttgtg gatggggact tgtgaatttt tctaaaggtg
5581 ctatttaaca tgggaggaga gcgtgtgcgg ctccagccca gcccgctgct cactttccac
5641 cctctctcca cctgcctctg gcttctcagg cctctgctct ccgacctctc tcctctgaaa
5701 ccctcctcca cagctgcagc ccatcctccc ggctccctcc tagtctgtcc tgcgtcctct
5761 gtccccgggt ttcagagaca acttcccaaa gcacaaagca gtttttcccc ctaggggtgg
5821 gaggaagcaa aagactctgt acctattttg tatgtgtata ataatttgag atgtttttaa
5881 ttattttgat tgctggaata aagcatgtgg aaatgaccca aacataa
```

E-cadherin (NCBI Ref.: NM_001317184.1; SEQ ID NO: 179)

```
   1 tcagtggcgt cggaactgca aagcacctgt gagcttgcgg aagtcagttc agactccagc
  61 ccgctccagc ccggcccgac ccgaccgcac ccggcgcctg ccctcgctcg gcgtccccgg
```

-continued

```
 121 ccagccatgg gcccttggag ccgcagcctc tcggcgctgc tgctgctgct gcaggtctcc
 181 tcttggctct gccaggagcc ggagccctgc caccctggct tgacgccga gagctacacg
 241 ttcacggtgc cccggcgcca cctggagaga ggccgcgtcc tgggcagagt gaattttgaa
 301 gattgcaccg gtcgacaaag gacagcctat ttttccctcg acacccgatt caaagtgggc
 361 acagatggtg tgattacagt caaaaggcct ctacggtttc ataacccaca gatccatttc
 421 ttggtctacg cctgggactc cacctacaga aagttttcca ccaaagtcac gctgaataca
 481 gtggggcacc accaccgccc ccgccccat caggcctccg tttctggaat ccaagcagaa
 541 ttgctcacat ttcccaactc ctctcctggc ctcagaagac agaagagaga ctgggttatt
 601 cctcccatca gctgcccaga aaatgaaaaa ggcccatttc ctaaaaacct ggttcagatc
 661 aaatccaaca aagacaaaga aggcaaggtt ttctacagca tcactggcca aggagctgac
 721 acaccccctg ttggtgtctt tattattgaa agagaaacag gatggctgaa ggtgacagag
 781 cctctggata gagaacgcat tgccacatac actctcttct ctcacgctgt gtcatccaac
 841 gggaatgcag ttgaggatcc aatggagatt ttgatcacgg taaccgatca gaatgacaac
 901 aagcccgaat cacccagga ggtctttaag gggtctgtca tggaaggtgc tcttccagga
 961 acctctgtga tggaggtcac agccacagac gcggacgatg atgtgaacac ctacaatgcc
1021 gccatcgctt acaccatcct cagccaagat cctgagctcc ctgacaaaaa tatgttcacc
1081 attaacagga acacaggagt catcagtgtg gtcaccactg gctggaccg agagagtttc
1141 cctacgtata ccctggtggt tcaagctgct gaccttcaag gtgagggtt aagcacaaca
1201 gcaacagctg tgatcacagt cactgacacc aacgataatc ctccgatctt caatcccacc
1261 acgggcttgg attttgaggc caagcagcag tacattctac acgtagcagt gacgaatgtg
1321 gtacctttg aggtctctct caccacctcc acagccaccg tcaccgtgga tgtgctggat
1381 gtgaatgaag cccccatctt tgtgcctcct gaaaagagag tggaagtgtc cgaggacttt
1441 ggcgtgggcc aggaaatcac atcctacact gcccaggagc cagacacatt tatggaacag
1501 aaaataacat atcggatttg gagagacact gccaactggc tggagattaa tccggacact
1561 ggtgccattt ccactcgggc tgagctggac agggaggatt ttgagcacgt gaagaacagc
1621 acgtacacag ccctaatcat agctacagac aatggttctc cagttgctac tggaacaggg
1681 acacttctgc tgatcctgtc tgatgtgaat gacaacgccc ccatacccaga acctcgaact
1741 atattcttct gtgagaggaa tccaaagcct caggtcataa acatcattga tgcagacctt
1801 cctcccaata catctccctt cacagcagaa ctaacacacg gggcgagtgc caactggacc
1861 attcagtaca acgacccaac ccaagaatct atcatttga agccaaagat ggccttagag
1921 gtgggtgact acaaaatcaa tctcaagctc atggataacc agaataaaga ccaagtgacc
1981 accttagagg tcagcgtgtg tgactgtgaa ggggccgctg gcgtctgtag aaggcacag
2041 cctgtcgaag caggattgca aattcctgcc attctgggga ttcttggagg aattcttgct
2101 ttgctaattc tgattctgct gctcttgctg tttcttcgga ggagagcggt ggtcaaagag
2161 cccttactgc ccccagagga tgacacccgg gacaacgttt attactatga tgaagaagga
2221 ggcggagaag aggaccagga ctttgacttg agccagctgc acaggggcct ggacgctcgg
2281 cctgaagtga ctcgtaacga cgttgcacca accctcatga gtgtccccg gtatcttccc
2341 cgccctgcca atcccgatga aattggaaat tttattgatg aaaatctgaa agcggctgat
2401 actgacccca cagccccgcc ttatgattct ctgtctcgtgt ttgactatga aggaagcggt
2461 tccgaagctg ctagtctgag ctccctgaac tcctcagagt cagacaaaga ccaggactat
```

-continued

```
2521 gactacttga acgaatgggg caatcgcttc aagaagctgg ctgacatgta cggaggcggc
2581 gaggacgact aggggactcg agagaggcgg gccccagacc catgtgctgg gaaatgcaga
2641 aatcacgttg ctggtggttt ttcagctccc ttcccttgag atgagtttct ggggaaaaaa
2701 aagagactgg ttagtgatgc agttagtata gctttatact ctctccactt tatagctcta
2761 ataagtttgt gttagaaaag tttcgactta tttcttaaag cttttttttt tttcccatca
2821 ctctttacat ggtggtgatg tccaaaagat acccaaattt taatattcca gaagaacaac
2881 tttagcatca gaaggttcac ccagcacctt gcagattttc ttaaggaatt ttgtctcact
2941 tttaaaaaga aggggagaag tcagctactc tagttctgtt gttttgtgta tataattttt
3001 taaaaaaaat ttgtgtgctt ctgctcatta ctacactggt gtgtccctct gcctttttt
3061 ttttttttaag acagggtctc attctatcgg ccaggctgga gtgcagtggt gcaatcacag
3121 ctcactgcag ccttgtcctc ccaggctcaa gctatccttg cacctcagcc tcccaagtag
3181 ctgggaccac aggcatgcac cactacgcat gactaattt ttaaatattt gagacgggt
3241 ctccctgtgt tacccaggct ggtctcaaac tcctgggctc aagtgatcct cccatcttgg
3301 cctcccagag tattgggatt acagacatga gccactgcac ctgcccagct ccccaactcc
3361 ctgccatttt ttaagagaca gtttcgctcc atcgcccagg cctgggatgc agtgatgtga
3421 tcatagctca ctgtaacctc aaactctggg gctcaagcag ttctcccacc agcctccttt
3481 ttattttttt gtacagatgg ggtcttgcta tgttgcccaa gctggtctta aactcctggc
3541 ctcaagcaat ccttctgcct tggccccca aagtgctggg attgtgggca tgagctgctg
3601 tgcccagcct ccatgttta atatcaactc tcactcctga attcagttgc tttgcccaag
3661 ataggagttc tctgatgcag aaattattgg gctcttttag ggtaagaagt ttgtgtcttt
3721 gtctggccac atcttgacta ggtattgtct actctgaaga cctttaatgg cttccctctt
3781 tcatctcctg agtatgtaac ttgcaatggg cagctatcca gtgacttgtt ctgagtaagt
3841 gtgttcatta atgtttattt agctctgaag caagagtgat atactccagg acttagaata
3901 gtgcctaaag tgctgcagcc aaagacagag cggaactatg aaaagtgggc ttggagatgg
3961 caggagagct tgtcattgag cctggcaatt tagcaaactg atgctgagga tgattgaggt
4021 gggtctacct catctctgaa aattctggaa ggaatggagg agtctcaaca tgtgtttctg
4081 acacaagatc cgtggtttgt actcaaagcc cagaatcccc aagtgcctgc ttttgatgat
4141 gtctacagaa aatgctggct gagctgaaca catttgccca attccaggtg tgcacagaaa
4201 accgagaata ttcaaaattc caaatttttt tcttaggagc aagaagaaaa tgtggcccta
4261 aaggggggtta gttgagggg aggggtagt gaggatcttg atttggatct cttttttattt
4321 aaatgtgaat ttcaactttt gacaatcaaa gaaaagactt ttgttgaaat agctttactg
4381 tttctcaagt gttttggaga aaaaatcaa ccctgcaatc acttttttgga attgtcttga
4441 ttttttcggca gttcaagcta tatcgaatat agttctgtgt agagaatgtc actgtagttt
4501 tgagtgtata catgtgtggg tgctgataat tgtgtatttt ctttggggt ggaaaaggaa
4561 aacaattcaa gctgagaaaa gtattctcaa agatgcattt ttataaattt tattaaacaa
4621 ttttgttaaa ccattaaaaa aaaaaaaaa aaaaaaaaa aa
```

Laminin (LAMA1)

(NCBI Ref.: NM_005559.3; SEQ ID NO: 180)

```
  1 cggggccagg gcagcgcgga ctcgcgtccc gtgagcgtt ccaggcgggc gcgcggcttt
 61 ctccccagac ccaccgagtg gcggcggagg cgagatgcgc gggggcgtgc tcctggtctt
121 gctgctgtgt gtcgccgcgc agtgccggca gagaggcctg tttcctgcca ttctcaatct
181 tgccagcaat gctcacatca gcaccaatgc cacctgtggc agaagggggc cggagatgtt
```

-continued

```
 241 ctgcaaactt gtggagcatg tgccaggtcg gcccgtccga aacccacagt gccggatctg 301 tgatggcaac agcgcaaacc ccagagaacg ccatccaata tcacatgcca tagatggcac 361 caataactgg tggcaaagtc ccagcattca gaatgggaga gaatatcact gggtcacaat 421 cactctggac ttaagacagg tctttcaagt tgcatatgtc atcattaaag ctgccaatgc 481 ccctcgacct ggaaactgga ttttggagcg ttctctggat ggcaccacgt tcagccnctg 541 gcagtattat gcagtcagcg actcagagtg tttgtctcgt tacaatataa ctccaagacg 601 agggccaccc acctacaggg ctgatgatga agtgatctgc acctcctatt attccagatt 661 ggtgccactt gagcatggag agattcatac atcactcatc aatggcagac caagcgctga 721 cgatctttca cccaagttgt tggaattcac ttctgcacga tatattcgcc ttcgcttgca 781 acgcattaga acgctcaatg cagatctcat gacccttagc caccgggaac ctaaagaact 841 ggatcctatt gttaccagac gctattatta ttcaataaag gacatttctg ttggaggcat 901 gtgtatctgc tatggccatg ctagtagctg cccatgggat gaaactacaa agaaactgca 961 gtgtcaatgt gagcataata cttgcgggga gagctgtaac aggtgctgtc ctgggtacca 1021 tcagcagccc tggaggccgg gaaccgtgtc ctccggcaat acatgtgaag catgtaattg 1081 tcacaataaa gccaaagact gttactatga tgaaagtgtt gcaaagcaga agaaaagttt 1141 gaatactgct ggacagttca gaggaggagg ggtttgcata aattgcttgc agaacaccat 1201 gggaatcaac tgtgaaacct gtattgatgg atattataga ccacacaaag tgtctcctta 1261 tgaggatgag ccttgccgcc cctgtaattg tgaccctgtg gggtccctca gttctgtctg 1321 tattaaggat gacctccatt ctgacttaca caatgggaag cagccaggtc agtgcccatg 1381 taaggaaggt tatacaggag aaaaatgtga tcgctgccaa cttggctata aggattaccc 1441 gacctgtgtc tcctgtgggt gcaacccagt gggcagtgcc agtgatgagc cctgcacagg 1501 gccctgtgtt tgtaaggaaa acgttgaggg gaaggcctgt gatcgctgca agccaggatt 1561 ctataacttg aaggaaaaaa accccgggg ctgctccgag tgcttctgct ttggcgtttc 1621 tgatgtctgc agcagcctct cttggcctgt tggtcaggta acagtatgt ccgggtggct 1681 ggtcaccgac ttgatcagtc ccaggaagat cccgtctcag caagatgcac taggcgggcg 1741 ccatcaggtc agcatcaaca acaccgcggt catgcagaga ctggctccca agtactactg 1801 ggcagccccc gaggcctacc ttggaaataa gctgactgcg tttggcggat tcctgaaata 1861 cacggtgtcc tacgatattc cggtagagac ggtagacagt aacctcatgt cgcatgctga 1921 cgtcatcatt aagggaaacg gactcacttt aagcacacag gctgagggtc tgtcattgca 1981 gccttatgaa gagtacctaa acgtggttag acttgtgcct gaaaacttcc aagattttca 2041 cagcaaaagg cagattgatc gtgaccagct gatgactgtc cttgccaatg tgacacatct 2101 tttgatcaga gccaactaca attctgcaaa aatggctctt tacaggttgg agtccgtctc 2161 tctggacata gccagctcta atgccatcga cctggtggtg gccgctgatg tggagcactg 2221 tgaatgtccg caaggctaca cagggacctc ctgtgagtcg tgcctctctg gctattaccg 2281 cgtggatgga atactctttg gaggaatttg tcaaccctgt gaatgccacg gcatgcagc 2341 tgagtgtaat gttcacggcg tttgcattgc gtgtgcgcac aacaccaccg gcgtccactg 2401 tgagcagtgc ttgcccggct tctacgggga gccttcccga gggacacctg gggactgcca 2461 gccctgcgcc tgccctctca ccatagcctc caacaatttc agccccacct gccacctcaa 2521 tgatggagat gaagtggtct gtgactggtg tgccccgggc tactcaggag cttggtgtga 2581 gagatgtgca gatggttact atggaaaccc aacagtgcct ggcgaatctt gtgttccctg
```

-continued

```
2641 tgactgcagc ggcaacgtgg acccctcgga ggctggtcac tgtgactcag tcaccgggga 2701 gtgcctgaag tgcctgggga acacagatgg cgcccactgt gaaaggtgtg ctgacgggtt 2761 ctatggggac gctgtgacag ccaagaactg ccgcgcctgt gaatgccatg tgaaaggctc 2821 ccattctgcc gtgtgccatc ttgagaccgg gctctgtgac tgcaaaccaa acgtgactgg 2881 acagcagtgt gaccagtgct tgcatggcta ttatgggctg gactcaggcc atggctgccg 2941 gccctgcaac tgcagcgtgg caggctccgt gtcagatggc tgcacggatg aaggccagtg 3001 tcactgtgtc ccaggtgtgg cagggaaaag tgtgacagg tgtgcccatg gcttctacgc 3061 ctaccaggat ggtagctgta caccctgtga ctgcccacac actcagaata cctgcgaccc 3121 agaaactgga gagtgtgtct gccccccctca cacacagggt gtgaagtgtg aagaatgtga 3181 ggatgggcac tggggctacg atgcggaggt ggggtgccag gctgcaatt gcagtctcgt 3241 ggggtcgact catcatcggt gcgatgtggt caccggccat tgccagtgca agtcaaaatt 3301 tggtggccgg gcctgcgatc agtgttcctt gggttacaga actttcccg actgtgttcc 3361 ctgtgactgt gacctgaggg gacgtcggg gacgcctgc aacctggagc agggtctctg 3421 cggctgtgtg aggaaaaccg gggcctgccc ttgcaaggaa aatgtctttg gtcctcagtg 3481 caacgaatgt cgagagggca ccttcgctct ccgcgcagac aaccccctgg gctgcagccc 3541 gtgcttctgc tccgggctgt cccacctctg ctcagagctg gaggactacg tgaggacccc 3601 agtaacgctg ggctccgatc agcctcttct gcgtgtggtt tctcagagta acttgagggg 3661 cacgaccgag ggggtttact accaggcccc cgacttcctg ctggatgccg ccaccgtccg 3721 gcagcacatc cgtgcagagc cgttttactg gcggctgccg cagcagttcc aaggagacca 3781 gctcatggcc tatggtggca aactgaagta cagcgtggcc ttctattctt tggatggcgt 3841 cggcaccctcc aattttgagc ctcaagttct catcaaaggt ggtcggatca gaaagcaagt 3901 catttacatg gatgcaccag ccccagagaa tggagtgaga caggaacaag aagtagcaat 3961 gagagagaat ttttggaaat attttaactc tgtttctgaa aaacctgtca cgcgagagga 4021 ttttatgtct gtcctcagcg atattgagta catcctcatc aaggcatcgt atggtcaagg 4081 attacagcag agcagaatct cagacatttc aatggaggtt ggcagaaagg ctgaaaagct 4141 gcacccagaa gaagaggttg catctcttt agagaattgt gtctgtcctc ctggcactgt 4201 gggattctca tgtcaggact gcgcccctgg gtaccacaga gggaagctcc cagcagggag 4261 tgacagggga ccacgccctc tggttgctcc ttgtgttccc tgcagttgca acaaccacag 4321 tgacacctgt gaccccaaca ccgggaagtg tctgaactgt ggcgataaca cagcaggtga 4381 ccattgtgat gtgtgtactt ctggctacta cgggaaggtg actggctcag caagtgactg 4441 tgctctgtgt gcctgtcctc acagccctcc tgccagtttt agtcccactt gtgtcttgga 4501 aggggaccac gatttccgtt gtgacgcctg tctcctgggc tatgaaggaa acactgtga 4561 aaggtgctcc tcaagctatt atgggaaccc tcaaacacca ggtggcagtt gccagaagtg 4621 tgactgcaac ccgcacggct ctgtccacgg tgactgtgac cgcacatctg ggcagtgcgt 4681 ttgcaggctg ggggcctcgg ggctccggtg cgatgagtgt gaaccgaggc acattctgat 4741 ggaaacagat tgtgtttcct gtgatgatga gtgtgtaggt gtgctgctga atgacttgga 4801 tgagattggt gatgccgttc tttctctgaa cctcactggc attatccctg tcccatatgg 4861 aattttgtca aacctggaaa atacaactaa atatctccag gaatctttat taaagaaaa 4921 tatgcaaaag gacctgggaa aaattaagct tgaaggtgtt gcagaagaaa cggacaacct 4981 gcaaaagaag ctcactagga tgttagcgag taccccaaaag gtgaataggg caactgagag 5041 aatcttcaag gagagtcaag acctggccat agccattgag aggctgcaga tgagcatcac
```

-continued

```
5101 agaaattatg gaaaagacaa ctttaaatca gactttggat gaagatttcc tactacccaa 5161 ttctactctt cagaacatgc aacagaatgg tacatctttg ctagaaatca tgcagataag 5221 agacttcaca cagttgcacc aaaatgccac ccttgaactc aaggctgctg aagatttatt 5281 gtcacaaatt caggaaaatt accagaagcc gctggaagaa ttggaggtat tgaaagaagc 5341 agcaagccac gtcctttcaa agcacaacaa tgaactaaag gcggctgagg cgctcgtgag 5401 ggaagctgag gcaaagatgc aggaaagcaa ccacctgctg ctcatggtca atgctaatct 5461 gagagaattc agtgataaaa agctgcatgt tcaagaagaa caaaatctga cctcagagct 5521 cattgtccaa ggaagaggat tgatagatgc tgctgctgca caaacagatg ctgtacaaga 5581 tgctctagag cacttagagg atcaccagga taagctactt ttatggtctg ccaaaatcag 5641 gcaccacata gatgacctgg tcatgcacat gtcccaaagg aacgcagtcg acctggtcta 5701 cagagctgag gaccatgccg ctgagttcca gagactagca gatgttctgt acagtggcct 5761 tgaaaacatc agaaatgtgt ccctgaatgc caccagtgca gcctatgtcc attacaacat 5821 ccagagcctg attgaagaat cggaggaact ggccagagat gctcacagga ctgtgactga 5881 gacgagcctg ctctcagaat cccttgtttc taacggaaaa gcggccgtgc agcgcagctc 5941 cagatttcta aaagaaggca acaacctcag caggaagctt ccaggtattg cattggaact 6001 gagtgaattg agaaataaga caaacagatt tcaagagaat gctgttgaaa ttaccaggca 6061 aaccaatgaa tcactcttga tacttagagc aattcctaaa ggtataagag acaagggagc 6121 caaaaccaaa gagctggcca cgtctgcaag ccagagcgcg gtgagcacgc tgagggacgt 6181 ggcggggctg agccaggagc tgctgaacac atctgccagc ctgtccaggg tcaacaccac 6241 attacgagag acacaccagc ttctgcagga ctccaccatg gccactctgt ggctggaag 6301 aaaagtcaaa gacgtggaaa ttcaagccaa ccttttgttt gatcggttga agcctttgaa 6361 gatgttagag gagaatctga gcagaaacct atcagaaatt aaactgttga tcagccaggc 6421 ccgcaaacaa gcagcttcta ttaaagtcgc cgtgtctgca gacagagatt gcatccgggc 6481 ctaccagcct cagatttcct ctaccaacta caatacctta acactaaatg ttaagacaca 6541 ggaacccgat aatcttctct tctacctcgg tagcagcacc gcttctgatt ccttgcagt 6601 ggagatgcgg cgagggagag tggccttcct gtgggacctg ggctccgggt ccacacgctt 6661 ggagtttcca gactttccca ttgatgacaa cagatggcac agtatccatg tagccagatt 6721 tggaaacatt ggttcactga gtgtaaagga aatgagctca aatcaaaagt caccaacaaa 6781 aacaagtaaa tcccctggga cagctaatgt tctggatgta aacaattcaa cactcatgtt 6841 tgttggaggt cttggaggac aaatcaagaa atctcctgct gtgaaggtta ctcattttaa 6901 aggctgcttg ggggaggcct tcctgaatgg aaaatccata ggcctatgga actatattga 6961 aagggaaggc aagtgccgtg ggtgcttcgg aagctcccag aatgaagacc cttccttcca 7021 ttttgacggg agtgggtact ctgtcgtgga gaagtcactt ccggctaccg tgacccagat 7081 aatcatgctt tttaatacct tttcacctaa tggacttctt ctctacctgg gttcatacgg 7141 cacaaaagac ttttatcca tcgagctgtt tcgtggcaga gtgaaggtta tgactgacct 7201 gggttcagga cccattaccc ttttgacaga cagacgttat aacaatggaa cctggtacaa 7261 aattgccttc agcgaaaccc ggaagcaagg agtgctagca gttatcgatg cctataacac 7321 cagtaataaa gaaaccaagc agggcgagac tccgggagca tcttctgacc tcaaccgcct 7381 agacaaggac ccgatttatg tgggtggatt accaaggtca agagttgtaa ggagaggtgt 7441 caccaccaaa agctttgtgg gctgcatcaa gaacctggaa atatccagat caacctttga
```

-continued

```
7501 cttactcaga aattcctatg gagtgagaaa aggctgttta ctggagccca tccggagtgt
7561 tagcttcctg aaaggcggct acattgaatt gccacccaaa tctttgtcac cagaatcaga
7621 atggctggta acatttgcca ccacgaacag cagtggcatc atcctggctg ccctcggcgg
7681 ggatgtggag aagcggggtg atcgtgagga agcacacgtg cccttctttt ccgtcatgct
7741 gatcggaggc aacattgagg tacatgtcaa tcctggggat gggacaggcc tgagaaaagc
7801 tctcctgcac gctcccacgg gtacctgcag tgatggacaa gcgcattcca tctccttggt
7861 caggaatcgg agaattatca ctgtccaatt ggatgagaac aatcctgtgg aaatgaagtt
7921 gggcacatta gtagaaagca ggacgataaa tgtgtccaat ctgtacgtcg ggggaattcc
7981 agagggagag gggacgtcac tgctcacaat gagaagatcg ttccatggct gtatcaaaaa
8041 cctgatcttc aatttggaac ttttggattt caacagtgca gttggccatg agcaagtcga
8101 cctggacacc tgctggctgt cagaaaggcc taagctggct cccgatgcag aggacagcaa
8161 gctcttgcca gagcccaggg cttttccaga acagtgtgtg gtggatgcag ctctggagta
8221 cgttcccggc gctcaccagt ttggtctcac acaaaacagc catttcatct tgccttttaa
8281 tcagtcggct gtcagaaaga agctctcggt tgagctaagc atccgcacgt tcgcctccag
8341 cggcctgatt tactacatgg ctcatcagaa ccaagcagac tacgctgtgc tccagctgca
8401 cgggggccgc ctccacttca tgtttgacct tggcaaaggc agaacaaagg tctctcaccc
8461 tgcactgctc agtgatggca gtggcacac ggtcaagaca gactatgtta aaagaaaagg
8521 cttcataact gtcgacggcc gagagtctcc catggtgact gtggtgggag atggaaccat
8581 gctggatgtg gagggtttgt ctacctagg aggcctgccc tcccagtacc aggccaggaa
8641 aattggaaat atcacccaca gcatccctgc ctgcattggg gatgtgacgg ttaacagcaa
8701 acagctggac aaggacagcc cggtgtctgc cttcacggtg aacaggtgct acgcagtggc
8761 ccaggaagga acatactttg acggaagcgg atatgcagct cttgtcaaag agggctacaa
8821 agtccagtca gatgtgaaca tcacactgga gtttcgaacc tcctcgcaga atggcgtcct
8881 cctggggatc agcactgcca aagtggatgc cattggacta gagcttgtgg acggcaaggt
8941 cttgttccat gtcaacaatg gtgctggcag gataacagct gcatatgagc ccaaaaaccgc
9001 cactgtgctc tgtgatggaa aatggcacac tcttcaagct aacaaaagca acaccgtat
9061 cactctgatt gttgacggga acgcagttgg cgctgaaagt ccacacaccc agtctacctc
9121 agtggacacc aacaatccca tttatgttgg tggctatcct gctggtgtga agcaaaaatg
9181 cctgcgcagc cagacctcgt tccgcgggtg tttgaggaag ctagctctga ttaagagccc
9241 gcaggtgcag tcctttgact tcagcagagc gttcgaactg cacggagttt tccttcattc
9301 ctgtcctggg accgagtcct gaacttcaag cagaatcctc agttggaatc attgctaata
9361 ttttgaggag aagtgtatgt gtgaattaag aatctcttca gttcatattt catttccaac
9421 tcaggttaag tgtttctggg gagagatgtt gtgtttacgt tacactaaaa ccacatgtgc
9481 aacaaatacc tccattaaat ggtctaaaat gtaaattgaa ttccctggct ctattttaa
9541 acgtattttt aaaaaaatct ttatacacat tgaatgttct gttgattact tgatagtatt
9601 ttatgttttt cattttgagc ttttaaaaa agtatcaata cagatgataa cagatca
```

Fibulin-5

(NCBI Ref.: NM_006329.3; SEQ ID NO: 181)

```
   1 cgcccctcgc cttctgcccg ggcgctcgca gccgagcgcg gccggggaag ggctctcctc
  61 ccagcgccga gcactgggcc ctggcagacg ccccaagatt gttgtgagga gtctagccag
 121 ttggtgagcg ctgtaatctg aaccagctgt gtccagactg aggcccccatt tgcattgttt
 181 aacatactta gaaaatgaag tgttcatttt taacattcct cctccaattg gtttaatgct
```

-continued

```
 241 gaattactga agagggctaa gcaaaaccag gtgcttgcgc tgagggctct gcagtggctg
 301 ggaggacccc ggcgctctcc ccgtgtcctc tccacgactc gctcggcccc tctgaataa
 361 aacacccgcg agccccgagg gcccagagga ggccgacgtg cccgagctcc tccggggtc
 421 ccgcccgcga gctttcttct cgccttcgca tctcctcctc gcgcgtcttg acatgccag
 481 gaataaaaag gatactcact gttaccattc tggctctctg tcttccaagc cctgggaatg
 541 cacaggcaca gtgcacgaat ggctttgacc tggatcgcca gtcaggacag tgtttagata
 601 ttgatgaatg ccgaaccatc cccgaggcct gccgaggaga catgatgtgt gttaaccaaa
 661 atggcgggta tttatgcatt ccccggacaa accctgtgta tcgagggccc tactcgaacc
 721 cctactcgac cccctactca ggtccgtacc cagcagctgc cccaccactc tcagctccaa
 781 actatcccac gatctccagg cctcttatat gccgctttgg ataccagatg gatgaaagca
 841 accaatgtgt ggatgtggac gagtgtgcaa cagattccca ccagtgcaac cccacccaga
 901 tctgcatcaa tactgaaggc gggtacacct gctcctgcac cgacggatat tggcttctgg
 961 aaggccagtg cttagacatt gatgaatgtc gctatggtta ctgccagcag ctctgtgcga
1021 atgttcctgg atcctattct tgtacatgca accctggttt taccctcaat gaggatggaa
1081 ggtcttgcca agatgtgaac gagtgtgcca ccgagaaccc ctgcgtgcaa acctgcgtca
1141 acacctacgg ctctttcatc tgccgctgtg acccaggata tgaacttgag gaagatggcg
1201 ttcattgcag tgatatggac gagtgcagct tctctgagtt cctctgccaa catgagtgtg
1261 tgaaccagcc cggcacatac ttctgctcct gccctccagg ctacatcctg ctggatgaca
1321 accgaagctg ccaagacatc aacgaatgtg agcacaggaa ccacacgtgc aacctgcagc
1381 agacgtgcta caatttacaa gggggcttca atgcattga ccccatccgc tgtgaggagc
1441 cttatctgag gatcagtgat aaccgctgta tgtgtcctgc tgagaaccct ggctgcagag
1501 accagcccct taccatcttg taccgggaca tggacgtggt gtcaggacgc tccgttcccg
1561 ctgacatctt ccaaatgcaa gccacgaccc gctaccctgg ggcctattac atttttccaga
1621 tcaaatctgg gaatgagggc agagaatttt acatgcggca aacgggcccc atcagtgcca
1681 ccctggtgat gacacgcccc atcaaagggc cccgggaaat ccagctggac ttggaaatga
1741 tcactgtcaa cactgtcatc aacttcagag gcagctccgt gatccgactg cggatatatg
1801 tgtcgcagta cccattctga gcctcgggct ggagcctccg acgctgcctc tcattggcac
1861 caagggacag gagaagagag gaaataacag agagaatgag agcgacacag acgttaggca
1921 tttcctgctg aacgtttccc cgaagagtca gccccgactt cctgactctc acctgtacta
1981 ttgcagacct gtcaccctgc aggacttgcc accccagtt cctatgacac agttatcaaa
2041 aagtattatc attgctcccc tgatagaaga ttgttggtga atttcaagg ccttcagttt
2101 atttccacta ttttcaaaga aaatagatta ggtttgcggg ggtctgagtc tatgttcaaa
2161 gactgtgaac agcttgctgt cacttcttca cctcttccac tccttctctc actgtgttac
2221 tgctttgcaa agacccggga gctggcgggg aaccctggga gtagctagtt tgcttttgc
2281 gtacacagag aaggctatgt aaacaaacca cagcaggatc gaagggtttt tagagaatgt
2341 gtttcaaaac catgcctggt attttcaacc ataaaagaag tttcagttgt ccttaaattt
2401 gtataacggt ttaattctgt cttgttcatt ttgagtattt ttaaaaaata tgtcgtagaa
2461 ttccttcgaa aggccttcag acacatgcta tgttctgtct tcccaaaccc agtctcctct
2521 ccattttagc ccagtgtttt ctttgaggac cccttaatct tgctttcttt agaattttta
2581 cccaattgga ttggaatgca gaggtctcca aactgattaa atatttgaag agaaaaa
```

An antisense nucleic acid molecule can be complementary to all or part of a non-coding region of the coding strand of a nucleotide sequence encoding a target integrin or a target integrin ligand (e.g., any of the exemplary target integrins or any of the exemplary integrin ligands described herein). Non-coding regions (5' and 3' untranslated regions) are the 5' and 3' sequences that flank the coding region in a gene and are not translated into amino acids.

Based upon the sequences disclosed herein, one of skill in the art can easily choose and synthesize any of a number of appropriate antisense nucleic acids to target a nucleic acid encoding a target integrin (e.g., any of the exemplary target integrins described herein) or a nucleic acid encoding an integrin ligands (e.g., any of the exemplary integrin ligands described herein). Antisense nucleic acids targeting a nucleic acid encoding a target integrin (e.g., any of the exemplary integrins described herein) or a nucleic acid encoding an integrin ligand (e.g., any of the exemplary integrin ligands described herein) can be designed using the software available at the Integrated DNA Technologies website.

An antisense nucleic acid can be, for example, about 5, 10, 15, 20, 25, 30, 35, 40, 45, or 50 nucleotides or more in length. An antisense oligonucleotide can be constructed using chemical synthesis and enzymatic ligation reactions using procedures known in the art. For example, an antisense nucleic acid can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used.

Examples of modified nucleotides which can be used to generate an antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3) w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest).

The antisense nucleic acid molecules described herein can be prepared in vitro and administered to a mammal, e.g., a human. Alternatively, they can be generated in situ such that they hybridize with or bind to cellular mRNA and/or genomic DNA encoding a target integrin (e.g., any of the exemplary target integrins described herein) or encoding a integrin ligand (e.g., any of the exemplary integrin ligands described herein) to thereby inhibit expression, e.g., by inhibiting transcription and/or translation. The hybridization can be by conventional nucleotide complementarities to form a stable duplex, or, for example, in the case of an antisense nucleic acid molecule that binds to DNA duplexes, through specific interactions in the major groove of the double helix. The antisense nucleic acid molecules can be delivered to a mammalian cell using a vector (e.g., a lentivirus, a retrovirus, or an adenovirus vector).

An antisense nucleic acid can be an α-anomeric nucleic acid molecule. An α-anomeric nucleic acid molecule forms specific double-stranded hybrids with complementary RNA in which, contrary to the usual, β-units, the strands run parallel to each other (Gaultier et al., *Nucleic Acids Res.* 15:6625-6641, 1987). The antisense nucleic acid can also comprise a 2'-O-methylribonucleotide (Inoue et al., *Nucleic Acids Res.* 15:6131-6148, 1987) or a chimeric RNA-DNA analog (Inoue et al., *FEBS Lett.* 215:327-330, 1987).

Exemplary integrin inhibitors that are antisense nucleic acids include ATL1102 (e.g., Limmroth et al., *Neurology* 83 (20): 1780-1788, 2014; Li et al., *Dig. Liver Dis.* 39 (6): 557-565, 2007; Goto et al., *Inflamm. Bowel Dis.* 12 (8): 758-765, 2006).

Another example of an inhibitory nucleic acid is a ribozyme that has specificity for a nucleic acid encoding a target integrin (e.g., any of the exemplary target integrins described herein) or an integrin ligand (e.g., any of the exemplary integrin ligands described herein). Ribozymes are catalytic RNA molecules with ribonuclease activity that are capable of cleaving a single-stranded nucleic acid, such as an mRNA, to which they have a complementary region. Thus, ribozymes (e.g., hammerhead ribozymes (described in Haselhoff and Gerlach, *Nature* 334:585-591, 1988)) can be used to catalytically cleave mRNA transcripts to thereby inhibit translation of the protein encoded by the mRNA. A ribozyme having specificity for a target integrin (e.g., any of the exemplary target integrins described herein) or an integrin ligand (e.g., any of the exemplary integrin ligands described herein) can be designed based upon the nucleotide sequence of any of the integrin mRNA sequences or integrin ligand mRNA sequences disclosed herein or known in the art. For example, a derivative of a Tetrahymena L-19 IVS RNA can be constructed in which the nucleotide sequence of the active site is complementary to the nucleotide sequence to be cleaved in a target integrin mRNA or an integrin ligand mRNA (see, e.g., U.S. Pat. Nos. 4,987,071 and 5,116,742). Alternatively, an integrin mRNA (e.g., any of the exemplary integrin mRNAs described herein) or an integrin ligand mRNA (e.g., any of the exemplary integrin ligand mRNAs described herein) can be used to select a catalytic RNA having a specific ribonuclease activity from a pool of RNA molecules. See, e.g., Bartel et al., *Science* 261:1411-1418, 1993.

An inhibitory nucleic acid can also be a nucleic acid molecule that forms triple helical structures. For example, expression of a target integrin (e.g., any of the exemplary target integrins described herein) or an integrin ligand (e.g., any of the exemplary integrin ligands described herein) can be inhibited by targeting nucleotide sequences complementary to the regulatory region of the gene encoding the target integrin (e.g., any of the exemplary target integrins described herein) or the integrin ligand (e.g., any of the exemplary integrin ligands described herein) (e.g., the promoter and/or enhancer, e.g., a sequence that is at least 1 kb, 2 kb, 3 kb, 4 kb, or 5 kb upstream of the transcription initiation start state) to form triple helical structures that prevent transcription of the gene in target cells. See generally Helene, *Anticancer Drug Des.* 6 (6): 569-84, 1991; Helene, *Ann. N.Y. Acad. Sci.* 660:27-36, 1992; and Maher, *Bioassays* 14 (12): 807-15, 1992.

In various embodiments, inhibitory nucleic acids can be modified at the base moiety, sugar moiety, or phosphate backbone to improve, e.g., the stability, hybridization, or solubility of the molecule. For example, the deoxyribose phosphate backbone of the nucleic acids can be modified to generate peptide nucleic acids (see, e.g., Hyrup et al., *Bioorganic Medicinal Chem.* 4 (1): 5-23, 1996). Peptide nucleic acids (PNAs) are nucleic acid mimics, e.g., DNA mimics, in which the deoxyribose phosphate backbone is replaced by a pseudopeptide backbone and only the four natural nucleobases are retained. The neutral backbone of PNAs allows for specific hybridization to DNA and RNA under conditions of low ionic strength. The synthesis of PNA oligomers can be performed using standard solid phase peptide synthesis protocols (see, e.g., Perry-O'Keefe et al., *Proc. Natl. Acad. Sci. U.S.A.* 93:14670-675, 1996). PNAs can be used as antisense or antigene agents for sequence-specific modulation of gene expression by, e.g., inducing transcription or translation arrest or inhibiting replication.

PNAs can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras can be generated which may combine the advantageous properties of PNA and DNA. Such chimeras allow DNA recognition enzymes, e.g., RNAse H and DNA polymerases, to interact with the DNA portion while the PNA portion would provide high binding affinity and specificity. PNA-DNA chimeras can be linked using linkers of appropriate lengths selected in terms of base stacking, number of bonds between the nucleobases, and orientation.

The synthesis of PNA-DNA chimeras can be performed as described in Finn et al., *Nucleic Acids Res.* 24:3357-63, 1996. For example, a DNA chain can be synthesized on a solid support using standard phosphoramidite coupling chemistry and modified nucleoside analogs. Compounds such as 5'-(4-methoxytrityl)amino-5'-deoxy-thymidine phosphoramidite can be used as a link between the PNA and the 5' end of DNA (Mag et al., *Nucleic Acids Res.* 17:5973-88, 1989). PNA monomers are then coupled in a stepwise manner to produce a chimeric molecule with a 5' PNA segment and a 3' DNA segment (Finn et al., *Nucleic Acids Res.* 24:3357-63, 1996). Alternatively, chimeric molecules can be synthesized with a 5' DNA segment and a 3' PNA segment (Peterser et al., *Bioorganic Med. Chem. Lett.* 5:1119-11124, 1975).

In some embodiments, the inhibitory nucleic acids can include other appended groups such as peptides, or agents facilitating transport across the cell membrane (see, Letsinger et al., *Proc. Natl. Acad. Sci. U.S.A.* 86:6553-6556, 1989; Lemaitre et al., *Proc. Natl. Acad. Sci. U.S.A.* 84:648-652, 1989; and WO 88/09810). In addition, the inhibitory nucleic acids can be modified with hybridization-triggered cleavage agents (see, e.g., Krol et al., *Bio/Techniques* 6:958-976, 1988) or intercalating agents (see, e.g., Zon, *Pharm. Res.,* 5:539-549, 1988). To this end, the oligonucleotide may be conjugated to another molecule, e.g., a peptide, hybridization triggered cross-linking agent, transport agent, hybridization-triggered cleavage agent, etc.

Another means by which expression of a target integrin (e.g., any of the exemplary target integrins described herein) mRNA or an integrin ligand (e.g., any of the exemplary integrin ligands described herein) mRNA can be decreased in a mammalian cell is by RNA interference (RNAi). RNAi is a process in which mRNA is degraded in host cells. To inhibit an mRNA, double-stranded RNA (dsRNA) corresponding to a portion of the gene to be silenced (e.g., a gene encoding a target integrin (e.g., any of the exemplary target integrins described herein) or an integrin ligand (e.g., any of the exemplary integrin ligands described herein)) is introduced into a mammalian cell. The dsRNA is digested into 21-23 nucleotide-long duplexes called short interfering RNAs (or siRNAs), which bind to a nuclease complex to form what is known as the RNA-induced silencing complex (or RISC). The RISC targets the homologous transcript by base pairing interactions between one of the siRNA strands and the endogenous mRNA. It then cleaves the mRNA about 12 nucleotides from the 3' terminus of the siRNA (see Sharp et al., *Genes Dev.* 15:485-490, 2001, and Hammond et al., *Nature Rev. Gen.* 2:110-119, 2001).

RNA-mediated gene silencing can be induced in a mammalian cell in many ways, e.g., by enforcing endogenous expression of RNA hairpins (see, Paddison et al., *Proc. Natl. Acad. Sci. U.S.A.* 99:1443-1448, 2002) or, as noted above, by transfection of small (21-23 nt) dsRNA (reviewed in Caplen, *Trends Biotech.* 20:49-51, 2002). Methods for modulating gene expression with RNAi are described, e.g., in U.S. Pat. No. 6,506,559 and US 2003/0056235, which are hereby incorporated by reference.

Standard molecular biology techniques can be used to generate siRNAs. Short interfering RNAs can be chemically synthesized, recombinantly produced, e.g., by expressing RNA from a template DNA, such as a plasmid, or obtained from commercial vendors, such as Dharmacon. The RNA used to mediate RNAi can include synthetic or modified nucleotides, such as phosphorothioate nucleotides. Methods of transfecting cells with siRNA or with plasmids engineered to make siRNA are routine in the art.

The siRNA molecules used to decrease expression of a target integrin (e.g., any of the exemplary target integrins described herein) mRNA or an integrin ligand (e.g., any of the exemplary integrin ligands described herein) can vary in a number of ways. For example, they can include a 3' hydroxyl group and strands of 21, 22, or 23 consecutive nucleotides. They can be blunt ended or include an overhanging end at either the 3' end, the 5' end, or both ends. For example, at least one strand of the RNA molecule can have a 3' overhang from about 1 to about 6 nucleotides (e.g., 1-5, 1-3, 2-4, or 3-5 nucleotides (whether pyrimidine or purine nucleotides) in length. Where both strands include an overhang, the length of the overhangs may be the same or different for each strand.

To further enhance the stability of the RNA duplexes, the 3' overhangs can be stabilized against degradation (by, e.g., including purine nucleotides, such as adenosine or guanosine nucleotides or replacing pyrimidine nucleotides by modified analogues (e.g., substitution of uridine 2-nucleotide 3' overhangs by 2'-deoxythymidine is tolerated and does not affect the efficiency of RNAi). Any siRNA can be used in the methods of decreasing a target integrin (e.g., any of the exemplary target integrins described herein) mRNA or an integrin ligand (e.g., any of the exemplary integrin ligands described herein) mRNA, provided it has sufficient homology to the target of interest (e.g., a sequence present in any one of SEQ ID NOs: 132-158, e.g., a target sequence encompassing the translation start site or the first exon of the mRNA). There is no upper limit on the length of the siRNA that can be used (e.g., the siRNA can range from about 21 base pairs of the gene to the full length of the gene or more (e.g., about 20 to about 30 base pairs, about 50 to about 60 base pairs, about 60 to about 70 base pairs, about 70 to about 80 base pairs, about 80 to about 90 base pairs, or about 90 to about 100 base pairs).

As described herein, inhibitory nucleic acids preferentially bind (e.g., hybridize) to a nucleic acid encoding a target integrin (e.g., any of the exemplary target integrins described herein) or an integrin ligand (e.g., any of the exemplary integrin ligands described herein).

Non-limiting examples of integrin inhibitors that are short interfering RNAs (siRNAs) are described in Wang et al., *Cancer Cell Int.* 16:90, 2016). In some embodiments, the integrin inhibitor is a short hairpin RNA (shRNA).

Non-limiting examples of integrin inhibitors that are microRNA include miR-124 (Cai et al., *Sci. Rep.* 7:40733, 2017), miR-134 (Qin et al., *Oncol. Rep.* 37 (2): 823-830, 2017), miR-92b (Ma et al., *Oncotarget* 8 (4): 6681-6690, 2007), miR-17 (Gong et al., *Oncol. Rep.* 36 (4), 2016), miR-338 (Chen et al., *Oncol. Rep.* 36 (3): 1467-74, 2016), and miR-30a-5p (Li et al., *Int. J. Oncol.* 48 (3): 1155-1164, 2016).

In some embodiments, the integrin inhibitor can include modified bases/locked nucleic acids (LNAs). In some embodiments, the integrin inhibitor is an aptamer (e.g., Berg et al., *Mol. Ther. Nucl. Acids* 5: e294, 2016; and Hussain et al., *Nucleic Acid Ther.* 23 (3): 203-212, 2013). Additional examples of integrin inhibitors that are inhibitory nucleic acids are described in Juliano et al., *Theranostics* 1:211-219, 2011; Millard et al., *Theranostics* 1:154-188, 2011; and Teoh et al., *Curr. Mol. Med.* 15:714-734, 2015. In some embodiments, the integrin inhibitor is an antisense nucleic acid, e.g., alicaforsen (Yacyshyn et al., *Clin. Gastroenterol. Hepatol.* 5(2): 215-220, 2007).

In certain embodiments, a therapeutically effective amount of an inhibitory nucleic acid targeting a nucleic acid encoding a target integrin (e.g., any of the exemplary target integrins described herein) or an integrin ligand (e.g., any of the exemplary integrin ligands described herein) can be administered to a subject (e.g., a human subject) in need thereof.

In some embodiments, the inhibitory nucleic acid can be about 10 nucleotides to about 40 nucleotides (e.g., about 10 to about 30 nucleotides, about 10 to about 25 nucleotides, about 10 to about 20 nucleotides, about 10 to about 15 nucleotides, 10 nucleotides, 11 nucleotides, 12 nucleotides, 13 nucleotides, 14 nucleotides, 15 nucleotides, 16 nucleotides, 17 nucleotides, 18 nucleotides, 19 nucleotides, 20 nucleotides, 21 nucleotides, 22 nucleotides, 23 nucleotides, 24 nucleotides, 25 nucleotides, 26 nucleotides, 27 nucleotides, 28 nucleotides, 29 nucleotides, 30 nucleotides, 31 nucleotides, 32 nucleotides, 33 nucleotides, 34 nucleotides, 35 nucleotides, 36 nucleotides, 37 nucleotides, 38 nucleotides, 39 nucleotides, or 40 nucleotides) in length. One skilled in the art will appreciate that inhibitory nucleic acids may comprise at least one modified nucleic acid at either the 5' or 3'end of DNA or RNA.

As is known in the art, the term "thermal melting point (Tm)" refers to the temperature, under defined ionic strength, pH, and inhibitory nucleic acid concentration, at which 50% of the inhibitory nucleic acids complementary to the target sequence hybridize to the target sequence at equilibrium. In some embodiments, an inhibitory nucleic acid can bind specifically to a target nucleic acid under stingent conditions, e.g., those in which the salt concentration is at least about 0.01 to 1.0 M Na ion concentration (or other salts) at pH 7.0 to 8.3 and the temperature is at least about 30° C. for short oligonucleotides (e.g., 10 to 50 nucleotide). Stringent conditions can also be achieved with the addition of destabilizing agents such as formamide.

In some embodiments of any of the inhibitory nucleic acids described herein, the inhibitory nucleic acid binds to a target nucleic acid (e.g., a nucleic acid encoding a target integrin, e.g., any of the exemplary target integrins described herein, or a nucleic acid encoding an integrin ligand, e.g., any of the exemplary integrin ligands described herein) with a Tm of greater than 20° C., greater than 22° C., greater than 24° C., greater than 26° C., greater than 28° C., greater than 30° C., greater than 32° C., greater than 34° C., greater than 36° C., greater than 38° C., greater than 40° C., greater than 42° C., greater than 44° C., greater than 46° C., greater than 48° C., greater than 50° C., greater than 52° C., greater than 54° C., greater than 56° C., greater than 58° C., greater than 60° C., greater than 62° C., greater than 64° C., greater than 66° C., greater than 68° C., greater than 70° C., greater than 72° C., greater than 74° C., greater than 76° C., greater than 78° C., or greater than 80° C., e.g., as measured in phosphate buffered saline using a UV spectrophotometer.

In some embodiments of any of the inhibitor nucleic acids described herein, the inhibitory nucleic acid binds to a target nucleic acid (e.g., a nucleic acid encoding a target integrin, e.g., any of the exemplary target integrins described herein, or a nucleic acid encoding an integrin ligand, e.g., any of the exemplary integrin ligands described herein) with a Tm of about 20° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., about 30° C., about 28° C., about 26° C., about 24° C., or about 22° C. (inclusive); about 22° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., about 30° C., about 28° C., about 26° C., or about 24° C. (inclusive); about 24° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., about 30° C., about 28° C., or about 26° C. (inclusive); about 26° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., about 30° C., or about 28° C. (inclusive); about 28° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., about 32° C., or about 30° C. (inclusive); about 30° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., about 34° C., or about 32° C. (inclusive); about 32° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., about 36° C., or about 34° C. (inclusive); about 34° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., about 38° C., or about 36° C. (inclusive); about 36° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., about 40° C., or about 38° C. (inclusive); about 38° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., about 42° C., or about 40° C. (inclusive); about 40° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., about 44° C., or about 42° C. (inclusive); about 42° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., about 46° C., or about 44° C. (inclusive); about 44° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., about 48° C., or about 46° C. (inclusive); about 46° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., about 50° C., or about 48° C. (inclusive); about 48° C. to about 80° C., about 78° C., about 76° C., about 74° C., about 72° C., about 70° C., about 68° C., about 66° C., about 64° C., about 62° C., about 60° C., about 58° C., about 56° C., about 54° C., about 52° C., or about 50° C. (inclusive); about 50° C. to about 80° C., about 78° C., about 76° C., about 74° C., about 72° C., about 70° C., about 68° C., about 66° C., about 64° C., about 62° C., about 60° C., about 58° C., about 56° C., about 54° C., or about 52° C. (inclusive); about 52° C. to about 80° C., about 78° C., about 76° C., about 74° C., about 72° C., about 70° C., about 68° C., about 66° C., about 64° C., about 62° C., about 60° C., about 58° C., about 56° C., or about 54° C. (inclusive); about 54° C. to about 80° C., about 78° C., about 76° C., about 74° C., about 72° C., about 70° C., about 68° C., about 66° C., about 64° C., about 62° C., about 60° C., about 58° C., or about 56° C. (inclusive); about 56° C. to about 80° C., about 78° C., about 76° C., about 74° C., about 72° C., about 70° C., about 68° C., about 66° C., about 64° C., about 62° C., about 60° C., or about 58° C. (inclusive); about 58° C. to about 80° C., about 78° C., about 76° C., about 74° C., about 72° C., about 70° C., about 68° C., about 66° C., about 64° C., about 62° C., or about 60° C. (inclusive); about 60° C. to about 80° C., about 78° C., about 76° C., about 74° C., about 72° C., about 70° C., about 68° C., about 66° C., about 64° C., or about 62° C. (inclusive); about 62° C. to about 80° C., about 78° C., about 76° C., about 74° C., about 72° C., about 70° C., about 68° C., about 66° C., or about 64° C. (inclusive); about 64° C. to about 80° C., about 78° C., about 76° C., about 74° C., about 72° C., about 70° C., or about 68° C. (inclusive); about 66° C. to about 80° C., about 78° C., about 76° C., about 74° C., about 72° C., about 70° C., or about 68° C. (inclusive); about 68° C. to about 80° C., about 78° C., about 76° C., about 74° C., about 72° C., or about 70° C. (inclusive); about 70° C. to about 80° C., about 78° C., about 76° C., about 74° C., or about 72° C. (inclusive); about 72° C. to about 80° C., about 78° C., about 76° C., or about 74° C. (inclusive); about 74° C. to about 80° C., about 78° C., or about 76° C. (inclusive); about 76° C. to about 80° C. or about 78° C. (inclusive); or about 78° C. to about 80° C. (inclusive), In some embodiments, the inhibitory nucleic acid can be formulated in a nanoparticle (e.g., a nanoparticle including one or more synthetic polymers, e.g., Patil et al., *Pharmaceutical Nanotechnol.* 367:195-203, 2009; Yang et al., *ACS Appl. Mater. Interfaces*, doi: 10.1021/acsami.6b16556, 2017; Perepelyuk et al., *Mol. Ther. Nucleic Acids* 6:259-268, 2017). In some embodiments, the nanoparticle can be a mucoadhesive particle (e.g., nanoparticles having a positively-charged exterior surface) (Andersen et al., *Methods Mol. Biol.* 555:77-86, 2009). In some embodiments, the nanoparticle can have a neutrally-charged exterior surface.

In some embodiments, the inhibitory nucleic acid can be formulated, e.g., as a liposome (Buyens et al., *J. Control Release* 158 (3): 362-370, 2012; Scarabel et al., *Expert Opin. Drug Deliv.* 17:1-14, 2017), a micelle (e.g., a mixed micelle) (Tangsangasaksri et al., *BioMacromolecules* 17:246-255, 2016; Wu et al., *Nanotechnology*, doi: 10.1088/1361-6528/aa6519, 2017), a microemulsion (WO 11/004395), a nanoemulsion, or a solid lipid nanoparticle (Sahay et al., *Nature Biotechnol.* 31:653-658, 2013; and Lin et al., *Nanomedicine* 9 (1): 105-120, 2014). Additional exemplary structural features of inhibitory nucleic acids and formulations of inhibitory nucleic acids are described in US 2016/0090598.

In some embodiments, a pharmaceutical composition can include a sterile saline solution and one or more inhibitory nucleic acid (e.g., any of the inhibitory nucleic acids described herein). In some examples, a pharmaceutical composition consists of a sterile saline solution and one or more inhibitory nucleic acid (e.g., any of the inhibitory nucleic acids described herein). In certain embodiments, the sterile saline is a pharmaceutical grade saline. In certain embodiments, a pharmaceutical composition can include one or more inhibitory nucleic acid (e.g., any of the inhibitory nucleic acids described herein) and sterile water. In certain embodiments, a pharmaceutical composition consists of one or more inhibitory nucleic acid (e.g., any of the inhibitory nucleic acids described herein) and sterile water. In certain embodiments, a pharmaceutical composition includes one or more inhibitory nucleic acid (e.g., any of the inhibitory nucleic acids described herein) and phosphate-buffered saline (PBS). In certain embodiments, a pharmaceutical composition consists of one or more inhibitory nucleic acids (e.g., any of the inhibitory nucleic acids described herein) and sterile phosphate-buffered saline (PBS). In some examples, the sterile saline is a pharmaceutical grade PBS.

In certain embodiments, one or more inhibitory nucleic acids (e.g., any of the inhibitory nucleic acids described herein) may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

Pharmaceutical compositions including one or more inhibitory nucleic acids encompass any pharmaceutically acceptable salts, esters, or salts of such esters. Non-limiting examples of pharmaceutical compositions include pharmaceutically acceptable salts of inhibitory nucleic acids. Suitable pharmaceutically acceptable salts include, but are not limited to, sodium and potassium salts.

Also provided herein are prodrugs that can include additional nucleosides at one or both ends of an inhibitory nucleic acid which are cleaved by endogenous nucleases within the body, to form the active inhibitory nucleic acid.

Lipid moieties can be used to formulate an inhibitory nucleic acid. In certain such methods, the inhibitory nucleic acid is introduced into preformed liposomes or lipoplexes made of mixtures of cationic lipids and neutral lipids. In certain methods, inhibitory nucleic acid complexes with mono- or poly-cationic lipids are formed without the presence of a neutral lipid. In certain embodiments, a lipid moiety is selected to increase distribution of an inhibitory nucleic acid to a particular cell or tissue in a mammal. In some examples, a lipid moiety is selected to increase distribution of an inhibitory nucleic acid to fat tissue in a mammal. In certain embodiments, a lipid moiety is selected to increase distribution of an inhibitory nucleic acid to muscle tissue.

In certain embodiments, pharmaceutical compositions provided herein comprise one or more inhibitory nucleic acid and one or more excipients. In certain such embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In some examples, a pharmaceutical composition provided herein includes liposomes and emulsions. Liposomes and emulsions can be used to formulate hydrophobic compounds. In some examples, certain organic solvents such as dimethylsulfoxide are used.

In some examples, a pharmaceutical composition provided herein includes one or more tissue-specific delivery molecules designed to deliver one or more inhibitory nucleic acids to specific tissues or cell types in a mammal. For example, a pharmaceutical composition can include liposomes coated with a tissue-specific antibody.

In some embodiments, a pharmaceutical composition provided herein can include a co-solvent system. Examples of such co-solvent systems include benzyl alcohol, a non-polar surfactant, a water-miscible organic polymer, and an aqueous phase. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. As can be appreciated, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In some examples, a pharmaceutical composition can be formulated for oral administration. In some examples, pharmaceutical compositions are formulated for buccal administration.

In some examples, a pharmaceutical composition is formulated for administration by injection (e.g., intravenous, subcutaneous, intramuscular, etc.). In some of these embodiments, a pharmaceutical composition includes a carrier and is formulated in aqueous solution, such as water or physiologically compatible buffers such as Hanks's solution, Ringer's solution, or physiological saline buffer. In some examples, other ingredients are included (e.g., ingredients that aid in solubility or serve as preservatives). In some examples, injectable suspensions are prepared using appropriate liquid carriers, suspending agents, and the like. Some pharmaceutical compositions for injection are formulated in unit dosage form, e.g., in ampoules or in multi-dose containers. Some pharmaceutical compositions for injection are suspensions, solutions, or emulsions in oily or aqueous vehicles, and may contain formulatory agents such as suspending, stabilizing, and/or dispersing agents. Solvents suitable for use in pharmaceutical compositions for injection include, but are not limited to, lipophilic solvents and fatty oils, such as sesame oil, synthetic fatty acid esters, such as ethyl oleate or triglycerides, and liposomes.

In certain embodiments, a therapeutically effective amount of an inhibitory nucleic acid targeting an integrin can be administered to a subject (e.g., a human subject) in need of thereof.

In certain embodiments, the inhibitory nucleic acids are 10 to 40 (e.g., 10 to 30, 10 to 25, 10 to 20, 10 to 15, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40) nucleotides in length. One skilled in the art will appreciate that inhibitory nucleic acids may comprise at least one modified nucleic acid at either the 5' or 3'end of the DNA or RNA.

Antibodies

In some embodiments, the integrin inhibitor is an antibody or an antigen-binding fragment thereof (e.g., a Fab or a scFv). In some embodiments, the antibody can be a humanized antibody, a chimeric antibody, a multivalent antibody, or a fragment thereof. In some embodiments, an antibody can be a scFv-Fc, a $V_HH$ domain, a VNAR domain, a (scFv) 2, a minibody, or a BiTE. In some embodiments, an antibody can be a DVD-Ig, and a dual-affinity re-targeting antibody (DART), a triomab, kih IgG with a common LC, a crossmab, an ortho-Fab IgG, a 2-in-1-IgG, IgG-ScFv, scFv2-Fc, a bi-nanobody, tanden antibody, a DART-Fc, a scFv-HAS-scFv, DNL-Fab3, DAF (two-in-one or four-in-one), DutaMab, DT-IgG, knobs-in-holes common LC, knobs-in-holes assembly, charge pair antibody, Fab-arm exchange antibody, SEEDbody, Triomab, LUZ-Y, Fcab, kλ-body, orthogonal Fab, DVD-IgG, IgG (H)-scFv, scFv-(H) IgG, IgG (L)-scFv, scFv-(L)-IgG, IgG (L,H)-Fc, IgG (H)-V, V (H)-IgG, IgG (L)-V, V (L)-IgG, KIH IgG-scFab, 2scFv-IgG, IgG-2scFv, scFv4-Ig, Zybody, DVI-IgG, nanobody, nanobody-HSA, a diabody, a TandAb, scDiabody, scDiabody-CH3, Diabody-CH3, Triple Body, miniantibody, minibody, TriBi minibody, scFv-CH3 KIH, Fab-scFv, scFv-CH-CL-scFv, F(ab')2-scFV2, scFv-KIH, Fab-scFv-Fc, tetravalent HCAb, scDiabody-Fc, diabody-Fc, tandem scFv-Fc, intrabody, dock and lock bispecific antibody, ImmTAC, HSAbody, scDiabody-HAS, tandem scFv, IgG-IgG, Cov-X-Body, and scFv1-PEG-scFv2.

Non-limiting examples of an antigen-binding fragment of an antibody include an Fv fragment, a Fab fragment, a F(ab')2 fragment, and a Fab' fragment. Additional examples of an antigen-binding fragment of an antibody is an antigen-binding fragment of an IgG (e.g., an antigen-binding fragment of IgG1, IgG2, IgG3, or IgG4) (e.g., an antigen-binding fragment of a human or humanized IgG, e.g., human or humanized IgG1, IgG2, IgG3, or IgG4); an antigen-binding fragment of an IgA (e.g., an antigen-binding fragment of IgA1 or IgA2) (e.g., an antigen-binding fragment of a human or humanized IgA, e.g., a human or humanized IgA1 or IgA2); an antigen-binding fragment of an IgD (e.g., an antigen-binding fragment of a human or humanized IgD); an antigen-binding fragment of an IgE (e.g., an antigen-binding fragment of a human or humanized IgE); or an antigen-binding fragment of an IgM (e.g., an antigen-binding fragment of a human or humanized IgM).

Any of the antibodies or antigen-binding fragments thereof described herein can bind to any of the integrins described herein or any of the integrin ligands described herein.

In some embodiments, the antibody is a pan-31 antibody (e.g., OS2966 (Carbonell et al., Cancer Res. 73 (10): 3145-3154, 2013). In some embodiments, the integrin antibody is a monoclonal antibody (e.g., 17E6 (Castel et al., Eur. J. Cell. Biol. 79 (7): 502-512, 2000); Mitjans et al., Int. J. Cancer 87 (5): 716-723, 2000)). In some embodiments, the monoclonal antibody is vedolizumab (e.g., Entyvio®) or a variant thereof (Feagan et al., N. Engl. J. Med 369:699-710, 2013; Sandborn et al., N. Engl. J. Med. 369:711-721, 2013; Sands et al., Gastroenterology 147:618-627, 2014; and Milch et al., Neuroimmunol. 264:123-126, 2013; Wyant et al., J. Crohns Colitis 10 (12): 1437-1444, 2016; and Feagan et al., Gastroenterology 142 (5): S160-S161, 2012).

In some embodiments, the antibody can be a Fab fragment of a monoclonal chimeric mouse-human antibody (e.g., abciximab (ReoPro, c7E3), Kononczuk et al., Curr. Drug Targets 16 (13): 1429-1437, 2015; Jiang et al., Appl. Microbiol. Biotechnol. 98 (1): 105-114, 2014), or a variant thereof. In some embodiments, the integrin antibody is a humanized monoclonal antibody. In some embodiments, the humanized monoclonal antibody is natalizumab (Tysabri®) (Targan et al., Gastroenterology 132 (5): 1672-1683, 2007; Sandborn et al., N. Engl. J. Med. 353 (18): 1912-1925, 2005; Nakamura et al., Intern Med. 56 (2): 211-214, 2017; Singh et al., J. Pediatr. Gastroenterol. Nutr. 62 (6): 863-866, 2016). In some embodiments, the humanized monoclonal antibody is vitaxin (MEDI-523) or a variant thereof (Huveneers et al., Int, J. Radiat. Biol. 81 (11-12): 743-751, 2007; Coleman et al., Circ. Res. 84 (11): 1268-1276, 1999). In some embodiments, the humanized monoclonal antibody is etaracizumab (Abegrin®, MEDI-522, LM609) or a variant thereof (Hersey et al., Cancer 116 (6): 1526-1534, 2010; Delbaldo et al., Invest New Drugs 26 (1): 35-43, 2008). In some embodiments, the humanized monoclonal antibody is CNTO95 (Intetumumab®) or a variant thereof (Jia et al., Anticancer Drugs 24 (3): 237-250, 2013; Heidenreich et al., Ann. Oncol. 24 (2): 329-336, 2013; Wu et al., J. Neurooncol. 110 (1): 27-36, 2012). In some embodiments, the humanized monoclonal antibody is efalizumab (Raptiva®) or a variant thereof (Krueger et al., J. Invest. Dermatol. 128 (11): 2615-2624, 2008; Li et al., PNAS 106 (11): 4349-4354, 2009; Woolacott et al., Health Technol. Assess 10:1-233, 2006). In some embodiments, the humanized monoclonal antibody is STX-100 (Stromedix®) or a variant thereof (van Aarsen et al., Cancer Res. 68:561-570, 2008; Lo et al., Am. J. Transplant. 13 (12): 3085-3093, 2013). In some embodiments, the humanized monoclonal antibody is 264RAD or a variant thereof (Eberlein et al., Oncogene 32 (37): 4406-4417, 2013).

In some embodiments, the humanized monoclonal antibody is rovelizumab or a variant thereof (Goodman et al., Trends Pharmacol. Sci 33:405-412, 2012). In some embodiments, the humanized monoclonal antibody is Cytolin® or a variant thereof (Rychert et al., Virology J. 10:120, 2013). In some embodiments, the humanized monoclonal antibody is etrolizumab or a variant thereof (Vermeire et al., Lancet 384:309-318, 2014; Rutgeerts et al., Gut 62:1122-1130, 2013; Lin et al., Gastroenterology 146:307-309, 2014; Ludviksson et al., J. Immunol. 162 (8): 4975-4982, 1999; Stefanich et al., Br. J. Pharmacol. 162 (8): 1855-1870, 2011). In some embodiments, the humanized monoclonal antibody is abrilumab (AMG 181; MEDI-7183) or a variant thereof (Pan et al., Br. J. Pharmacol. 169 (1): 51-68, 2013; Pan et al., Br. J. Clin. Pharmacol. 78 (6): 1315-1333, 2014). In some embodiments, the humanized monoclonal antibody is PF-00547659 (SHP647) or a variant thereof (Vermeire et al., Gut 60 (8): 1068-1075, 2011; Sandborn et al., Gastroenterology 1448 (4): S-162, 2015). In some embodiments, the humanized monoclonal antibody is SAN-300 (hAQC2) or a variant thereof (Karpusas et al., J. Mol. Biol. 327:1031-1041, 2003). In some embodiments, the humanized monoclonal antibody is DI176E6 (EMD 5257) or a variant thereof (Goodman et al., Trends Pharmacol. Sci 33:405-412, 2012; and Sheridan et al., Nat. Biotech. 32:205-207, 2014).

In some embodiments, the integrin antibody is a chimeric monoclonal antibody. In some embodiments, the chimeric monoclonal antibody is volociximab or a variant thereof (Kuwada et al., Curr. Opin. Mol. Ther. 9 (1): 92-98, 2007; Ricart et al., Clin. Cancer Res. 14 (23): 7924-7929, 2008; Ramakrishnan et al., J. Exp. Ther. Oncol. 5 (4): 273-86, 2006; Bell-McGuinn et al., Gynecol. Oncol. 121:273-279, 2011; Almokadem et al., Exp. Opin. Biol. Ther. 12:251-7, 2012).

In some embodiments, the antibody specifically binds one or more (e.g., 1, 2, 3, 4, or 5) integrin. In some embodiments, the antibody specifically binds an integrin dimer (e.g., MLN-00002, MLN02 (Feagan et al., Clin. Gastroenterol. Hepatol. 6 (12): 1370-1377, 2008; Feagan et al., N. Engl. J. Med. 352 (24): 2499-2507, 2005). In certain embodiments, the antibody comprises or consists of an antigen-binding fragment of abciximab (Reopro™) (Straub et al., Eur. J. Cardiothorac Surg. 27 (4): 617-621, 2005; Kim et al., Korean J. Intern. Med. 19 (4): 220-229, 2004). In some embodiments, the integrin inhibitor is an antibody-drug conjugate (e.g., IMGN388 (Bendell et al., EJC Suppl 8 (7): 152, 2010).

Further examples of antibodies and antigen-binding fragments thereof are described in U.S. Pat. Nos. 5,919,792; 6,214,834; 7,074,408; 6,833,373; 7,655,624; 7,465,449; 9,558,899; 7,659,374; 8,562,986; 8,398,975; and 8,853,149; US 2007/0117849; US 2009/0180951; US 2014/0349944; US 2004/0018192; WO 11/137418; and WO 01/068586; each of which is incorporated by reference in its entirety.

In some embodiments, any of the antibodies or antigen-binding fragments described herein has a dissociation constant ($K_D$) of less than $1\times10^{-5}$ M (e.g., less than $0.5\times10^{-5}$ M, less than $1\times10^{-6}$ M, less than $0.5\times10^{-6}$ M, less than $1\times10^{-7}$ M, less than $0.5\times10^{-7}$ M, less than $1\times10^{-8}$ M, less than $0.5\times10^{-8}$ M, less than $1\times10^{-9}$ M, less than $0.5\times10^{-9}$ M, less than $1\times10^{-10}$ M, less than $0.5\times10^{-10}$ M, less than $1\times10^{-11}$ M, less than $0.5\times10^{-11}$ M, or less than $1\times10^{-12}$ M), e.g., as measured in phosphate buffered saline using surface plasmon resonance (SPR).

In some embodiments, any of the antibodies or antigen-binding fragments described herein has a $K_D$ of about $1\times10^{-12}$ M to about $1\times10^{-5}$ M, about $0.5\times10^{-5}$ M, about $1\times10^{-6}$ M, about $0.5\times10^{-6}$ M, about $1\times10^{-7}$M, about $0.5\times10^{-7}$ M, about $1\times10^{-8}$ M, about $0.5\times10^{-8}$ M, about $1\times10^{-9}$ M, about $0.5\times10^{-9}$ M, about $1\times10^{-10}$M, about $0.5\times10^{-10}$ M, about $1\times10^{-11}$ M, or about $0.5\times10^{-11}$ M (inclusive); about $0.5\times10^{-11}$ M to about $1\times10^{-5}$ M, about $0.5\times10^{-5}$ M, about $1\times10^{-6}$ M, about $0.5\times10^{-6}$ M, about $1\times10^{-7}$M, about $0.5\times10^{-7}$ M, about $1\times10^{-8}$ M, about $0.5\times10^{-8}$ M, about $1\times10^{-9}$ M, about $0.5\times10^{-9}$ M, about $1\times10^{-10}$M, about $0.5\times10^{-10}$ M, or about $1\times10^{-11}$ M (inclusive); about $1\times10^{-11}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$ M, about $1 \times 10^{-10}$ M, or about $0.5 \times 10^{-10}$ M (inclusive); $0.5 \times 10^{-10}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$ M, about $0.5 \times 10^{-9}$ M, or about $1 \times 10^{-10}$ M (inclusive); about $1 \times 10^{-10}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$ M, or about $0.5 \times 10^{-9}$ M (inclusive); about $0.5 \times 10^{-9}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, or about $1 \times 10^{-9}$ M (inclusive); about $1 \times 10^{-9}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, or about $0.5 \times 10^{-8}$ M (inclusive); about $0.5 \times 10^{-8}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, or about $1 \times 10^{-8}$ M (inclusive); about $1 \times 10^{-8}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, or about $0.5 \times 10^{-7}$ M (inclusive); about $0.5 \times 10^{-7}$ M to about $1 \times 10^{-5}$ M, about $0.5 \times 10^{-5}$ M, about $1 \times 10^{-6}$ M, about $0.5 \times 10^{-6}$ M, or about $1 \times 10^{-7}$ M (inclusive); about $1 \times 10^{-7}$ M to about $1 \times 10^{-5}$ M, about $0.5 \times 10^{-5}$ M, about $1 \times 10^{-6}$ M, or about $0.5 \times 10^{-6}$ M (inclusive); about $0.5 \times 10^{-6}$ M to about $1 \times 10^{-5}$ M, about $0.5 \times 10^{-5}$ M, or about $1 \times 10^{-6}$ M (inclusive); about $1 \times 10^{-6}$ M to about $1 \times 10^{-5}$ M or about $0.5 \times 10^{-5}$ M (inclusive); or about $0.5 \times 10^{-5}$ M to about $1 \times 10^{-5}$ M (inclusive), e.g., as measured in phosphate buffered saline using surface plasmon resonance (SPR).

In some embodiments, any of the antibodies or antigen-binding fragments described herein has a $K_{off}$ of about $1 \times 10^{-6}$ s$^{-1}$ to about $1 \times 10^{-3}$ s$^{-1}$, about $0.5 \times 10^{-3}$ s$^{-1}$, about $1 \times 10^{-4}$ s$^{-1}$, about $0.5 \times 10^{-4}$ s$^{-1}$, about $1 \times 10^{-5}$ s$^{-1}$, or about $0.5 \times 10^{-5}$ s$^{-1}$ (inclusive); about $0.5 \times 10^{-5}$ s$^{-1}$ to about $1 \times 10^{-3}$ s$^{-1}$, about $0.5 \times 10^{-3}$ s$^{-1}$, about $1 \times 10^{-4}$ s$^{-1}$, about $0.5 \times 10^{-4}$ s$^{-1}$, or about $1 \times 10^{-5}$ s$^{-1}$ (inclusive); about $1 \times 10^{-5}$ s$^{-1}$ to about $1 \times 10^{-3}$ s$^{-1}$, about $0.5 \times 10^{-3}$ s$^{-1}$, about $1 \times 10^{-4}$ s$^{-1}$, or about $0.5 \times 10^{-4}$ s$^{-1}$ (inclusive); about $0.5 \times 10^{-4}$ s$^{-1}$ to about $1 \times 10^{-3}$ s$^{-1}$, about $0.5 \times 10^{-3}$ s$^{-1}$, or about $1 \times 10^{-4}$ s$^{-1}$ (inclusive); about $1 \times 10^{-4}$ s$^{-1}$ to about $1 \times 10^{-3}$ s$^{-1}$, or about $0.5 \times 10^{-3}$ s$^{-1}$ (inclusive); or about $0.5 \times 10^{-5}$ s$^{-1}$ to about $1 \times 10^{-3}$ s$^{-1}$ (inclusive), e.g., as measured in phosphate buffered saline using surface plasmon resonance (SPR).

In some embodiments, any of the antibodies or antigen-binding fragments described herein has a $K_{on}$ of about $1 \times 10^{2}$ M$^{-1}$s$^{-1}$ to about $1 \times 10^{6}$ M$^{-1}$s$^{-1}$, about $0.5 \times 10^{6}$ M$^{-1}$s$^{-1}$, about $1 \times 10^{5}$ M$^{-1}$s$^{-1}$, about $0.5 \times 10^{5}$ M$^{1}$s$^{-1}$, about $1 \times 10^{4}$ M$^{-1}$s$^{-1}$, about $0.5 \times 10^{4}$ M$^{-1}$s$^{-1}$, about $1 \times 10^{3}$ M$^{-1}$s$^{-1}$, or about $0.5 \times 10^{3}$ M$^{-1}$s$^{-1}$ (inclusive); about $0.5 \times 10^{3}$ M$^{-1}$s$^{-1}$ to about $1 \times 10^{6}$ M$^{-1}$s$^{-1}$, about $0.5 \times 10^{6}$ M$^{-1}$s$^{-1}$, about $1 \times 10^{5}$ M$^{-1}$s$^{-1}$, about $0.5 \times 10^{5}$ M$^{-1}$s$^{-1}$, about $1 \times 10^{4}$ M$^{-1}$s$^{-1}$, about $0.5 \times 10^{4}$ M$^{-1}$s$^{-1}$, or about $1 \times 10^{3}$ M$^{-1}$s$^{-1}$ (inclusive); about $1 \times 10^{3}$ M$^{-1}$s$^{-1}$ to about $1 \times 10^{6}$ M$^{-1}$s$^{-1}$, about $0.5 \times 10^{6}$ M$^{-1}$s$^{-1}$, about $1 \times 10^{5}$ M$^{-1}$s$^{-1}$, about $0.5 \times 10^{5}$ M$^{-1}$s$^{-1}$, about $1 \times 10^{4}$ M$^{-1}$s$^{-1}$, or about $0.5 \times 10^{4}$ M$^{-1}$s$^{-1}$ (inclusive); about $0.5 \times 10^{4}$ M$^{-1}$s$^{-1}$ to about $1 \times 10^{6}$ M$^{-1}$s$^{-1}$, about $0.5 \times 10^{6}$ M$^{-1}$s$^{-1}$, about $1 \times 10^{5}$ M$^{-1}$s$^{-1}$, about $0.5 \times 10^{5}$ M$^{-1}$s$^{-1}$, or about $1 \times 10^{4}$ M$^{-1}$s$^{-1}$ (inclusive); about $1 \times 10^{4}$ M$^{-1}$s$^{-1}$ to about $1 \times 10^{6}$ M$^{-1}$s$^{-1}$, about $0.5 \times 10^{6}$ M$^{-1}$s$^{-1}$, about $1 \times 10^{5}$ M$^{-1}$s$^{-1}$, or about $0.5 \times 10^{5}$ M$^{-1}$s$^{-1}$ (inclusive); about $0.5 \times 10^{5}$ M$^{-1}$s$^{-1}$ to about $1 \times 10^{6}$ M$^{-1}$s$^{-1}$, about $0.5 \times 10^{6}$ M$^{-1}$s$^{-1}$, or about $1 \times 10^{5}$ M$^{-1}$s$^{-1}$ (inclusive); about $1 \times 10^{5}$ M$^{-1}$s$^{-1}$ to about $1 \times 10^{6}$ M$^{-1}$s$^{-1}$, or about $0.5 \times 10^{6}$ M$^{-1}$s$^{-1}$ (inclusive); or about $0.5 \times 10^{6}$ M$^{-1}$s$^{-1}$ to about $1 \times 10^{6}$ M$^{-1}$s$^{-1}$ (inclusive), e.g., as measured in phosphate buffered saline using surface plasmon resonance (SPR).

Fusion Protein Inhibitors of Integrins

In some embodiments, the integrin inhibitor is a fusion protein (e.g., an Fc fusion protein of an extracellular domain of an integrin or an integrin receptor), a soluble receptor (e.g., the extracellular domain of an integrin or an integrin receptor), or a recombinant integrin binding protein (e.g., an integrin ligand). See, e.g., Lode et al., *PNAS* 96 (4): 1591-1596, 1999; Stephens et al., *Cell Adhesion Comm.* 7:377-390, 2000; and US 2008/0739003; incorporated by reference herein). Non-limiting examples of fusion proteins that are integrin inhibitors include Ag25426 (Proteintech).

Small Molecule Antagonists

In some embodiments, the integrin inhibitor is a small molecule. In some embodiments, the small molecule is a non-peptide small molecule. In some embodiments, the non-peptide small molecule is a RGD (ArgGlyAsp)-mimetic antagonist (e.g., tirofiban (Aggrastat®); Pierro et al., *Eur. J. Ophthalmol.* 26 (4): c74-76, 2016; Guan et al., *Eur. J. Pharmacol* 761:144-152, 2015. In some embodiments, the small molecule is α4 antagonist (e.g., firategrast (Miller et al., *Lancet Neurol.* 11 (2): 131-139, 2012) AJM300 (Yoshimura et al., *Gastroenterology* 149 (7): 1775-1783, 2015; Takazoe et al., *Gastroenterology* 136 (5): A-181, 2009; Sugiura et al., *J. Crohns Colitis* 7 (11): e533-542, 2013)). In some embodiments, the small molecule is α4β1 antagonist (e.g., IVL745 (Norris et al., *J. Allergy Clin. Immunol.* 116 (4): 761-767, 2005; Cox et al., *Nat. Rev. Drug Discov.* 9 (10): 804-820, 2010)), BIO-1211 (Abraham et al., *Am. J. Respir. Crit. Care Med.* 162:603-611, 2000; Ramroodi et al., *Immunol. Invest.* 44 (7): 694-712, 2015; Lin et al., *J. Med. Chem.* 42 (5): 920-934, 1999), HMR 1031 (Diamant et al., *Clin. Exp. Allergy* 35 (8): 1080-1087, 2005); valategrast (R411) (Cox et al., *Nat. Rev. Drug Discov.* 9 (10): 804-820, 2010), GW559090X (Ravensberg et al., *Allergy* 61 (9): 1097-1103, 2006), TR14035 (Sircar et al., *Bioorg. Med. Chem.* 10 (6): 2051-2066, 2002; Cortijo et al., *Br. J. Pharmacol.* 147 (6): 661-670, 2006)). In some embodiments, the small molecule is αvβ3 antagonist (e.g., L0000845704, SB273005). In some embodiments, the small molecule is α5β1 antagonist (e.g., JSM6427). In some embodiments, the small molecule is GLPG0974 (Vermeire et al., *J. Crohns Colitis* Suppl. 1: S39, 2015). In some embodiments, the small molecule is MK-0429 (Pickarksi et al., *Oncol. Rep.* 33 (6): 2737-45, 2015; Rosenthal et al., *Asia Pac J. Clin. Oncol.* 6:42-8, 2010). In some embodiments, the small molecule is JSM-6427 or a variant thereof (Zahn et al., *Arch. Ophthalmol.* 127 (10): 1329-1335, 2009; Stragies et al., *J. Med. Chem.* 50:3786-94, 2007).

In some embodiments, the small molecule integrin inhibitor can be PTG-100, which is described in, e.g., Shames et al., "Pharmakokinetics and Pharmacodynamics of the Novel Oral Peptide Therapeutic PTG-100 (α4β7 Integrin Antagonist) in Normal Healthy Volunteers," 24th *United European Gastroentrology Week*, October 15-19, Vienna, Austria, 2016.

In some embodiments, the small molecule targets a β2 integrin. In some embodiments, the small molecule is SAR-118 (SAR1118) or a variant thereof (Zhong et al., *ACS Med. Chem. Lett.* 3 (3): 203-206, 2012; Suchard et al., *J. Immunol.* 184:3917-3926, 2010; Yandrapu et al., *J. Ocul. Pharmacol. Ther.* 29 (2): 236-248, 2013; Semba et al., *Am. J. Ophthalmol.* 153:1050-60, 2012). In some embodiments, the small molecule is BMS-587101 or a variant thereof (Suchard et al., *J. Immunol.* 184 (7): 3917-3926, 2010; Potin et al., *J.*

*Med. Chem.* 49:6946-6949, 2006). See e.g., Shimaoka et al., *Immunity* 19 (3): 391-402, 2003; U.S. Pat. Nos. 7,138,417; 7,928,113; 7,943,660; and 9,216,174; US 2008/0242710; and US 2008/0300237.

In some embodiments, the integrin inhibitor is an inhibitor as shown in Table 6.

TABLE 6

Integrin Inhibitors

| Drug Name | Target-based Actions | Structure | Other Drug Names | References |
|---|---|---|---|---|
| ALPHA-4 INHIBITORS | | | | |
| ELND-004<br>Elan Corp plc | CD49d antagonist<br>Alpha 4 inhibitor | 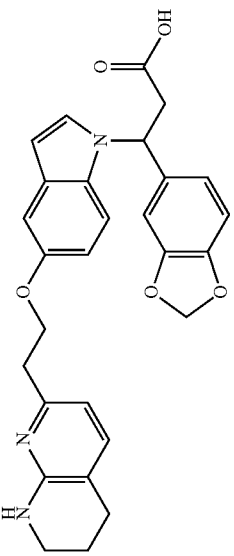 | ELND-004 | Soler-Ferran, Dulce, and Michael J Briskin. "Integrin α4β7 Antagonists: Activities, Mechanisms of Action and Therapeutic Prospects." Current Immunology Reviews 8.2 (2012): 118-134. and<br>U.S. Pat. No. 6,436,904;<br>U.S. Pat. No. 6,492,421;<br>U.S. Pat. No. 6,903,088;<br>U.S. Pat. No. 6,939,855;<br>U.S. Pat. No. 6,949,570;<br>U.S. Pat. No. 7,030,114;<br>U.S. Pat. No. 7,115,768;<br>U.S. Pat. No. 7,166,580;<br>U.S. Pat. No. 7,320,960;<br>U.S. Pat. No. 7,452,912;<br>U.S. Pat. No. 7,335,663 |
| ELND-002 (PEGylated subcutaneous formulation, hematological malignancies/ multiple sclerosis)<br>Elan Corp plc | CD49d antagonist | | ELND-002;<br>ELND-002 (PEGylated subcutaneous formulation, hematological malignancies/ multiple sclerosis),<br>Elan; alpha-4 integrin inhibitor (injectable, hematologic malignancies), Elan | U.S. Pat. No. 6,436,904;<br>U.S. Pat. No. 6,492,421;<br>U.S. Pat. No. 6,903,088;<br>U.S. Pat. No. 6,939,855;<br>U.S. Pat. No. 6,949,570;<br>U.S. Pat. No. 7,030,114;<br>U.S. Pat. No. 7,115,768;<br>U.S. Pat. No. 7,166,580;<br>U.S. Pat. No. 7,320,960;<br>U.S. Pat. No. 7,452,912;<br>U.S. Pat. No. 7,335,663 |

TABLE 6-continued

Integrin Inhibitors

| Drug Name | Target-based Actions | Structure | Other Drug Names | References |
|---|---|---|---|---|
| ELND-002 (oral, multiple sclerosis) Elan Corp plc | CD49d antagonist | 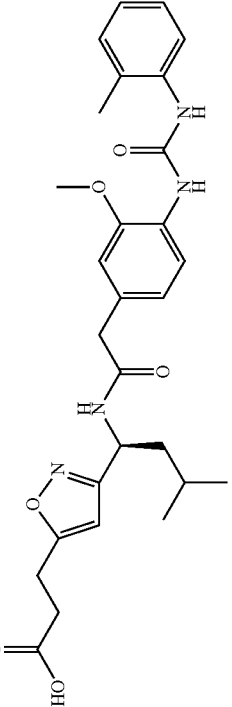 | ELND-002; ELND-002 (oral, multiple sclerosis), Elan; alpha-4 integrin antagonists (oral, autoimmune diseases), Elan; alpha-4 integrin antagonists (oral, multiple sclerosis), Elan | U.S. Pat. No. 6,436,904; U.S. Pat. No. 6,492,421; U.S. Pat. No. 6,903,088; U.S. Pat. No. 6,939,855; U.S. Pat. No. 6,949,570; U.S. Pat. No. 7,030,114; U.S. Pat. No. 7,115,768; U.S. Pat. No. 7,166,580; U.S. Pat. No. 7,320,960; U.S. Pat. No. 7,452,912; U.S. Pat. No. 7,335,663 |
| alpha4-beta1/alpha4-beta7 antagonists (asthma), Roche | Integrin alpha-4/beta-1 antagonist; Integrin alpha-4/beta-7 antagonist | 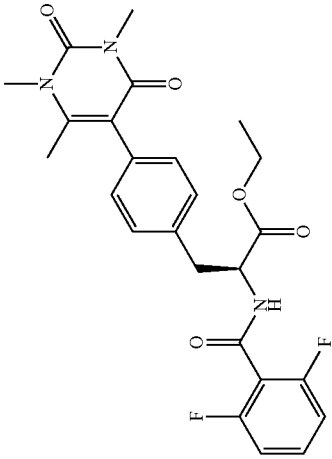 | alpha4-beta1/alpha4-beta7 antagonist prodrugs (asthma), Roche; alpha4-beta1/alpha4-beta7 antagonists (asthma), Roche | See chemical structure; Sidduri A et al. "Identification of N-acyl 4-(5-pyrimidine-2,4-dionyl) phenylalanine derivatives and their orally active prodrug esters as dual-acting alpha4-beta1 and alpha4-beta7 receptor antagonists" Bioorganic and Medicinal Chemistry Letters (2013) 23 (4) 1026-1031 |

TABLE 6-continued

Integrin Inhibitors

| Drug Name | Target-based Actions | Structure | Other Drug Names | References |
|---|---|---|---|---|
| alpha-4/beta-7 integrin modulators (IBD), Morphic Therapeutic | Integrin alpha-4/beta-7 modulator | 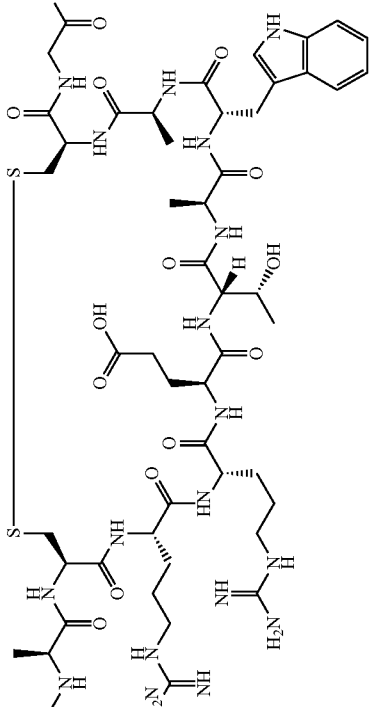 | alpha-4/beta-7 integrin modulators (IBD), Morphic Therapeutic | See chemical structure |
| ET-3764 integrin alpha-4/beta-7-targeting nacellin (oral, IBD), Encycle Therapeutics Inc | Integrin alpha-4/beta-7 antagonist |  | ET-3764; integrin alpha-4-beta-7-targeting nacellin (oral, IBD, Encycle; macrocyclic peptido-mimetics Encycle; nacellins (peptido-mimetic macrocycles), Encycle | PCT/CA2017/000244, which published as WO2018085921A1 |
| E-6007 (ER-46419501) Eisai Co Ltd | Integrin antagonist | 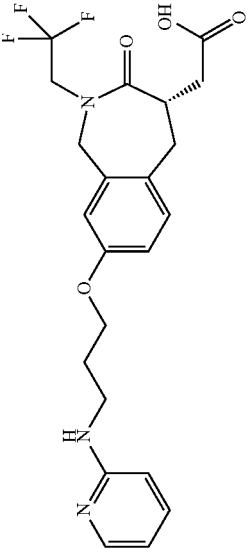 | E-6007; integrin activation inhibitor (ulcerative colitis/Crohn's disease), EA Pharma; integrin activation inhibitor (ulcerative | See chemical structure; Ohkuro M, et al. "E6007: An orally active inhibitor of integrin activation for inflammatory bowel disease" 2007 (May 20) Abs-S1588; Digestive Disease Week |

TABLE 6-continued

Integrin Inhibitors

| Drug Name | Target-based Actions | Structure | Other Drug Names | References |
|---|---|---|---|---|
| ER-464195-01 (analogue of E6007) EA Pharma Co., Ltd | inhibits integrin activation by dissociating interaction between calreticulin (CRT) and integrin a 4 (ITGA4) | | colitis/Crohn's disease), Eisai | Ohkuro, Masayoshi, et al. "Calreticulin and integrin alpha dissociation induces anti-inflammatory programming in animal models of inflammatory bowel disease." Nature communications 9.1 (2018): 1982 and WO2005063705 |
| HCA-3551 EA Pharma Co Ltd | Integrin alpha-4/ beta-1 antagonist; Integrin alpha-4/ beta-7 antagonist | | HCA-3551; alpha-4 integrin antagonist (multiple sclerosis), Ajinomoto | Hirano, Yuta, et al. "Ameliorating effects of HCA 3551, alpha 4 integrin antagonist, on Theiler's murine encephalomyelitis virus (TMEV)-induced demyelinating disease." Journal of Neuroimmunology 275.1 (2014): 157. |
| DW-908e Pharmacopeia Inc | Integrin alpha-4/ beta-1 antagonist | 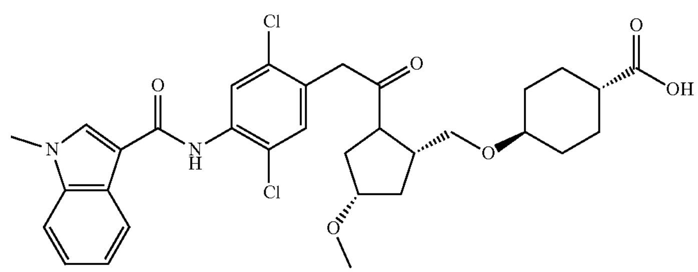 [SMILES: CO[C@@H]1CC(C(=O)Cc2cc(Cl)c(NC(=O)c3cn(C)c4ccccc34)cc2Cl)[C@H](CO[C@H]2CC[C@H](C(=O)O)CC2)C1] | DW-908e; PS-181895; PS-460644; PS-489655; PS-969819; allergy therapeutics, Daiichi; asthma therapeutics, Daiichi; asthma/allergy therapeutics, Daiichi | See chemical structure |

TABLE 6-continued

Integrin Inhibitors

| Drug Name | Target-based Actions | Structure | Other Drug Names | References |
|---|---|---|---|---|
| VLA-4 antagonists, Texas/Schering-Plough Encysive Pharmaceuticals Inc | Integrin alpha-4/beta-1 antagonist | (structure shown) | AVA-4746; TBC-3342; TBC-4746; VLA-4 antagonists, Encysive/Schering-Plough; VLA-4 antagonists, Texas/Schering-Plough; integrin alpha-4/beta-1 antagonists, Schering-Plough/Encysive | See chemical structure and WO-2004044046; EP-0103766; WO-2010008719 |
| GW-559090 GlaxoSmithKline plc | Integrin alpha-4/beta-1 antagonist | (structure shown) | 559090; GW-559090; alpha-4 integrin antagonist (inhaled), GlaxoSmithKline | See chemical structure and WO-00037444 |
| TRK-170 Toray Industries Inc | Integrin alpha-4/beta-1 antagonist; Integrin alpha-4/beta-7 antagonist | | TRK-170 | Koga Y, Kainoh, M "Effect of an orally active small molecule alpha4beta1/alpha4beta7 integrin antagonist, TRK-170, on experimental colitis in mice" International Congess on Immunology; 2010 (August 22-27) and Hiroe Hirokawa, et al. "Inhibitory Effects of an Orally Active Small Molecule Alpha4beta1/ |

TABLE 6-continued

Integrin Inhibitors

| Drug Name | Target-based Actions | Structure | Other Drug Names | References |
|---|---|---|---|---|
| integrin antagonists (inflammation), Ajinomoto Co Inc | Integrin alpha-4/ beta-1 antagonist | | carotegrast; integrin antagonists (inflammation), Ajinomoto | WO-00216329 |
| TRK-720 Toray Industries Inc | Integrin alpha-4/ beta-1 antagonist | 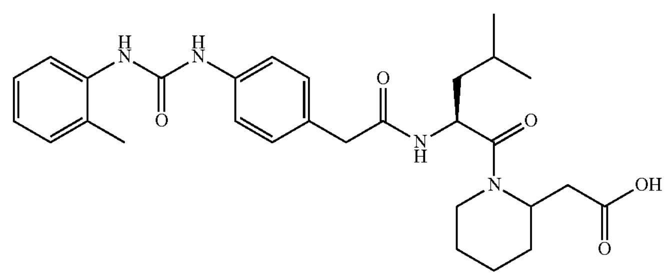 [SMILES: Cc1ccccc1NC(=O)Nc1ccc(CC(=O)N[C@@H](CC(C)C)C(=O)N2CCCCC2CC(=O)O)cc1] | TRK-720; TRK-720 hydrate; VLA4 inhibitor (inhaled, asthma), Toray | Shiraki M "Physical characterization of trk-720 hydrate, the very late antigen-4 (vla-4) inhibitor, as a solid form for inhalation: preparation of the hydrate by solvent exchange among its solvates and mechanistical considerations" Journal of Pharmaceutical Sciences; (2010) 99 (9) 3986-4004 |
| VLA-4 antagonists (inflammatory disorders) Merck | Integrin alpha-4/ beta-1 antagonist | | MK-0617 and MK-0668 | [MK-0617] CARLEVARO, C. MANUEL, et al. "Plausible binding mode of the active α4β1 antagonist, Mk-0617, determined by docking and free energy calculations." Journal of Theoretical and Computational Chemistry 12.02 (2013): 1250108. and [MK-0668] Lin, Linus S., et al. "Discovery of N-{N-[(3-Cyanophenyl)sulfonyl]-4 (R)-cyclobutylamino-(1)-prolyl]-4-[(3′,5′-dichloroisonicotinoyl)amino]-(1)-phenylalanine (MK-0668), an Extremely Potent and Orally Active Antagonist of Very Late Antigen-4." Journal of medicinal chemistry 52.11 (2009): 3449-3452. |
| LFA-1/ICAM interaction inhibitors Biogen Inc | CD11a modulator; ICAM-1 modulator | | LFA-1/ICAM interaction inhibitors, Biogen Idec | WO-2005105766 |

TABLE 6-continued

Integrin Inhibitors

| Drug Name | Target-based Actions | Structure | Other Drug Names | References |
|---|---|---|---|---|
| alpha-4 beta-1/alpha-4 beta-7 integrin antagonists Johnson & Johnson | Integrin alpha-4/beta-1 antagonist; Integrin alpha-4/beta-7 antagonist | | alpha-4 beta-1/alpha-4 beta-7 integrin antagonists, Johnson & Johnson | Lawson et al. "Selection of a 2-azabicyclo[2.2.2]octane-based .alpha.(4).beta.(1) integrin antagonist as an inhaled anti-asthmatic agent Bioorganic and Medicinal Chemistry; 2006 14 (12) 4208-4216 |
| VLA-4/VCAM antagonists (inflammation) Elan Corp plc | Integrin alpha-4/beta-1 antagonist; Vascular cell adhesion protein 1 modulator | 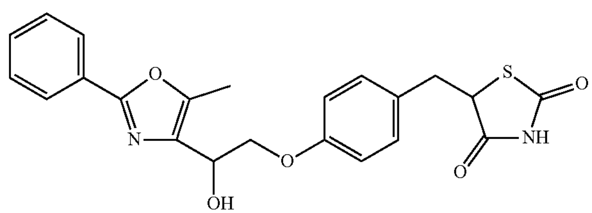 [SMILES: Cc1oc(-c2ccccc2)nc1C(O)COc1ccc(CC2SC(=O)NC2=O)cc1] | CT-737; CT-747; CT-757; CT-767; VLA-4/VCAM antagonists (inflammation), Elan/Wyeth; VLA-4/VCAM antagonists (inflammation), Elan/Wyeth-Ayerst | Xu Y, et al "Arylsulfonamide pyrimidines as vla-4 antagonists" Bioorganic and Medicinal Chemistry Letters; 2013 23 (10) 3070-3074 |
| integrin antagonists, Zeneca Group plc | Integrin antagonist; Vascular cell adhesion protein 1 antagonist | 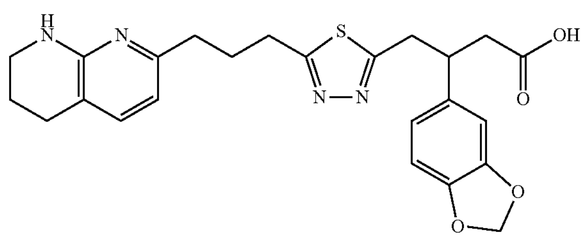 [SMILES: O=C(O)CC(Cc1nnc(CCCc2ccc3c(n2)NCCC3)s1)c1ccc2c(c1)OCO2] | VCAM antagonists, Zeneca; fibronectin antagonists, Zeneca; integrin antagonists, Zeneca | WO-09702289 and Haworth D et al., "Anti-inflammatory activity of c(ILDV-NH(CH2)5CO), a novel, selective, cyclic peptide inhibitor of VLA-4-mediated cell adhesion" British Journal of Pharmacology; 1999 126 (8) 1751-1760 |
| SB-683698 Tanabe Seiyaku Co Ltd | Integrin alpha-4/beta-1 antagonist; Integrin alpha-4/beta-7 antagonist | | SB-683698; TR-14035; TR-9109 | Tsuda-Tsukimoto M, et al. "Characterization of hepatobiliary transport systems of a novel alpha4beta1/alpha4beta7 dual antagonist, TR-14035", Pharmaceutical Research; 2006 23 (11) 2646-2656 |

TABLE 6-continued

Integrin Inhibitors

| Drug Name | Target-based Actions | Structure | Other Drug Names | References |
|---|---|---|---|---|
| R-1541 Roche Holding Co | Integrin antagonist | 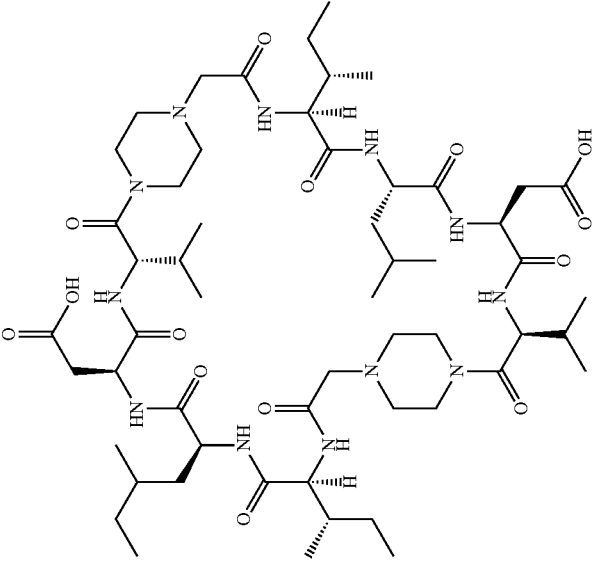 | R-1541 | See chemical structure |
| alpha-4/beta-7 antagonists, Millennium LeukoSite Inc | Integrin alpha-4/beta-7 antagonist; MAdCAM inhibitor | 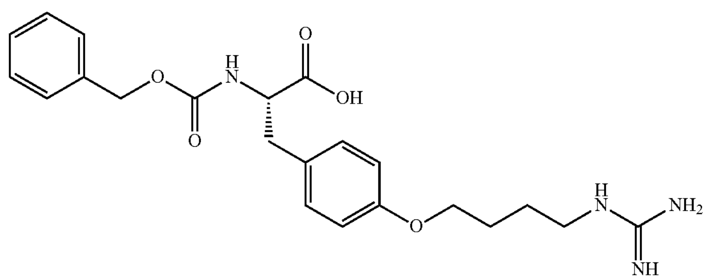 [SMILES: N=C(N)NCCCCOc1ccc(C[C@H](NC(=O)OCc2ccccc2)C(=O)O)cc1] | A4B7 program, Millennium; alpha-4/beta-7 antagonists, Millennium; autoimmune therapeutics, Genzyme/ LeukoSite; beta-7 integrin receptor antagonists, LeukoSite; inflammatory disease therapeutics, Genzyme/ LeukoSite; | Harriman GC et al. "Cell adhesion antagonists: Synthesis and evaluation of a novel series of phenylalanine based inhibitors" Bioorganic and Medicinal Chemistry Letters; 2000 10 (14) 1497-1499 |

TABLE 6-continued

Integrin Inhibitors

| Drug Name | Target-based Actions | Structure | Other Drug Names | References |
|---|---|---|---|---|
| | | | inflammatory therapeutics, LeukoSite; small molecule IBS program, Millennium | |
| CP-664511 Pfizer | Integrin alpha-4/ beta-1 antagonist; Vascular cell adhesion protein 1 antagonist | | CP-664511; VLA-4 antagonists, Pfizer | WO-00151487 and Kudlacz E, et al. "Pulmonary eosinophilia in a murine model of allergic inflammation is attenuated by small molecule alpha4beta1 antagonists" Journal of Pharmacology and Experimental Therapeutics; 2002 301 (2) 747-752 |
| BETA-7 INHIBITORS | | | | |
| alpha epsilon beta 7 integrin antagonists (inflammatory disease), NIAID | Integrin alpha-E antagonist; Integrin beta-7 antagonist | | alpha epsilon beta 7 integrin antagonists (inflammatory disease), NIAID | U.S. Ser. No. 09/856,544 and PCT/US99/27817 |
| alpha-4/beta-7 integrin inhibitors, Institut de Recherche Jouveinal SA (IRJ) | Integrin alpha-4/ beta-7 antagonist | | alpha-4/beta-7 integrin inhibitors, Jouveinal | Callier Dublanchet A-C, et al. "Potential alpha4beta7 integrin-mediated cell adhesion inhibitors: synthesis and evaluation of novel pyrazolones derivatives and a study of their stability" ACS Meeting; 2000 220th (Washington DC) MEDI 142 |
| ITGAL—Integrin alpha-L | | | | |

TABLE 6-continued

Integrin Inhibitors

| Drug Name | Structure | Target-based Actions | Other Drug Names | References |
|---|---|---|---|---|
| lifitegrast Sunesis Pharmaceuticals Inc | 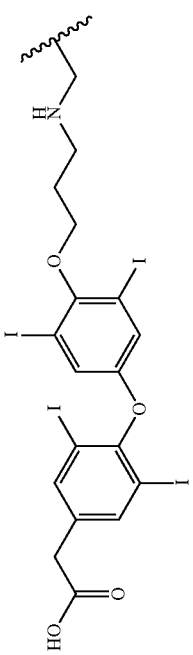 | CD11a antagonist (integrin alpha-L (ITGAL)) ICAM-1 inhibitor | SAR-1118; SHP-606; SPD-606; Xiidra; dual LFA-1/ICAM-1 inhibitors (inflammatory diseases), SARcode; dual LFA-1/ICAM-1 inhibitors, Sunesis; lifitegrast; lifitegrast sodium | Zhong M, et al. "Structure-activity relationship (SAR) of the alpha-amino acid residue of potent tetrahydroisoquinoline (THIQ)-derived LFA-1/ICAM-1 antagonists" Bioorganic and Medicinal Chemistry Letters; 2011 21 (1) 307-310 |
| BIRT-2584 Boehringer Ingelheim International GmbH | 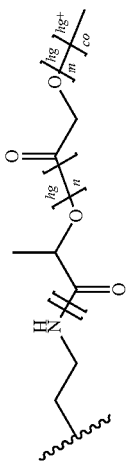 | CD11a antagonist; Cell adhesion molecule inhibitor; ICAM-1 inhibitor; ITGAL | BIRT-0377; BIRT-2584; BIRT-2584 XX; BIRT-377; ICAM-1 antagonists (inflammation), Boehringer Ingelheim; LFA-1 inhibitors (inflammation/allergy), Boehringer Ingelheim | Wu J-P, et al. "The discovery of 1H-imidazo[1,2-alfa]imidazol-2-one derivatives as LFA-1 inhibitors" Inflammation Research; 2003 52 (Suppl 2) Abs 137 and WO-2007084882 |
| LFA-1/ICAM-1 interaction inhibitors, Genentech/Roc | | CD11a modulator; CD11b modulator; ICAM-1 modulator | CP151088; ICAM-2078; ICAM-850; LFA-1/ICAM-1 interaction inhibitors, Genentech/Roche; LFA-1/ICAM-1 | Khojasteh SC, et al. "Preclinical absorption, distribution, metabolism and excretion (ADME) characterization of ICAM1988, an LFA-1/ICAM antagonist, and its prodrug" Xenobiotica; 2008 38 (3) 340-352 and WO-02059114 |

TABLE 6-continued

Integrin Inhibitors

| Drug Name | Target-based Actions | Structure | Other Drug Names | References |
|---|---|---|---|---|
| | | | interaction inhibitors, Roche; Mac-1/ICAM-1 interaction inhibitors, Genentech; Mac-1/ICAM-1 interaction inhibitors, Roche; RO-0276845; RO-5182851; RO-5184438; RO-5200045 | |
| LFA-1 inhibitors, Novartis Pharma AG | CD11a antagonist; ICAM inhibitor | 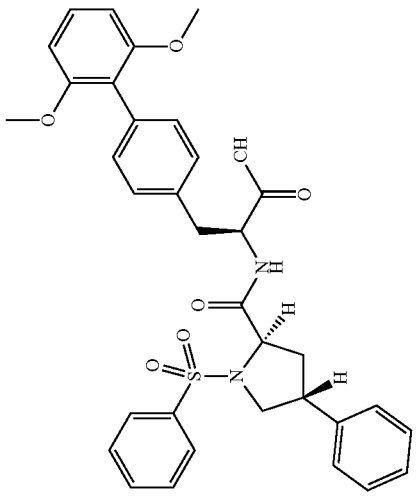 | LFA-1 inhibitors, Novartis; LFA-451; LFA-703; LFA-878; XVA-143 | See chemical structure |

TABLE 6-continued

Integrin Inhibitors

| Drug Name | Target-based Actions | Structure | Other Drug Names | References |
|---|---|---|---|---|
| IC-776 ICOS Corp | CD11a antagonist; ICAM inhibitor | 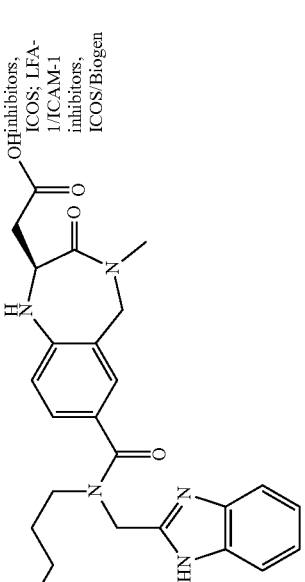 | A-276594; A-286982; A-292949; A-295339; A-324920; IC-52593; IC-776; LFA-1 antagonists, ICOS: LFA-1/ICAM-1 inhibitors, Abbott/ICOS; LFA-1/ICAM-1 inhibitors, ICOS: LFA-1/ICAM-1 inhibitors, ICOS/Biogen | Pei Z, et al. "Discovery of potent antagonists of leukocyte function-associated antigen-1/inercellular adhesion molecule-1 interaction. 3. Amide (C-ring) structure-activity relationship and improvement of overall properties of arylthio cinnamides" Journal of Medicinal Chemistry; 2001 44 (18) 2913-2920 |

Other exemplary integrin inhibitors include the following:

SMART anti-L-selectin Mab from PDL BioPharma Inc., which is an L-Selectin antagonist, and described in WO-09706822, and Co M S, et al., "Properties and pharmacokinetics of two humanized antibodies specific for L-selectin"; Immunotechnology; 1999 4:253-266; both of which are hereby incorporated by reference in their entireties.

SEL-K2, an anti-PSGL-1 antibody, from Tetherex Pharmaceuticals Inc, which is described in Barbara Muz, et al., "Inhibition of P-Selectin and PSGL-1 Using Humanized Monoclonal Antibodies Increases the Sensitivity of Multiple Myeloma Cells to Proteasome Inhibitors" American Society of Hematology Annual Meeting and Exposition; 2014 56th (December 8) Abs 4758, which is hereby incorporated by reference in its entirety.

Vatelizumab described in I. A. Antonijevic, et al., "Safety, tolerability and pharmacodynamic characterization of vatelizumab, a monoclonal antibody targeting very-late-antigen (VLA)-2: a randomized, double-blind, placebo-controlled phase 1 study" Abstract release date: Sep. 23, 2015) ECTRIMS Online Library. Oct. 9, 2015; and WO-2010095031; WO-2011104604; and WO-2010052556, which are all hereby incorporated by reference in their entireties.

anti-VCAM mAb, which is described in Soriano, Antonio, et al., "VCAM-1, but not ICAM-1 or MAdCAM-1, immunoblockade ameliorates DSS-induced colitis in mice." Laboratory Investigation 80.10 (2000): 1541; and Gerritsen M E, et al. (1995), "Activation-dependent isolation and culture of murine pulmonary microvascular endothelium," Microcirculation 2:151-163.

Cyclic Peptides

In some embodiments, the integrin inhibitor is a cyclic peptide. In some embodiments, the cyclic peptide comprises or consists of an amino acid sequence as set forth in the amino acid sequence of a ligand recognition sequence of an endogenous integrin ligand. In some embodiments, the cyclic peptide competes for a target integrin ligand binding site with an endogenous integrin ligand. In some embodiments, the cyclic peptide includes one or more (e.g., 1, 2, 3, 4, 5, 6, 7, 8) D-amino acids. In some embodiments, the cyclic peptide is a synthetic cyclic peptide. In some embodiments, the synthetic cyclic peptide is a heptapeptide. In some embodiments, the synthetic cyclic peptide is eptifabitide (Integrilin™), or a variant thereof. In some embodiments, the cyclic peptide comprises a heterocyclic nucleic (e.g., a benzodiazepinone, a piperazine, a benzoazepinone, a nitroaryl, an isoxazoline, an indazole, or a phenol; Spalluto et al., Curr. Med. Chem. 12:51-70, 2005). In some embodiments, the cyclic peptide is a macrocycle (see, e.g., Halland et al., ACS Med. Chem. Lett. 5 (2): 193-198, 2014). In some embodiments, the peptide is ALG-1001 or a variant thereof (Mathis et al., Retin. Phys. 9:70, 2012). In some embodiments, the cyclic peptide is an imidazolone-phenylalanine derivative, a heteroaryl, hetrocyclic, and aryl derivative, a bicyclic-aromatic amino acid derivative, a cyclohexane-carboxylic acid derivative, a di-aryl substituted urea derivative, a multimeric L-alanine derivative, a L-alanine derivative, or a pyrimidyl-sulfonamide derivative (see, e.g., U.S. Pat. Nos. 6,630,492; 6,794,506; 7,049,306; 7,371,854; 7,759,387; 8,030,328; 8,129,366; 7,820,687; 8,350,010; and 9,345,793).

Peptidomimetics

In some embodiments, the integrin inhibitor is a peptidomimetic. In some embodiments, the peptidomimetic has an integrin-ligand recognition motif (e.g., RGD, KTS, or MLD). Sec, e.g., Carron et al., Cancer Research 58:1930-1935, 1998; Fanelli et al., Vascular Cell 6:11, 2014; and De Marco et al., Curr. Top. Med. Chem. 16 (3): 343-359, 2016.

In some embodiments, the peptidomimetic is an RGD (ArgGlyAsp)-based peptide (U.S. Pat. No. 8,809,338, incorporated by reference in its entirety herein). In some embodiments, the RGD-based peptide can be cilengitide or a variant thereof (EMD 12974) (Mas-Moruno et al., Anticancer Agents Med. Chem. 10:753-768, 2010; Reardon et al., Future Oncol. 7 (3): 339-354, 2011; Beckman et al., Clin. Genitourin Cancer 4 (4): 299-302, 2006; SC56631 (e.g., Engleman et al., Am Soc. Clin. Invest. 99 (9): 2284-2292, 1997; Peng et al., Nature Chem Biol. 2:381-389, 2006). In some embodiments, the peptidomimetic can be a Lys-Gly-Asp (KGD)-based peptide. In some embodiments, the peptidomimetic can be vipegitide or a variant thereof (Momic et al., Drug Design Devel. Therapy 9:291-304, 2015). In some embodiments, the peptidomimetic can be a peptide conjugated with an antimicrobial synthetic peptide. (e.g., ACDCRGDCFC conjugated with (KLAKLAK) 2 (Ellerby et al., Nat. Med. 5 (9): 1032-1038, 1999). Sce, e.g., U.S. Pat. No. 8,636,977.

Disintegrins

In some embodiments, the integrin inhibitor can be a disintegrin. The term "disintegrin" as used herein refers to a low molecular weight peptide integrin inhibitor derived from a snake venom (e.g., pit viper venom). In some embodiments, the disintegrin is a RGD (ArgGlyAsp)-, a KTS- or an MLD-based disintegrin.

Non-limiting examples of disintegrins include accutin, accurhagin-C, albolabrin, alternagin-c, barbourin, basilicin, bitisgabonin-1, bitisgabonin-2, bitistatin, cerastin, cereberin, cumanastatin 1, contortrostatin, cotiarin, crotatroxin, dendroaspin, disba-01, durissin, echistatin, EC3, elegantin, eristicophin, eristostatin, EMS11, EO4, EO5, flavoridin, flavostatin, insularin, jarastatin, jerdonin, jerdostatin, lachesin, lebein (e.g., lebein-1, lebein-2), leberagin-C, lebestatin, lutosin, molossin, obtustatin, ocellatusin, rhodocetin, rhodostomin, R-mojastin 1, salmosin, saxatilin, schistatin, tablysin-15, tergeminin, triflavin, trigramin, trimestatin, VA6, vicrostatin, viridin, viperstatin, VB7, VLO4, and VLO5, or a variant thereof. See, e.g., Arruda Macedo et al., Curr. Protein. Pept. Sci. 16 (6): 532-548, 2015; Hsu et al., Sci. Rep. 6:23387, 2016; Kele et al. Curr. Protein Pept. Sci. 6:532-548, 2015; Koh et al., Toxicon 59 (4): 497-506, 2012; Scarborough et al., J. Biol. Chem. 268:1058-1065, 1993; Kisiel et al., FEBS Lett. 577:478-482, 2004; Souza et al., Arch. Biochem. Biophys. 384:341-350, 2000; Eble et al., J. Biol. Chem. 278:26488-26496, 2003; Marcinkiewicz et al., J. Biol. Chem. 274:12468-12473, 1999; Calvete et al., J. Proteome Res. 6:326-336, 2007; Scibelli et al., FEMS Microbiol. Lett. 247:51-57, 2005; Oliva et al., Toxicon 50:1053-1063, 2007; Minca et al., Toxicon 59:472-486, 2012; Smith et al., FEBS Lett. 512:111-115, 2002; Tselepis et al., J. Biol. Chem. 272:21341-21348, 1997; Da Silva et al., Tromb. Res. 123:731-739, 2009; Thibault et al., Mol. Pharmacol. 58:1137-1145, 2000; Lu et al., Biochem. J. 304:818-825, 1994; Yeh et al., Biochim. Biophys. Acta. 1425:493-504, 1998; Huang et al., Exp. Hematol. 36:1704-1713, 2008; Shih et al., Matrix Biol. 32:152-159, 2013; Wang et al., Br. J. Pharmacol. 160:1338-1351, 2010; Della-Casa et al., Toxicon 57:125-133, 2011; Sheu et al., Biochim. Biophys. Acta. 1336:445-454, 1997; Fujii et al., J. Mol. Biol. 332: 115-122, 2003; Bilgrami et al., J. Mol. Biol. 341:829-837, 2004; Zhou et al., Toxicon 43:69-75, 2004; Scarborough et al., J. Biol. Chem. 268:1066-1073, 1993; Shebuski et al., J.

Biol. Chem. 264:21550-21556, 1989; Lu et al., Biochem. J. 304:929-936, 1994; McLane et al., Biochem. J. 301:429-436, 1994; Juarez et al., Toxicon 56:1052-1058, 2010; Olfa et al., Lab. Invest. 85:1507-1516, 2005; Elbe et al., Matrix Biol. 21:547-558, 2002; Bazan-Socha et al., Biochemistry 43:1639-1647, 2004; Danen et al., Exp. Cell. Res. 238:188-196, 1998; Marcinkiewicz et al., Biochemistry 38 (40): 13302-13309, 1999; Calvete et al., Biochem. J. 372:725-734, 2003; Swenson et al., Pathophysiol. Haemost. Thromb. 34:169-178, 2005; Kwon et al., PLOS One 8; e81165, 2013; Yang et al., Toxicon 45:661-669, 2005; Limam et al., Matrix Biol. 29:117-126, 2010; Gan et al., J. Biol. Chem. 263: 19827-19832, 1988; Ma et al., Thromb. Haemost. 105 (6): 1032-1045, 2011; and U.S. Pat. No. 7,074,408, incorporated in their entirety herein.

Chemokine/Chemokine Receptor Inhibitors

The term "chemokine/chemokine receptor inhibitors" refers to an agent which decreases the ability of a chemokine to bind to its receptor, where the chemokine is one of CXCL10 (IL-10), CCL11, or an ELR chemokine, or the chemokine receptor is CCR2 or CCR9.

CXCL10 (IP-10) Inhibitors

As used herein "CXCL10," "interferon gamma-induced protein 10" and "IP-10" can be used interchangeably. CXCL 10 binds to the CXCR3 receptor (e.g., CXCR3-A or CXCR3-B).

The term "CXCL10 inhibitor" refers to an agent which decreases the ability of CXCL10 to bind to a CXCR3 receptor (e.g., CXCR3-A and/or CXCR3-B).

In some embodiments, the CXCL10 inhibitor can decrease the binding between CXCL10 and CXCR3-A by blocking the ability of CXCL10 to interact with CXCR3-A. In some embodiments, the CXCL10 inhibitor can decrease the binding between CXCL10 and CXCR3-B by blocking the ability of CXCL10 to interact with CXCR3-B.

In some instances, the CXCL10 inhibitor that decreases the binding between CXCL10 and a CXCR3 (e.g., CXCR3-A and/or CXCR3-B) is a small molecule. In some instances, the CXCL10 inhibitor that decreases the binding between CXCL10 and a CXCR3 (e.g., CXCR3-A and/or CXCR3-B) is an antibody or an antigen-binding antibody fragment. In some instances, the CXCL10 inhibitor that decreases the binding between CXCL10 and a CXCR3 (e.g., CXCR3-A and/or CXCR3-B) is a peptide (e.g., a peptide antagonist of a CXCR3 receptor, e.g., one or both of CXCR-A and/or CXCR-B).

Exemplary sequences for human CXCL10 and human CXCR3 are shown in SEQ ID NOs: 182-184.

```
Human CXCL10
                                          (SEQ ID NO: 182)
vplsrtvrc tcisisnqpv nprslekle1 ipasqfcprv eiiatmkkkg ekrclnpesk aiknllkavs kerskrsp Human CXCR3 Isoform 1
                                          (SEQ ID NO: 183)
mvlevsdhqv lndaevaall enfsssydyg enesdsccts ppcpqdfsln fdraflpaly sllfllgllg ngavaavlls rrtalsstdt fllhlavadt llvltlplwa vdaavqwvfg sglckvagal fninfyagal llacisfdry lnivhatqly rrgpparvtl tclavwglcl lfalpdfifl sahhderlna thcqynfpqv grtalrylql vagfllpllv maycyahila
```

```
vllvsrgqrr lramrlvvvv vvafalcwtp yhlvvlvdil mdlgalarnc gresrvdvak svtsglgymh cclnpllyaf vgvkfrermw mlllrlgcpn qrglqrqpss srrdsswset seasysgl Human CXCR3 Isoform 2
                                          (SEQ ID NO: 184)
melrkygpgr lagtviggaa qsksqtksds itkeflpgly tapsspfpps qvsdhqvlnd aevaallenf sssydygene sdscctsppc pqdfslnfdr aflpalysll fllgllgnga vaavllsrrt alsstdtfll hlavadtllv ltlplwavda avqwvfgsgl ckvagalfni nfyagallla cisfdrylni vhatqlyrrg pparvtltcl avwglcllfa lpdfiflsah hderlnathc qynfpqvgrt alrvlqlvag fllpllvmay cyahilavll vsrgqrrlra mrlvvvvvva falcwtpyhl vvlvdilmdl galarncgre srvdvaksvt sglgymhccl npllyafvgv kfrermwmll lrlgcpnqrg lqrqpsssrr dsswsetsea sysgl
```

Antibodies

In some embodiments, the CXCL10 inhibitor is an antibody or an antigen-binding fragment thereof (e.g., a Fab or a scFv). In some embodiments, an antibody or antigen-binding fragment described herein binds specifically to CXCL10 or a CXCR3 receptor (e.g., CXCR3-A and/or CXCR3-B), or both a CXCL10 and a CXCR3 receptor (e.g., CXCR3-A and/or CXCR3-B). In some embodiments, a CXCL10 inhibitor can bind to both CXCR3-A and CXCR3-B.

In some embodiments, the antibody can be a humanized antibody, a chimeric antibody, a multivalent antibody, or a fragment thereof. In some embodiments, an antibody can be a scFv-Fc (Sokolowska-Wedzina et al., Mol. Cancer Res. 15 (8): 1040-1050, 2017), a VHH domain (Li et al., Immunol. Lett. 188:89-95, 2017), a VNAR domain (Hasler et al., Mol. Immunol. 75:28-37, 2016), a (scFv) 2, a minibody (Kim et al., PLOS One 10 (1): e113442, 2014), or a BiTE. In some embodiments, an antibody can be a DVD-Ig (Wu et al., Nat. Biotechnol. 25 (11): 1290-1297, 2007; WO 08/024188; WO 07/024715), and a dual-affinity re-targeting antibody (DART) (Tsai et al., Mol. Ther. Oncolytics 3:15024, 2016), a triomab (Chelius et al., MAbs 2 (3): 309-319, 2010), kih IgG with a common LC (Kontermann et al., Drug Discovery Today 20 (7): 838-847, 2015), a crossmab (Regula et al., EMBO Mol. Med. 9 (7): 985, 2017), an ortho-Fab IgG (Kontermann et al., Drug Discovery Today 20 (7): 838-847, 2015), a 2-in-1-IgG (Kontermann et al., Drug Discovery Today 20 (7): 838-847, 2015), IgG-scFv (Cheal et al., Mol. Cancer Ther. 13 (7): 1803-1812, 2014), scFv2-Fc (Natsume et al., J. Biochem. 140 (3): 359-368, 2006), a bi-nanobody (Kontermann et al., Drug Discovery Today 20 (7): 838-847, 2015), tanden antibody (Kontermann et al., Drug Discovery Today 20 (7): 838-847, 2015), a DART-Fc (Kontermann et al., Drug Discovery Today 20 (7): 838-847, 2015), a scFv-HSA-scFv (Kontermann et al., Drug Discovery Today 20 (7): 838-847, 2015), DNL-Fab3 (Kontermann et al., Drug Discovery Today 20 (7): 838-847, 2015), DAF (two-in-one or four-in-one), DutaMab, DT-IgG, knobs-in-holes common LC, knobs-in-holes assembly, charge pair antibody, Fab-arm exchange antibody, SEEDbody, Triomab, LUZ-Y, Fcab, k-body, orthogonal Fab, DVD-IgG, IgG (H)-scFv, scFv-(H) IgG, IgG (L)-scFv, scFv-(L)-IgG, IgG (L,H)-Fc, IgG (H)-V, V (H)-IgG, IgG (L)-V, V (L)-IgG, KIH IgG-scFab, 2scFv-IgG, IgG-2scFv, scFv4-Ig, Zybody, DVI-IgG, nanobody (e.g., antibodies derived from *Camelus bactriamus, Calelus dromaderius*, or *Lama paccos*) (U.S. Pat. No. 5,759,808; Stijlemans et al., *J. Biol. Chem.* 279:1256-1261, 2004; Dumoulin et al., *Nature* 424:783-788, 2003; and Pleschberger et al., *Bioconjugate Chem.* 14:440-448, 2003), nanobody-HSA, a diabody (e.g., Poljak, Structure 2 (12): 1121-1123, 1994; Hudson et al., *J. Immunol. Methods* 23 (1-2): 177-189, 1999), a TandAb (Reusch et al., mAbs 6 (3): 727-738, 2014), scDiabody (Cuesta et al., *Trends in Biotechnol.* 28 (7): 355-362, 2010), scDiabody-CH3 (Sanz et al., *Trends in Immunol.* 25 (2): 85-91, 2004), Diabody-CH3, Triple Body, miniantibody, minibody, TriBi minibody, scFv-CH3 KIH, Fab-scFv, scFv-CH-CL-scFv, F(ab')2-scFV2, scFv-KIH, Fab-scFv-Fc, tetravalent HCAb, scDiabody-Fc, diabody-Fc, tandem scFv-Fc, intrabody (Huston et al., *Human Antibodies* 10 (3-4): 127-142, 2001; Wheeler et al., *Mol. Ther.* 8 (3): 355-366, 2003; and Stocks, *Drug Discov. Today* 9 (22): 960-966, 2004), dock and lock bispecific antibody, ImmTAC, HSAbody, scDiabody-HSA, tandem scFv, IgG-IgG, Cov-X-Body, and scFv1-PEG-scFv2.

Non-limiting examples of an antigen-binding fragment of an antibody include an Fv fragment, a Fab fragment, a F(ab')2 fragment, and a Fab' fragment. Additional examples of an antigen-binding fragment of an antibody is an antigen-binding fragment of an IgG (e.g., an antigen-binding fragment of IgG1, IgG2, IgG3, or IgG4) (e.g., an antigen-binding fragment of a human or humanized IgG, e.g., human or humanized IgG1, IgG2, IgG3, or IgG4); an antigen-binding fragment of an IgA (e.g., an antigen-binding fragment of IgA1 or IgA2) (e.g., an antigen-binding fragment of a human or humanized IgA, e.g., a human or humanized IgA1 or IgA2); an antigen-binding fragment of an IgD (e.g., an antigen-binding fragment of a human or humanized IgD); an antigen-binding fragment of an IgE (e.g., an antigen-binding fragment of a human or humanized IgE); or an antigen-binding fragment of an IgM (e.g., an antigen-binding fragment of a human or humanized IgM).

In some embodiments, an antibody can be an IgNAR, a bispecific antibody (Milstein and Cuello, *Nature* 305:537-539, 1983; Suresh et al., *Methods in Enzymology* 121:210, 1986; WO 96/27011; Brennan et al., *Science* 229:81, 1985; Shalaby et al., *J. Exp. Med.* 175:217-225, 1992; Kolstelny et al., *J. Immunol.* 148 (5): 1547-1553, 1992; Hollinger et al., *Proc. Natl. Acad. Sci. U.S.A.* 90:6444-6448, 1993; Gruber et al., *J. Immunol.* 152:5368, 1994; and Tutt et al., *J. Immunol.* 147:60, 1991), a bispecific diabody, a triabody (Schoonooghe et al., *BMC Biotechnol.* 9:70, 2009), a tetrabody, scFv-Fc knobs-into-holes, a scFv-Fc-scFv, a (Fab'scFv)$_2$, a V-IgG, a IvG-V, a dual V domain IgG, a heavy chain immunoglobulin or a camelid (Holt et al., *Trends Biotechnol.* 21 (11): 484-490, 2003), an intrabody, a monoclonal antibody (e.g., a human or humanized monoclonal antibody), a heteroconjugate antibody (e.g., U.S. Pat. No. 4,676, 980), a linear antibody (Zapata et al., *Protein Eng.* 8 (10:1057-1062, 1995), a trispecific antibody (Tutt et al., *J. Immunol.* 147:60, 1991), a Fabs-in-Tandem immunoglobulin (WO 15/103072), or a humanized camelid antibody.

In some embodiments, the antibody is a humanized antibody, a chimeric antibody, a multivalent antibody, or a fragment thereof. In some embodiments, the antibody is a monoclonal antibody. In some embodiments, the antibody is a humanized monoclonal antibody. See e.g., Hunter & Jones, *Nat. Immunol.* 16:448-457, 2015; and Heo et al., *Oncotarget* 7 (13): 15460-15473, 2016. Additional examples of antibodies and antigen-binding fragments thereof are described in U.S. Pat. Nos. 8,440,196; 7,842,144; 8,034,344; and 8,529,895; US 2013/0317203; US 2014/0322239; US 2015/0166666; US 2016/0152714; and US 2017/0002082, each of which is incorporated by reference in its entirety (e.g., the sections describing CXCL10 inhibitors).

In other instances, the CXCL10 inhibitor is a monoclonal antibody (mAb) (see, e.g., WO 05/58815). For example, the CXCL10 inhibitor can be Eldelumab® (MDX-1100 or BMS-936557), BMS-986184 (Bristol-Meyers Squibb), or NI-0801 (NovImmune). See, e.g., Kuhne et al., *J. Immunol.* 178 (1): S241, 2007; Sandborn et al., *J. Crohns Colitis* 11 (7): 811-819, 2017; and Danese et al., *Gastroenterology* 147 (5): 981-989, 2014. Additional examples of CXCL10 inhibitors that are antibodies are described in U.S. Patent Application Publication Nos. 2017/0158757, 2017/0081413, 2016/0009808, 2015/0266951, 2015/0104866, 2014/0127229, 2014/0065164, 2013/0216549, 2010/0330094, 2010/0322941, 2010/0077497, 2010/0021463, 2009/0285835, 2009/0169561, 2008/0063646, 2005/0191293, 2005/0112119, 2003/0158392, 2003/0031645, and 2002/0018776; and WO 98/11218, each of which is incorporated by reference in its entirety (e.g., the description of CXCL10 inhibitors).

In some embodiments, any of the antibodies or antigen-binding fragments described herein has a dissociation constant ($K_D$) of less than $1 \times 10^{-5}$ M (e.g., less than $0.5 \times 10^{-5}$ M, less than $1 \times 10^{-6}$ M, less than $0.5 \times 10^{-6}$ M, less than $1 \times 10^{-7}$ M, less than $0.5 \times 10^{-7}$ M, less than $1 \times 10^{-8}$ M, less than $0.5 \times 10^{-8}$ M, less than $1 \times 10^{-9}$ M, less than $0.5 \times 10^{-9}$ M, less than $1 \times 10^{-10}$ M, less than $0.5 \times 10^{-10}$ M, less than $1 \times 10^{-11}$ M, less than $0.5 \times 10^{-11}$ M, or less than $1 \times 10^{-12}$ M), e.g., as measured in phosphate buffered saline using surface plasmon resonance (SPR).

In some embodiments, any of the antibodies or antigen-binding fragments described herein has a $K_D$ of about $1 \times 10^{-12}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$ M, about $0.5 \times 10^{-9}$ M, about $1 \times 10^{-10}$ M, about $0.5 \times 10^{-10}$ M, about $1 \times 10^{-11}$ M, or about $0.5 \times 10^{-11}$ M (inclusive); about $0.5 \times 10^{-11}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$ M, about $0.5 \times 10^{-9}$ M, about $1 \times 10^{-10}$ M, about $0.5 \times 10^{-10}$ M, or about $1 \times 10^{-11}$ M (inclusive); about $1 \times 10^{-11}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$ M, about $0.5 \times 10^{-9}$ M, about $1 \times 10^{-10}$ M, or about $0.5 \times 10^{-10}$ M (inclusive); about $0.5 \times 10^{-10}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$ M, about $0.5 \times 10^{-9}$ M, or about $1 \times 10^{-10}$ M (inclusive); about $1 \times 10^{-10}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$ M, or about $0.5 \times 10^{-9}$ M (inclusive); about $0.5 \times 10^{-9}$ M to about $1 \times 10^{5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, or about $1 \times 10^{-9}$ M (inclusive); about $1 \times 10^{-9}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, or about $0.5 \times 10^{-8}$ M (inclusive); about $0.5 \times 10^{-8}$ M to about $1 \times 10^{-5}$ M, about 0.5×10$^{-5}$ M, about 1×10$^{-6}$ M, about 0.5×10$^{-6}$ M, about 1×10$^{-7}$ M, about 0.5×10$^{-7}$ M, or about 1×10$^{-8}$ M (inclusive); about 1×10$^{-8}$ M to about 1×10$^{5}$ M, about 0.5×10$^{5}$ M, about 1×10$^{-6}$ M, about 0.5×10$^{-6}$ M, about 1×10$^{-7}$ M, or about 0.5×10$^{-7}$ M (inclusive); about 0.5×10$^{-7}$ M to about 1×10$^{-5}$ M, about 0.5×10$^{-5}$ M, about 1×10$^{-6}$ M, about 0.5×10$^{-6}$ M, or about 1×10$^{-7}$ M (inclusive); about 1×10$^{-7}$ M to about 1×10$^{-5}$ M, about 0.5×10$^{-5}$ M, about 1×10$^{-6}$ M, or about 0.5×10$^{-6}$ M (inclusive); about 0.5×10$^{-6}$ M to about 1×10$^{-5}$ M, about 0.5×10$^{-5}$ M, or about 1×10$^{-6}$ M (inclusive); about 1×10$^{-6}$ M to about 1×10$^{-5}$ M or about 0.5×10$^{-5}$ M (inclusive); or about 0.5×10$^{-5}$ M to about 1×10$^{-5}$ M (inclusive), e.g., as measured in phosphate buffered saline using surface plasmon resonance (SPR).

In some embodiments, any of the antibodies or antigen-binding fragments described herein has a K$_{off}$ of about 1×10$^{-6}$ s$^{-1}$ to about 1×10$^{-3}$ s$^{-1}$, about 0.5×10$^{-3}$ s$^{-1}$, about 1×10$^{-4}$ s$^{-1}$, about 0.5×10$^{-4}$ s$^{-1}$, about 1×10$^{-5}$ s$^{-1}$, or about 0.5×10$^{-5}$ s$^{-1}$ (inclusive); about 0.5×10$^{-5}$ s$^{1}$ to about 1×10$^{-3}$ s$^{-1}$, about 0.5×10$^{-3}$ s$^{-1}$, about 1×10$^{-4}$ s$^{-1}$, about 0.5×10$^{-4}$ s$^{-1}$, or about 1×10$^{-5}$ s$^{-1}$ (inclusive); about 1×10$^{-5}$ s$^{1}$ to about 1×10$^{-3}$ s$^{-1}$, about 0.5×10$^{-3}$ s$^{-1}$, about 1×10$^{-4}$ s$^{-1}$, or about 0.5×10$^{-4}$ s$^{-1}$ (inclusive); about 0.5×10$^{-4}$ s$^{-1}$ to about 1×10$^{-3}$ s$^{-1}$, about 0.5×10$^{-3}$ s$^{-1}$, or about 1×10$^{-4}$ s$^{-1}$ (inclusive); about 1×10$^{-4}$ s$^{-1}$ to about 1×10$^{-3}$ s$^{-1}$, or about 0.5×10$^{-3}$ s$^{-1}$ (inclusive); or about 0.5×10$^{-5}$ s$^{-1}$ to about 1×10$^{-3}$ s$^{-1}$ (inclusive), e.g., as measured in phosphate buffered saline using surface plasmon resonance (SPR).

In some embodiments, any of the antibodies or antigen-binding fragments described herein has a K$_{on}$ of about 1×10$^{2}$ M$^{-1}$s$^{-1}$ to about 1×10$^{6}$ M$^{-1}$s$^{-1}$, about 0.5×10$^{6}$ M$^{-1}$s$^{-1}$, about 1×10$^{5}$ M$^{-1}$s$^{-1}$, about 0.5×10$^{5}$ M$^{-1}$s$^{-1}$, about 1×10$^{4}$ M$^{-1}$s$^{-1}$, about 0.5×10$^{4}$ M$^{-1}$s$^{-1}$, about 1×10$^{3}$ M$^{-1}$s$^{-1}$, or about 0.5×10$^{3}$ M$^{-1}$s$^{-1}$ (inclusive); about 0.5×10$^{3}$ M$^{-1}$s$^{-1}$ to about 1×10$^{6}$ M$^{-1}$s$^{-1}$, about 0.5×10$^{6}$ M$^{-1}$s$^{-1}$, about 1×10$^{5}$ M$^{-1}$s$^{-1}$, about 0.5×10$^{5}$ M$^{-1}$s$^{-1}$, about 1×10$^{4}$ M$^{-1}$s$^{-1}$, about 0.5×10$^{4}$ M$^{-1}$s$^{-1}$, or about 1×10$^{3}$ M$^{-1}$s$^{-1}$ (inclusive); about 1×10$^{3}$ M$^{-1}$s$^{-1}$ to about 1×10$^{6}$ M$^{-1}$s$^{-1}$, about 0.5×10$^{6}$ M$^{-1}$s$^{-1}$, about 1×10$^{5}$ M$^{-1}$s$^{-1}$, about 0.5×10$^{5}$ M$^{-1}$s$^{-1}$, about 1×10$^{4}$ M$^{-1}$s$^{-1}$, or about 0.5×10$^{4}$ M$^{-1}$s$^{-1}$ (inclusive); about 0.5×10$^{4}$ M$^{-1}$s$^{-1}$ to about 1×10$^{6}$ M$^{-1}$s$^{-1}$, about 0.5×10$^{6}$ M$^{-1}$s$^{-1}$, about 1×10$^{5}$ M$^{-1}$s$^{-1}$, about 0.5×10$^{5}$ M$^{-1}$s$^{-1}$, or about 1×10$^{4}$ M$^{-1}$s$^{-1}$ (inclusive); about 1×10$^{4}$ M$^{-1}$s$^{-1}$ to about 1×10$^{6}$ M$^{-1}$s$^{-1}$, about 0.5×10$^{6}$ M$^{-1}$s$^{-1}$, about 1×10$^{5}$ M$^{-1}$s$^{-1}$, or about 0.5×10$^{5}$ M$^{-1}$s$^{-1}$ (inclusive); about 0.5×10$^{5}$ M$^{-1}$s$^{-1}$ to about 1×10$^{6}$ M$^{-1}$s$^{-1}$, about 0.5×10$^{6}$ M$^{-1}$s$^{-1}$, or about 1×10$^{5}$ M$^{-1}$s$^{-1}$ (inclusive); about 1×10$^{5}$ M$^{-1}$s$^{-1}$ to about 1×10$^{6}$ M$^{-1}$s$^{-1}$, or about 0.5×10$^{6}$ M$^{-1}$s$^{-1}$ (inclusive); or about 0.5×10$^{6}$ M$^{-1}$s$^{-1}$ to about 1×10$^{6}$ M$^{-1}$s$^{-1}$ (inclusive), e.g., as measured in phosphate buffered saline using surface plasmon resonance (SPR).

Additional examples of CXCL10 inhibitors that are antibodies or antigen-binding antibody fragments are known in the art.

CCL11 Inhibitors

The term "CCL11 inhibitor" refers to an agent which decreases the ability of CCL11 to bind to one or more of CCR2, CCR3, and CCR5.

In some embodiments, the CCL11 inhibitor can decrease the binding between CCL11 and CCR2 by blocking the ability of CCL11 to interact with CCR2. In some embodiments, the CCL11 inhibitor can decrease the binding between CCL11 and CCR3 by blocking the ability of CCL11 to interact with CCR3. In some embodiments, the CCL11 inhibitor can decrease the binding between CCL11 and CCR5 by blocking the ability of CCL11 to interact with CCR5.

In some embodiments, a CCL11 inhibitor is an antibody or an antigen-binding fragment thereof.

Exemplary sequences for human CCL11, human CCR2, human CCR3, and human CCR5 are shown in SEQ ID NOs: 185-191.

```
Human CCL11
                                        (SEQ ID NO: 185)
mkvsaallwl lliaaafspq glagpasvpt tccfnlanrk iplqrlesyr ritsgkcpqk avifktklak dicadpkkkw vqdsmkyldq ksptpkp Human CCR2 Isoform A
                                        (SEQ ID NO: 186)
mlstsrsrfi rntnesgeev ttffdydyga pchkfdvkqi gaqllpplys lvfifgfygn mlvvlilinc kklkcltdiy llnlaisdll flitlplwah saanewvfgn amcklftgly higyfggiff iilltidryl aivhavfalk artvtfgvvt svitwlvavf asvpgiiftk cqkedsvyvc gpyfprgwnn fhtimrnilg lvlpllimvi cysgilktll rcrnekkrhr avrviftimi vyflfwtpyn ivillntfqe ffglsncest sqldqatqvt etlgmthcci npiiyafvge kfrslfhial gcriaplqkp vcggpgvrpg knvkvttqgl ldgrgkgksi grapeaslqd kega Human CCR2 Isoform B
                                        (SEQ ID NO: 187)
mlstsrsrfi rntnesgeev ttffdydyga pchkfdvkqi gaqllpplys lvfifgfvgn mlvvlilinc kklkcltdiy llnlaisdll flitlplwah saanewvfgn amcklftgly higyfggiff iilltidryl aivhavfalk artvtfgvvt svitwlvavf asvpgiiftk cqkedsvyvc gpyfprgwnn fhtimrnilg lylpllimvi cysgilktll rcrnekkrhr avrviftimi vyflfwtpyn ivillntfqe ffglsncest sqldqatqvt etlgmthcci npiiyafvge kfrrylsvff rkhitkrfck qcpyfyretv dgvtstntps tgeqevsagl Human CCR3 Isoform 1
                                        (SEQ ID NO: 188)
mttsldtvet fgttsyyddv gllcekadtr almaqfvppl yslyftvgll gnvvvvmili kyrrlrimtn iyllnlaisd llflvtlpfw ihyvrghnwv fghgmcklls gfyhtglyse iffiilltid rylaivhavf alrartvtfg vitsivtwgl avlaalpefi fyeteelfee tlcsalyped tvyswrhfht lrmtifclvl pllvmaicyt giiktllrcp skkkykairl ifyimayffi fwtpynvail lssyqsilfg ndcerskhld lymlytevia yshccmnpvi yafvgerfrk ylrhffhrhl lmhlgryipf lpseklerts svspstaepe lsivf
```

```
Human CCR3 Isoform 2
                                        (SEQ ID NO: 189)
mpfgirmllr ahkpgssrrs emttsldtve tfgttsyydd vgllcekadt ralmaqfvpp lyslvftvgl lgnvvvvmil ikyrrlrimt niyllnlais dllflvtlpf wihyvrghnw vfghgmckll sgfyhtglys eiffiillti drylaivhav falrartvtf gvitsivtwg lavlaalpef ifyeteelfe etlcsalype dtvyswrhfh tlrmtifclv lpllymaicy tgiiktllrc pskkkykair lifvimavff ifwtpynvai llssyqsilf gndcerskhl dlvmlvtevi ayshccmnpv iyafvgerfr kylrhffhrh llmhlgryip flpseklert ssvspstaep elsivf Human CCR3 Isoform 3
                                        (SEQ ID NO: 190)
mpfgirmllr ahkpgrsemt tsldtvetfg ttsyyddvgl lcekadtral maqfvpplys lyftvgllgn vvvvmiliky rrlrimtniy llnlaisdll flvtlpfwih yvrghnwvfg hgmckllsgf yhtglyseif fiilltidry laivhavfal rartvtfgvi tsivtwglav laalpefify eteelfeetl csalypedtv yswrhfhtlr mtifclylpl lvmaicytgi iktllrcpsk kkykairlif vimavffifw tpynvaills syqsilfgnd cerskhldlv mlvteviays hccmnpviya fvgerfrkyl rhffhrhllm hlgryipflp seklertssv spstaepels ivf Human CCR5
                                        (SEQ ID NO: 191)
mdyqvsspiy dinyytsepc qkinvkqiaa rllpplysly fifgfvgnml vililinckr lksmtdiyll nlaisdlffl ltvpfwahya aaqwdfgntm cqlltglyfi gffsgiffii lltidrylav vhavfalkar tvtfgvvtsv itwvvavfas lpgiiftrsq keglhytcss hfpysqyqfw knfqtlkivi lglylpllvm vicysgilkt llrcrnekkr hravrlifti mivyflfwap ynivlllntf qeffglnncs ssnrldqamq vtetlgmthc cinpiiyafv gekfrnyllv ffqkhiakrf ckccsifqqe aperassvyt rstgeqeisv gl
```

Antibodies

In some embodiments, the CCL11 inhibitor is an antibody or an antigen-binding fragment thereof (e.g., a Fab or a scFv). In some embodiments, an antibody or antigen-binding fragment described herein binds specifically to CCL11, CCR2, CCR3, or CCR5, or can specifically bind to two or more of CCL11, CCR2, CCR3, and CCR5. In some embodiments, a CCL11 inhibitor can bind to two or more of CCR2, CCR3, and CCR5.

In some embodiments, the antibody can be a humanized antibody, a chimeric antibody, a multivalent antibody, or a fragment thereof. In some embodiments, an antibody can be a scFv-Fc (Sokolowska-Wedzina et al., *Mol. Cancer Res.* 15 (8): 1040-1050, 2017), a VHH domain (Li et al., *Immunol. Lett.* 188:89-95, 2017), a VNAR domain (Hasler et al., *Mol. Immunol.* 75:28-37, 2016), a (scFv) 2, a minibody (Kim et al., *PLOS One* 10 (1): e113442, 2014), or a BITE. In some embodiments, an antibody can be a DVD-Ig (Wu et al., *Nat. Biotechnol.* 25 (11): 1290-1297, 2007; WO 08/024188; WO 07/024715), and a dual-affinity re-targeting antibody (DART) (Tsai et al., *Mol. Ther. Oncolytics* 3:15024, 2016), a triomab (Chelius et al., MAbs 2 (3): 309-319, 2010), kih IgG with a common LC (Kontermann et al., *Drug Discovery Today* 20 (7): 838-847, 2015), a crossmab (Regula et al., *EMBO Mol. Med.* 9 (7): 985, 2017), an ortho-Fab IgG (Kontermann et al., *Drug Discovery Today* 20 (7): 838-847, 2015), a 2-in-1-IgG (Kontermann et al., *Drug Discovery Today* 20 (7): 838-847, 2015), IgG-scFv (Cheal et al., *Mol. Cancer Ther.* 13 (7): 1803-1812, 2014), scFv2-Fc (Natsume et al., *J. Biochem.* 140 (3): 359-368, 2006), a bi-nanobody (Kontermann et al., *Drug Discovery Today* 20 (7): 838-847, 2015), tanden antibody (Kontermann et al., *Drug Discovery Today* 20 (7): 838-847, 2015), a DART-Fc (Kontermann et al., *Drug Discovery Today* 20 (7): 838-847, 2015), a scFv-HSA-scFv (Kontermann et al., *Drug Discovery Today* 20 (7): 838-847, 2015), DNL-Fab3 (Kontermann et al., *Drug Discovery Today* 20 (7): 838-847, 2015), DAF (two-in-one or four-in-one), DutaMab, DT-IgG, knobs-in-holes common LC, knobs-in-holes assembly, charge pair antibody, Fab-arm exchange antibody, SEEDbody, Triomab, LUZ-Y, Fcab, kx-body, orthogonal Fab, DVD-IgG, IgG (H)-scFv, scFv-(H) IgG, IgG (L)-scFv, scFv-(L)-IgG, IgG (L,H)-Fc, IgG (H)-V, V (H)-IgG, IgG (L)-V, V (L)-IgG, KIH IgG-scFab, 2scFv-IgG, IgG-2scFv, scFv4-Ig, Zybody, DVI-IgG, nanobody (e.g., antibodies derived from *Camelus bactriamus, Calelus dromaderius,* or *Lama paccos*) (U.S. Pat. No. 5,759,808; Stijlemans et al., *J. Biol. Chem.* 279:1256-1261, 2004; Dumoulin et al., *Nature* 424:783-788, 2003; and Pleschberger et al., *Bioconjugate Chem.* 14:440-448, 2003), nanobody-HSA, a diabody (e.g., Poljak, Structure 2 (12): 1121-1123, 1994; Hudson et al., *J. Immunol. Methods* 23 (1-2): 177-189, 1999), a TandAb (Reusch et al., mAbs 6 (3): 727-738, 2014), scDiabody (Cuesta et al., *Trends in Biotechnol.* 28 (7): 355-362, 2010), scDiabody-CH3 (Sanz et al., *Trends in Immunol.* 25 (2): 85-91, 2004), Diabody-CH3, Triple Body, miniantibody, minibody, TriBi minibody, scFv-CH3 KIH, Fab-scFv, scFv-CH-CL-scFv, F(ab')2-scFV2, scFv-KIH, Fab-scFv-Fc, tetravalent HCAb, scDiabody-Fc, diabody-Fc, tandem scFv-Fc, intrabody (Huston et al., *Human Antibodies* 10 (3-4): 127-142, 2001; Wheeler et al., *Mol. Ther.* 8 (3): 355-366, 2003; and Stocks, *Drug Discov. Today* 9 (22): 960-966, 2004), dock and lock bispecific antibody, ImmTAC, HSAbody, scDiabody-HSA, tandem scFv, IgG-IgG, Cov-X-Body, and scFv1-PEG-scFv2.

Non-limiting examples of an antigen-binding fragment of an antibody include an Fv fragment, a Fab fragment, a F(ab')2 fragment, and a Fab' fragment. Additional examples of an antigen-binding fragment of an antibody is an antigen-binding fragment of an IgG (e.g., an antigen-binding fragment of IgG1, IgG2, IgG3, or IgG4) (e.g., an antigen-binding fragment of a human or humanized IgG, e.g., human or humanized IgG1, IgG2, IgG3, or IgG4); an antigen-binding fragment of an IgA (e.g., an antigen-binding fragment of IgA1 or IgA2) (e.g., an antigen-binding fragment of a human or humanized IgA, e.g., a human or humanized IgA1 or IgA2); an antigen-binding fragment of an IgD (e.g., an antigen-binding fragment of a human or humanized IgD); an antigen-binding fragment of an IgE (e.g., an antigen-binding fragment of a human or humanized IgE); or an antigen-binding fragment of an IgM (e.g., an antigen-binding fragment of a human or humanized IgM).

In some embodiments, an antibody can be an IgNAR, a bispecific antibody (Milstein and Cuello, *Nature* 305:537-539, 1983; Suresh et al., *Methods in Enzymology* 121:210, 1986; WO 96/27011; Brennan et al., *Science* 229:81, 1985; Shalaby et al., *J. Exp. Med.* 175:217-225, 1992; Kolstelny et al., *J. Immunol.* 148 (5): 1547-1553, 1992; Hollinger et al., *Proc. Natl. Acad. Sci. U.S.A.* 90:6444-6448, 1993; Gruber et al., *J. Immunol.* 152:5368, 1994; and Tutt et al., *J. Immunol.* 147:60, 1991), a bispecific diabody, a triabody (Schoonooghe et al., *BMC Biotechnol.* 9:70, 2009), a tetrabody, scFv-Fc knobs-into-holes, a scFv-Fc-scFv, a (Fab'scFv)$_2$, a V-IgG, a IvG-V, a dual V domain IgG, a heavy chain immunoglobulin or a camelid (Holt et al., *Trends Biotechnol.* 21 (11): 484-490, 2003), an intrabody, a monoclonal antibody (e.g., a human or humanized monoclonal antibody), a heteroconjugate antibody (e.g., U.S. Pat. No. 4,676,980), a linear antibody (Zapata et al., *Protein Eng.* 8 (10:1057-1062, 1995), a trispecific antibody (Tutt et al., *J. Immunol.* 147:60, 1991), a Fabs-in-Tandem immunoglobulin (WO 15/103072), or a humanized camelid antibody.

In some embodiments, the antibody is a humanized antibody, a chimeric antibody, a multivalent antibody, or a fragment thereof. In some embodiments, the antibody is a monoclonal antibody. In some embodiments, the antibody is a humanized monoclonal antibody. See e.g., Hunter & Jones, *Nat. Immunol.* 16:448-457, 2015; and Heo et al., *Oncotarget* 7 (13): 15460-15473, 2016. Additional examples of antibodies and antigen-binding fragments thereof are described in U.S. Pat. Nos. 8,440,196; 7,842,144; 8,034,344; and 8,529,895; US 2013/0317203; US 2014/0322239; US 2015/0166666; US 2016/0152714; and US 2017/0002082, each of which is incorporated by reference in its entirety.

In some examples the chemokine/chemokine receptor inhibitor is bertilimumab (Immune Pharmaceuticals), an anti-eotaxin-1 monoclonal antibody that targets CCL11, and is currently in a Phase II clinical study for ulcerative colitis. Additional examples of CCL11 inhibitors are described in U.S. Patent Application Publication Nos. 2016/0289329, 2015/0086546, 2014/0342450, 2014/0178367, 2013/0344070, 2013/0071381, 2011/0274696, 2011/0038871, 2010/0074886, 2009/0297502, 2009/0191192, 2009/0169541, 2009/0142339, 2008/0268536, 2008/0241923, 2008/0241136, 2005/0260139, 2005/0048052, 2004/0265303, 2004/0132980, 2004/0126851, 2003/0165494, 2002/0150576, 2002/0150570, 2002/0051782, 2002/0051781, 2002/0037285, 2002/0028436, 2002/0015700, 2002/0012664, 2017/0131282, 2016/0368979, 2016/0208011, 2011/0268723, 2009/0123375, 2007/0190055, 2017/0049884, 2011/0165182, 2009/0226434, 2009/0110686, 2009/0047735, 2009/0028881, 2008/0107647, 2008/0107595, 2008/0015348, 2007/0274986, 2007/0231327, 2007/0036796, 2007/0031408, 2006/0229336, 2003/0228306, 2003/0166870, 2003/0003440, 2002/0019345, and 2001/0000241, each of which is incorporated by reference in its entirety (e.g., the description of CCL11 inhibitors).

In some embodiments, any of the antibodies or antigen-binding fragments described herein has a dissociation constant ($K_D$) of less than $1\times10^5$ M (e.g., less than $0.5\times10^{-5}$ M, less than $1\times10^{-6}$ M, less than $0.5\times10^{-6}$ M, less than $1\times10^{-7}$ M, less than $0.5\times10^{-7}$ M, less than $1\times10^{-8}$ M, less than $0.5\times10^{-8}$ M, less than $1\times10^{-9}$ M, less than $0.5\times10^{-9}$ M, less than $1\times10^{-10}$ M, less than $0.5\times10^{-10}$ M, less than $1\times10^{-11}$ M, less than $0.5\times10^{-11}$ M, or less than $1\times10^{-12}$ M), e.g., as measured in phosphate buffered saline using surface plasmon resonance (SPR).

In some embodiments, any of the antibodies or antigen-binding fragments described herein has a $K_D$ of about $1\times10^{-12}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, about $0.5\times10^{-9}$ M, about $1\times10^{-10}$ M, about $0.5\times10^{-10}$ M, about $1\times10^{-11}$ M, or about $0.5\times10^{-11}$ M (inclusive); about $0.5\times10^{-11}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, about $0.5\times10^{-9}$ M, about $1\times10^{-10}$ M, about $0.5\times10^{-10}$ M, or about $1\times10^{-11}$ M (inclusive); about $1\times10^{-11}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, about $0.5\times10^{-9}$ M, about $1\times10^{-10}$ M, or about $0.5\times10^{-10}$ M (inclusive); about $0.5\times10^{-10}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, about $0.5\times10^{-9}$ M, or about $1\times10^{-10}$ M (inclusive); about $1\times10^{-10}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, or about $0.5\times10^{-9}$ M (inclusive); about $0.5\times10^{-9}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, or about $1\times10^{-9}$ M (inclusive); about $1\times10^{-9}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, or about $0.5\times10^{-8}$ M (inclusive); about $0.5\times10^{-8}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, or about $1\times10^{-8}$ M (inclusive); about $1\times10^{-8}$ M to about $1\times10^{-5}$ M, about $0.5\times10^5$ M, about $1\times10^{-6}$ M, about $0.5\times10^{-6}$ M, about $1\times10^{-7}$ M, or about $0.5\times10^{-7}$ M (inclusive); about $0.5\times10^{-7}$ M to about $1\times10^{-5}$ M, about $0.5\times10^{-5}$ M, about $1\times10^{-6}$ M, about $0.5\times10^{-6}$ M, or about $1\times10^{-7}$ M (inclusive); about $1\times10^{-7}$ M to about $1\times10^{-5}$ M, about $0.5\times10^{-5}$ M, about $1\times10^{-6}$ M, or about $0.5\times10^{-6}$ M (inclusive); about $0.5\times10^{-6}$ M to about $1\times10^{-5}$ M, about $0.5\times10^{-5}$ M, or about $1\times10^{-6}$ M (inclusive); about $1\times10^{-6}$ M to about $1\times10^{-5}$ M or about $0.5\times10^{-5}$ M (inclusive); or about $0.5\times10^{-5}$ M to about $1\times10^{-5}$ M (inclusive), e.g., as measured in phosphate buffered saline using surface plasmon resonance (SPR).

In some embodiments, any of the antibodies or antigen-binding fragments described herein has a $K_{off}$ of about $1\times10^{-6}$ s$^{-1}$ to about $1\times10^{-3}$ s$^{-1}$, about $0.5\times10^{-3}$ s$^{-1}$, about $1\times10^{-4}$ s$^{-1}$, about $0.5\times10^{-4}$ s$^{-1}$, about $1\times10^{-5}$ s$^{-1}$, or about $0.5\times10^{-5}$ s$^{-1}$ (inclusive); about $0.5\times10^{-5}$ s$^{-1}$ to about $1\times10^{-3}$ s$^{-1}$, about $0.5\times10^{-3}$ s$^{-1}$, about $1\times10^{-4}$ s$^{-1}$, about $0.5\times10^{-4}$ s$^{-1}$, or about $1\times10^{-5}$ s$^{-1}$ (inclusive); about $1\times10^{-5}$ s$^{-1}$ to about $1\times10^{-3}$ s$^{-1}$, about $0.5\times10^{-3}$ s$^{-1}$, about $1\times10^{-4}$ s$^{-1}$, or about $0.5\times10^{-4}$ s$^{-1}$ (inclusive); about $0.5\times10^{-4}$ s$^{-1}$ to about $1\times10^{-3}$ s$^{-1}$, about $0.5\times10^{-3}$ s$^{-1}$, or about $1\times10^{-4}$ s$^{-1}$ (inclusive); about $1\times10^{-4}$ s$^{-1}$ to about $1\times10^{-3}$ s$^{-1}$, or about $0.5\times10^{-3}$ s$^{-1}$ (inclusive); or about $0.5\times10^{-5}$ s$^{-1}$ to about $1\times10^{-3}$ s$^{-1}$ (inclusive), e.g., as measured in phosphate buffered saline using surface plasmon resonance (SPR).

In some embodiments, any of the antibodies or antigen-binding fragments described herein has a $K_{on}$ of about $1\times10^2$ M$^{-1}$s$^{-1}$ to about $1\times10^6$ M$^{-1}$s$^{-1}$, about $0.5\times10^6$ M$^{-1}$s$^{-1}$, about $1\times10^5$ M$^{-1}$s$^{-1}$, about $0.5\times10^5$ M$^{-1}$s$^{-1}$, about $1\times10^4$ M$^{-1}$s$^{-1}$, about $0.5\times10^4$ M$^{-1}$s$^{-1}$, about $1\times10^3$ M$^{-1}$s$^{-1}$, or about $0.5\times10^3$ M$^{-1}$s$^{-1}$ (inclusive); about $0.5\times10^3$ M$^{-1}$s$^{-1}$ to about $1\times10^6$ M$^{-1}$s$^{-1}$, about $0.5\times10^6$ M$^{-1}$s$^{-1}$, about $1\times10^5$ M$^{-1}$s$^{-1}$, about $0.5\times10^5$ M$^{-1}$s$^{-1}$, about $1\times10^4$ M$^{-1}$s$^{-1}$, about $0.5\times10^4$ M$^{-1}$s$^{-1}$, or about $1\times10^3$ $M^{-1}s^{-1}$ (inclusive); about $1\times10^3$ $M^{-1}s^{-1}$ to about $1\times10^6$ $M^1s^{-1}$, about $0.5\times10^6$ $M^{-1}s^{-1}$, about $1\times10^5$ $M^{-1}s^{-1}$, about $0.5\times10^5$ $M^{-1}s^{-1}$, about $1\times10^4$ $M^{-1}s^{-1}$, or about $0.5\times10^4$ $M^{-1}s^{-1}$ (inclusive); about $0.5\times10^4$ $M^{-1}s^{-1}$ to about $1\times10^6$ $M^{-1}s^{-1}$, about $0.5\times10^6$ $M^{-1}s^{-1}$, about $1\times10^5$ $M^{-1}s^{-1}$, about $0.5\times10^5$ $M^{-1}s^{-1}$, or about $1\times10^4$ $M^{-1}s^{-1}$ (inclusive); about $1\times10^4$ $M^{-1}s^{-1}$ to about $1\times10^6$ $M^{-1}s^{-1}$, about $0.5\times10^6$ $M^{-1}s^{-1}$, about $1\times10^5$ $M^{-1}s^{-1}$, or about $0.5\times 10^5$ $M^{-1}s^{-1}$ (inclusive); about $0.5\times10^5$ $M^{-1}s^{-1}$ to about $1\times10^6$ $M^{-1}s^{-1}$, about $0.5\times10^6$ $M^{-1}s^{-1}$, or about $1\times10^5$ $M^{-1}s^{-1}$ (inclusive); about $1\times10^5$ $M^{-1}s^{-1}$ to about $1\times10^6$ $M^{-1}s^{-1}$, or about $0.5\times10^6$ $M^{-1}s^{-1}$ (inclusive); or about $0.5\times 10^6$ $M^{-1}s^{-1}$ to about $1\times10^6$ $M^{-1}s^{-1}$ (inclusive), e.g., as measured in phosphate buffered saline using surface plasmon resonance (SPR).

Additional examples of CCL11 inhibitors that are antibodies or antigen-binding antibody fragments are known in the art.

Small Molecules and Peptides

In some instances, the CXCL10 inhibitor is a small molecule. For example, the CXCL10 inhibitor can be ganodermycin (see, e.g., Jung et al., *J. Antiobiotics* 64:683-686, 2011). Additional exemplary small molecule CXCL10 inhibitors are described in: U.S. Patent Application Publication No. 2005/0075333; U.S. Patent Application Publication No. 2004/0242498; U.S. Patent Application Publication No. 2003/0069234; U.S. Patent Application Publication No. 2003/0055054; U.S. Patent Application Publication No. 2002/0169159; WO 97/24325; WO 98/38167; WO 97/44329; WO 98/04554; WO 98/27815; WO 98/25604; WO 98/25605; WO 98/25617; WO 98/31364; Hesselgesser et al., *J. Biol. Chem.* 273 (25): 15687-15692 (1998); and Howard et al., *J. Med. Chem.* 41 (13): 2184-2193 (1998).

In some examples, the CXCL10 inhibitor is a peptide antagonist of a CXCR3 receptor (e.g., as described in U.S. Patent Application Publication No. 2007/0116669, 2006/0204498, and WO 98/09642). In some examples, the CXCL10 inhibitor is a chemokine mutant or analogue, e.g., those described in U.S. Pat. No. 5,739,103, WO 96/38559, and WO 98/06751. Additional examples of CXCL10 inhibitors that are small molecules or peptides are known in the art.

CCR2 Inhibitors

As used herein "CCR2," "CC chemokine receptor 2," or "MCP-1" can be used interchangeably. CCL2, CCL8, and CCL16 each individually bind to CCR2.

The term "CCR2 inhibitor" refers to an agent which decreases the ability of CCR2 to bind to one or more (e.g., two, or three) of CCL2, CCL8, and CCL16.

In some embodiments, the CCR2 inhibitor can decrease the binding between CCL2 and CCR2 by blocking the ability of CCL2 to interact with CCR2. In some embodiments, the CCR2 inhibitor can decrease the binding between CCL8 and CCR2 by blocking the ability of CCL8 to interact with CCR2. In some embodiments, the CCR2 inhibitor can decrease the binding between CCL16 and CCR2 by blocking the ability of CCL16 to interact with CCR2.

In some embodiments, the CCR2 inhibitor decreases the ability of CCR2 to bind to each of CCL2 and CCL8. In some embodiments, the CCR2 inhibitor decreases the ability of CCR2 to bind to each of CCL2 and CCL16. In some embodiments, the CCR2 inhibitor decreases the ability of CCR2 to bind to each of CCL8 and CCL16. In some embodiments, the CCR5 inhibitor decreases the ability of CCR2 to bind to each of CCL2, CCL8, and CCL16.

In some instances, the CCR2 inhibitor is a small molecule. In some instances, the CCR2 inhibitor is an antibody or an antigen-binding antibody fragment. In some instances, the CCR2 inhibitor is a peptide.

Exemplary sequences for human CCR2, human CCL2, human CCL8, and human CCL16 are shown in SEQ ID NOs: 192-195, respectively.

```
Human CCR2 Isoform A
                            (SEQ ID NO: 192)
mlstsrsrfi rntnesgeev ttffdydyga pchkfdvkqi gaqllpplys lvfifgfvgn mlvvlilinc kklkcltdiy llnlaisdll flitlplwah saanewvfgn amcklftgly higyfggiff iilltidryl aivhavfalk artvtfgvvt svitwlvavf asvpgiiftk cqkedsvyvc gpyfprgwnn fhtimrnilg lvlpllimvi cysgilktll rcrnekkrhr avrviftimi vyflfwtpyn ivillntfqe ffglsncest sqldqatqvt etlgmthcci npiiyafvge kfrslfhial gcriaplqkp vcggpgvrpg knvkvttqgl ldgrgkgksi grapeaslqd kega Human CCL2 Isoform B
                            (SEQ ID NO: 193)
mlstsrsrfi rntnesgeev ttffdydyga pchkfdvkqi gaqllpplys lvfifgfvgn mlvvlilinc kklkcltdiy llnlaisdll flitlplwah saanewvfgn amcklftgly higyfggiff iilltidryl aivhavfalk artvtfgvvt svitwlvavf asvpgiiftk cqkedsvyvc gpyfprgwnn fhtimrnilg lvlpllimvi cysgilktll rcrnekkrhr avrviftimi vyflfwtpyn ivillntfqe ffglsncest sqldqatqvt etlgmthcci npiiyafvge kfrrylsvff rkhitkrfck qcpvfyretv dgvtstntps tgeqevsagl Human CCL8
                            (SEQ ID NO: 194)
qpdsvsi pitccfnvin rkipiqrles ytritniqcp keaviflakr gkevcadpke rwvrdsmkhl dqifqnlkp Human CCL16
                            (SEQ ID NO: 195)
qpkvpew vntpstcclk yyekvlprd vvgyrkalnc hlpaiifvtk mrevctnpn ddwvqeyikd pnlpllptrn lstvkiitak ngqpqllnsq
```

Antibodies

In some embodiments, the CCR2 inhibitor is an antibody or an antigen-binding fragment thereof (e.g., a Fab or a scFv). In some embodiments, an antibody or antigen-binding fragment described herein binds specifically to CCR2. In some embodiments, an antibody or antigen-binding fragment described herein binds specifically to CCL2. In some embodiments, an antibody or antigen-binding fragment described herein binds specifically to CCL8. In some embodiments, an antibody or antigen-binding fragment described herein binds specifically to CCL16. In some embodiments, an antibody or antigen-binding fragment described herein binds specifically to CCR2 and one or more of (e.g., one, two, or three) of CCL2, CCL8, and CCL16.

In some embodiments, the antibody can be a humanized antibody, a chimeric antibody, a multivalent antibody, or a fragment thereof. In some embodiments, an antibody can be a scFv-Fc (Sokolowska-Wedzina et al., *Mol. Cancer Res.* 15 (8): 1040-1050, 2017), a VHH domain (Li et al., *Immunol. Lett.* 188:89-95, 2017), a VNAR domain (Hasler et al., *Mol. Immunol.* 75:28-37, 2016), a (scFv) 2, a minibody (Kim et al., *PLOS One* 10 (1): e113442, 2014), or a BiTE. In some embodiments, an antibody can be a DVD-Ig (Wu et al., *Nat. Biotechnol.* 25 (11): 1290-1297, 2007; WO 08/024188; WO 07/024715), and a dual-affinity re-targeting antibody (DART) (Tsai et al., *Mol. Ther. Oncolytics* 3:15024, 2016), a triomab (Chelius et al., MAbs 2 (3): 309-319, 2010), kih IgG with a common LC (Kontermann et al., *Drug Discovery Today* 20 (7): 838-847, 2015), a crossmab (Regula et al., *EMBO Mol. Med.* 9 (7): 985, 2017), an ortho-Fab IgG (Kontermann et al., *Drug Discovery Today* 20 (7): 838-847, 2015), a 2-in-1-IgG (Kontermann et al., *Drug Discovery Today* 20 (7): 838-847, 2015), IgG-scFv (Cheal et al., *Mol. Cancer Ther.* 13 (7): 1803-1812, 2014), scFv2-Fc (Natsume et al., *J. Biochem.* 140 (3): 359-368, 2006), a bi-nanobody (Kontermann et al., *Drug Discovery Today* 20 (7): 838-847, 2015), tanden antibody (Kontermann et al., *Drug Discovery Today* 20 (7): 838-847, 2015), a DART-Fc (Kontermann et al., *Drug Discovery Today* 20 (7): 838-847, 2015), a scFv-HSA-scFv (Kontermann et al., *Drug Discovery Today* 20 (7): 838-847, 2015), DNL-Fab3 (Kontermann et al., *Drug Discovery Today* 20 (7): 838-847, 2015), DAF (two-in-one or four-in-one), DutaMab, DT-IgG, knobs-in-holes common LC, knobs-in-holes assembly, charge pair antibody, Fab-arm exchange antibody, SEEDbody, Triomab, LUZ-Y, Fcab, kλ-body, orthogonal Fab, DVD-IgG, IgG (H)-scFv, scFv-(H) IgG, IgG (L)-scFv, scFv-(L)-IgG, IgG (L,H)-Fc, IgG (H)-V, V (H)-IgG, IgG (L)-V, V (L)-IgG, KIH IgG-scFab, 2scFv-IgG, IgG-2scFv, scFv4-Ig, Zybody, DVI-IgG, nanobody (e.g., antibodies derived from *Camelus bactriamus, Calelus dromaderius*, or *Lama paccos*) (U.S. Pat. No. 5,759,808; Stijlemans et al., *J. Biol. Chem.* 279:1256-1261, 2004; Dumoulin et al., *Nature* 424:783-788, 2003; and Pleschberger et al., *Bioconjugate Chem.* 14:440-448, 2003), nanobody-HSA, a diabody (e.g., Poljak, *Structure* 2 (12): 1121-1123, 1994; and Hudson et al., *J. Immunol. Methods* 23 (1-2): 177-189, 1999), a TandAb (Reusch et al., mAbs 6 (3): 727-738, 2014), scDiabody (Cuesta et al., *Trends in Biotechnol.* 28 (7): 355-362, 2010), scDiabody-CH3 (Sanz et al., *Trends in Immunol.* 25 (2): 85-91, 2004), Diabody-CH3, Triple Body, miniantibody, minibody, TriBi minibody, scFv-CH3 KIH, Fab-scFv, scFv-CH-CL-scFv, F(ab')2-scFV2, scFv-KIH, Fab-scFv-Fc, tetravalent HCAb, scDiabody-Fc, diabody-Fc, tandem scFv-Fc, intrabody (Huston et al., *Human Antibodies* 10 (3-4): 127-142, 2001; Wheeler et al., *Mol. Ther.* 8 (3): 355-366, 2003; and Stocks, *Drug Discov. Today* 9 (22): 960-966, 2004), dock and lock bispecific antibody, ImmTAC, HSAbody, scDiabody-HSA, tandem scFv, IgG-IgG, Cov-X-Body, and scFv1-PEG-scFv2.

Non-limiting examples of an antigen-binding fragment of an antibody include an Fv fragment, a Fab fragment, a F(ab')$_2$ fragment, and a Fab' fragment. Additional examples of an antigen-binding fragment of an antibody is an antigen-binding fragment of an IgG (e.g., an antigen-binding fragment of IgG1, IgG2, IgG3, or IgG4) (e.g., an antigen-binding fragment of a human or humanized IgG, e.g., human or humanized IgG1, IgG2, IgG3, or IgG4); an antigen-binding fragment of an IgA (e.g., an antigen-binding fragment of IgA1 or IgA2) (e.g., an antigen-binding fragment of a human or humanized IgA, e.g., a human or humanized IgA1 or IgA2); an antigen-binding fragment of an IgD (e.g., an antigen-binding fragment of a human or humanized IgD); an antigen-binding fragment of an IgE (e.g., an antigen-binding fragment of a human or humanized IgE); or an antigen-binding fragment of an IgM (e.g., an antigen-binding fragment of a human or humanized IgM).

In some embodiments, an antibody can be an IgNAR, a bispecific antibody (Milstein and Cuello, *Nature* 305:537-539, 1983; Suresh et al., *Methods in Enzymology* 121:210, 1986; WO 96/27011; Brennan et al., *Science* 229:81, 1985; Shalaby et al., *J. Exp. Med.* 175:217-225, 1992; Kolstelny et al., *J. Immunol.* 148 (5): 1547-1553, 1992; Hollinger et al., *Proc. Natl. Acad. Sci. U.S.A.* 90:6444-6448, 1993; Gruber et al., *J. Immunol.* 152:5368, 1994; and Tutt et al., *J. Immunol.* 147:60, 1991), a bispecific diabody, a triabody (Schoonooghe et al., *BMC Biotechnol.* 9:70, 2009), a tetrabody, scFv-Fc knobs-into-holes, a scFv-Fc-scFv, a (Fab'scFv)$_2$, a V-IgG, a IvG-V, a dual V domain IgG, a heavy chain immunoglobulin or a camelid (Holt et al., *Trends Biotechnol.* 21 (11): 484-490, 2003), an intrabody, a monoclonal antibody (e.g., a human or humanized monoclonal antibody), a heteroconjugate antibody (e.g., U.S. Pat. No. 4,676,980), a linear antibody (Zapata et al., *Protein Eng.* 8 (10:1057-1062, 1995), a trispecific antibody (Tutt et al., *J. Immunol.* 147:60, 1991), a Fabs-in-Tandem immunoglobulin (WO 15/103072), or a humanized camelid antibody.

In some embodiments, the CCR2 inhibitor is a monoclonal antibody. For example, the CCR2 inhibitor can be MLN1202 (Millennium Pharmaceuticals), C775, STI-B0201, STI-B0211, STI-B0221, STI-B0232, carlumab (CNTO 888; Centocor, Inc.), or STI-B0234, or an antigen-binding fragment thereof. Sec also, e.g., Vergunst et al., *Arthritis Rheum.* 58 (7): 1931-1939, 2008. Additional examples of CCR2 inhibitors that are antibodies or antigen-binding antibody fragments are described in, e.g., U.S. Patent Application Publication Nos. 2015/0086546, 2016/0272702, 2016/0289329, 2016/0083482, 2015/0361167; 2014/0342450, 2014/0178367, 2013/0344070, 2013/0071381, 2011/0274696, 2011/0059107, 2011/0038871, 2009/0068109, 2009/0297502, 2009/0142339, 2008/0268536, 2008/0241923, 2008/0241136, 2007/0128112, 2007/0116708, 2007/0111259, 2006/0246069, 2006/0039913, 2005/0232923, 2005/0260139, 2005/0058639, 2004/0265303, 2004/0132980, 2004/0126851, 2004/0219644, 2004/0047860, 2003/0165494, 2003/0211105, 2002/0150576, 2002/0051782, 2002/0042370, and 2002/0015700; and U.S. Pat. Nos. 6,312,689, 6,084,075, 6,406,694, 6,406,865, 6,696,550, 6,727,349, 7,442,775, 7,858,318, 5,859,205, 5,693,762, and 6,075,181, each of which is incorporated by reference (e.g., the description of the CCR2 inhibitors). Additional examples of CCR2 inhibitors are described in, e.g., WO 00/05265. Additional examples of CCR2 inhibitors that are antibodies or antigen-binding antibodies fragments are described in, e.g., Loberg et al., *Cancer Res.* 67 (19): 9417, 2007.

In some embodiments, any of the antibodies or antigen-binding fragments described herein has a dissociation constant ($K_D$) of less than $1\times10^{-5}$ M (e.g., less than $0.5\times10^{-5}$ M, less than $1\times10^{-6}$ M, less than $0.5\times10^{-6}$ M, less than $1\times10^{-7}$ M, less than $0.5\times10^{-7}$ M, less than $1\times10^{-8}$ M, less than $0.5\times10^{-8}$ M, less than $1\times10^{-9}$ M, less than $0.5\times10^{-9}$ M, less than $1\times10^{-10}$ M, less than $0.5\times10^{-10}$ M, less than $1\times10^{-11}$ M, less than $0.5\times10^{-11}$ M, or less than $1\times10^{-12}$ M), e.g., as measured in phosphate buffered saline using surface plasmon resonance (SPR).

In some embodiments, any of the antibodies or antigen-binding fragments described herein has a $K_D$ of about $1\times10^{-12}$ M to about $1\times10^5$ M, about $0.5\times10^{-5}$ M, about $1\times10^{-6}$ M, about $0.5\times10^{-6}$ M, about $1\times10^{-7}$ M, about $0.5\times$ $10^{-7}$ M, about $1\times10^{-8}$ M, about $0.5\times10^{-8}$ M, about $1\times10^{-9}$ M, about $0.5\times10^{-9}$ M, about $1\times10^{-10}$ M, about $0.5\times10^{-10}$ M, about $1\times10^{-11}$ M, or about $0.5\times10^{-11}$ M (inclusive); about $0.5\times10^{-11}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, about $0.5\times10^{-9}$ M, about $1\times10^{-10}$ M, about $0.5\times10^{-10}$ M, or about $1\times10^{-11}$ M (inclusive); about $1\times10^{-11}$ M to about $1\times10^{5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, about $0.5\times10^{-9}$ M, about $1\times10^{-10}$ M, or about $0.5\times10^{-10}$ M (inclusive); about $0.5\times10^{-10}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, about $0.5\times10^{-9}$ M, or about $1\times10^{-10}$ M (inclusive); about $1\times10^{-10}$ M to about $1\times10^{-5}$ M, about $0.5\times10^{5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, or about $0.5\times10^{-9}$ M (inclusive); about $0.5\times10^{-9}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, or about $1\times10^{-9}$ M (inclusive); about $1\times10^{-9}$ M to about $1\times10^{5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, or about $0.5\times10^{-8}$ M (inclusive); about $0.5\times10^{-8}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, or about $1\times10^{-8}$ M (inclusive); about $1\times10^{-8}$ M to about $1\times10^{-5}$ M, about $0.5\times10^{-5}$ M, about $1\times10^{-6}$ M, about $0.5\times10^{-6}$ M, about $1\times10^{-7}$ M, or about $0.5\times10^{-7}$ M (inclusive); about $0.5\times10^{-7}$ M to about $1\times10^{-5}$ M, about $0.5\times10^{-5}$ M, about $1\times10^{-6}$ M, about $0.5\times10^{-6}$ M, or about $1\times10^{-7}$ M (inclusive); about $1\times10^{-7}$ M to about $1\times10^{5}$ M, about $0.5\times10^{-5}$ M, about $1\times10^{-6}$ M, or about $0.5\times10^{-6}$ M (inclusive); about $0.5\times10^{-6}$ M to about $1\times10^{-5}$ M, about $0.5\times10^{-5}$ M, or about $1\times10^{-6}$ M (inclusive); about $1\times10^{-6}$ M to about $1\times10^{-5}$ M or about $0.5\times10^{-5}$ M (inclusive); or about $0.5\times10^{-5}$ M to about $1\times10^{5}$ M (inclusive), e.g., as measured in phosphate buffered saline using surface plasmon resonance (SPR).

In some embodiments, any of the antibodies or antigen-binding fragments described herein has a $K_{off}$ of about $1\times10^{-6}$ s$^{-1}$ to about $1\times10^{-3}$ s$^{-1}$, about $0.5\times10^{-3}$ s$^{-1}$, about $1\times10^{-4}$ s$^{-1}$, about $0.5\times10^{-4}$ s$^{-1}$, about $1\times10^{-5}$ s$^{-1}$, or about $0.5\times10^{-5}$ s$^{-1}$ (inclusive); about $0.5\times10^{-5}$ s$^{-1}$ to about $1\times10^{-3}$ s$^{-1}$, about $0.5\times10^{-3}$ s$^{-1}$, about $1\times10^{-4}$ s$^{-1}$, about $0.5\times10^{-4}$ s$^{-1}$, or about $1\times10^{-5}$ s$^{-1}$ (inclusive); about $1\times10^{-5}$ s$^{-1}$ to about $1\times10^{-3}$ s$^{-1}$, about $0.5\times10^{-3}$ s$^{-1}$, about $1\times10^{-4}$ s$^{-1}$, or about $0.5\times10^{-4}$ s$^{-1}$ (inclusive); about $0.5\times10^{-4}$ s$^{-1}$ to about $1\times10^{-3}$ s$^{-1}$, about $0.5\times10^{-3}$ s$^{-1}$, or about $1\times10^{-4}$ s$^{-1}$ (inclusive); about $1\times10^{-4}$ s$^{-1}$ to about $1\times10^{-3}$ s$^{-1}$, or about $0.5\times10^{-3}$ s$^{-1}$ (inclusive); or about $0.5\times10^{-5}$ s$^{-1}$ to about $1\times10^{-3}$ s$^{-1}$ (inclusive), e.g., as measured in phosphate buffered saline using surface plasmon resonance (SPR).

In some embodiments, any of the antibodies or antigen-binding fragments described herein has a $K_{on}$ of about $1\times10^{2}$ M$^{-1}$s$^{-1}$ to about $1\times10^{6}$ M$^{-1}$s$^{-1}$, about $0.5\times10^{6}$ M$^{-1}$s$^{-1}$, about $1\times10^{5}$ M$^{-1}$s$^{-1}$, about $0.5\times10^{5}$ M$^{-1}$s$^{-1}$, about $1\times10^{4}$ M$^{-1}$s$^{-1}$, about $0.5\times10^{4}$ M$^{1}$s$^{-1}$, about $1\times10^{3}$ M$^{-1}$s$^{-1}$, or about $0.5\times10^{3}$ M$^{-1}$s$^{-1}$ (inclusive); about $0.5\times10^{3}$ M$^{-1}$s$^{-1}$ to about $1\times10^{6}$ M$^{-1}$s$^{-1}$, about $0.5\times10^{6}$ M$^{-1}$s$^{-1}$, about $1\times10^{5}$ M$^{-1}$s$^{-1}$, about $0.5\times10^{5}$ M$^{-1}$s$^{-1}$, about $1\times10^{4}$ M$^{-1}$s$^{-1}$, about $0.5\times10^{4}$ M$^{-1}$s$^{-1}$, or about $1\times10^{3}$ M$^{-1}$s$^{-1}$ (inclusive); about $1\times10^{3}$ M$^{-1}$s$^{-1}$ to about $1\times10^{6}$ M$^{-1}$s$^{-1}$, about $0.5\times10^{6}$ M$^{-1}$s$^{-1}$, about $1\times10^{5}$ M$^{-1}$s$^{-1}$, about $0.5\times10^{5}$ M$^{-1}$s$^{-1}$, about $1\times10^{4}$ M$^{1}$s$^{-1}$, or about $0.5\times10^{4}$ M$^{-1}$s$^{-1}$ (inclusive); about $0.5\times10^{4}$ M$^{-1}$s$^{-1}$ to about $1\times10^{6}$ M$^{-1}$s$^{-1}$, about $0.5\times10^{6}$ M$^{-1}$s$^{-1}$, about $1\times10^{5}$ M$^{-1}$s$^{-1}$, about $0.5\times10^{5}$ M$^{-1}$s$^{-1}$, or about $1\times10^{4}$ M$^{-1}$s$^{-1}$ (inclusive); about $1\times10^{4}$ M$^{-1}$s$^{-1}$ to about $1\times10^{6}$ M$^{-1}$s$^{-1}$, about $0.5\times10^{6}$ M$^{-1}$s$^{-1}$, about $1\times10^{5}$ M$^{-1}$s$^{-1}$, or about $0.5\times10^{5}$ M$^{-1}$ s$^{-1}$ (inclusive); about $0.5\times10^{5}$ M$^{-1}$s$^{-1}$ to about $1\times10^{6}$ M$^{-1}$s$^{-1}$, about $0.5\times10^{6}$ M$^{-1}$s$^{-1}$, or about $1\times10^{5}$ M$^{-1}$s$^{-1}$ (inclusive); about $1\times10^{5}$ M$^{-1}$s$^{-1}$ to about $1\times10^{6}$ M$^{-1}$s$^{-1}$, or about $0.5\times 10^{6}$ M$^{-1}$s$^{-1}$ 1 (inclusive); or about $0.5\times10^{6}$ M$^{-1}$s$^{-1}$ to about $1\times10^{6}$ M$^{-1}$s$^{-1}$ (inclusive), e.g., as measured in phosphate buffered saline using surface plasmon resonance (SPR).

Additional examples of CCR2 inhibitors that are antibodies or antigen-binding antibody fragments are known in the art.

Small Molecules and Peptides

In some examples, the CCR2 inhibitor is a small molecule. For example, the CCR2 inhibitor can be elubrixin, PF-04634817, BMS-741672, or CCX872. See, e.g., U.S. Pat. No. 9,434,766; U.S. Patent Application Publication No. 20070021466; Deerberg et al., *Org. Process Rev. Dev.* 20 (11): 1949-1966, 2016; and Morganti et al., *J. Neurosci.* 35 (2): 748-760, 2015.

Additional non-limiting examples of CCR2 inhibitors that are small molecules include, e.g., the phenylamino substituted quaternary salt compounds described in U.S. Patent Application Publication No. 2009/0112004; the biaryl derivatives described in U.S. Patent Application Publication No. 2009/0048238; the pyrazol derivatives described in U.S. Patent Application Publication No. 2009/0029963; the heterocyclic compounds described in U.S. Patent Application Publication No. 2009/0023713; the imidazole derivatives described in U.S. Patent Application Publication No. 2009/0012063; the aminopyrrolidines described in U.S. Patent Application Publication No. 2008/0176883; the heterocyclic cyclopentyl tetrahydroisoquinolones and tetrahydropyridopyridines described in U.S. Patent Application Publication No. 2008/0081803; the heteroaryl sulfonamides described in U.S. Patent Application Publication No. 2010/0056509; the triazolyl pyridyl benzenesulfonamides described in U.S. Patent Application Publication No. 2010/0152186; the bicyclic and bridged nitrogen heterocycles described in U.S. Patent Application Publication No. 2006/0074121; the fused heteroaryl pyridyl and phenyl benzenesulfonamides described in WO 09/009740; and the 3-aminopyrrolidene derivatives described in WO 04/050024.

Additional non-limiting examples of CCR2 inhibitors include: N-((1R,3S)-3-isopropyl-3-{[3-(trifluoromethyl)-7, 8-dihydro-1,6-naph-thyri-din-6 (5H)-yl] carbonyl}cyclopentyl)-N-[(3S,4S)-3-methoxytetrahydro-2H-pyran-4-yl]amine; 3[(3S,4R)-1-((1R,3S)-3-isopropyl-2-oxo-3-{[6-(trifluoromethyl)-2H-1,3-ben-z-oxazin-3 (4H)-yl]methyl}cyclopentyl)-3-methylpiperidin-4-yl]benzoic acid; (3S,48)-N-((1R,3S)-3-isopropyl-3-{[7-(trifluoromethyl)-3,4-dihydroisoquin-olin-2 (1B)-yl] carbonyl}cyclopentyl)-3-methyltetrahydro-2H-p-yran-4-aminium; 3-[(3S,4R or 3R,4S)-1-((1R,3S)-3-Isopropyl-3-{ [6-(trifluoromethyl)-2H-1,3-benzoxazin-3-(4H)-yl] carbonyl}cyclopentyl)-3-methylpiperidin-4-yl]benzoic acid; INCB3284; Eotaxin-3; PF-04178903 (Pfizer), and pharmaceutically acceptable salts thereof.

Additional non-limiting examples of CCR2 inhibitors include: bindarit (2-((1-benzyl-1H-indazol-3-yl) methoxy)-2-methylpropionic acid); AZD2423 (AstraZeneca); the indole describes described in U.S. Pat. Nos. 7,297,696, 6,962,926, 6,737,435, and 6,569,888; the bicyclic pyrrole derivatives described in U.S. Pat. Nos. 6,441,004 and 6,479, 527; the CCR2 inhibitors described in U.S. Patent Application Publications Nos. 2005/0054668, 2005/0026975, 2004/

0198719, and 2004/0047860, and Howard et al., *Expert Opin. Ther. Patents* 11 (7): 1147-1151 (2001).

Additional non-limiting examples of CCR2 inhibitors that are small molecules are described in, e.g., WO 97/24325; WO 98/38167; WO 97/44329; WO 98/04554; WO 98/27815; WO 98/25604; WO 98/25605; WO 98/25617; WO 98/31364; Hesselgesser et al., *J. Biol. Chem.* 273 (25): 15687-15692, 1998; and Howard et al., *J. Med. Chem.* 41 (13): 2184-2193, 1998.

In some embodiments, the CCR2 inhibitor is a small nucleic acid, e.g., NOX-E36 (a 40-nucleotide L-RNA oligonucleotide that is linked to a 40-kDa PEG; NOXXON Pharma AG).

In some embodiments, the CCR2 inhibitor is a peptide, e.g., a dominant negative peptide described in, e.g., Kiyota et al., *Mol. Ther.* 17 (5): 803-809, 2009, and U.S. Patent Application Publication No. 20070004906, or an antagonistic peptide, e.g., the antagonistic peptides described in WO 05/037305 and Jiang-Hong Gong, et al., *J. Exp. Med.* 186:131, 1997. Additional examples of CCR2 inhibitors that are peptides are described in, e.g., U.S. Pat. No. 5,739,103; WO 96/38559; WO 98/06751; and WO 98/09642. In some embodiments, a CCR2 inhibitor is a CCR2 mutein (e.g., U.S. Patent Application Publication No. 2004/0185450).

Additional examples of CCR2 inhibitors that are small molecules and peptides are known in the art.

CCR9 Inhibitors

As used herein "CCR9" or "CC chemokine receptor 9" can be used interchangeably. CCR9 specifically binds to CCL25.

The term "CCR9 inhibitor" refers to an agent which decreases the ability of CCR9 to bind to CCL25.

In some embodiments, the CCR9 inhibitor can decrease the binding between CCL25 and CCR9 by blocking the ability of CCL25 to interact with CCR9. In some instances, the CCR9 inhibitor is a small molecule. In some instances, the CCR9 inhibitor is an antibody or an antigen-binding antibody fragment.

Exemplary sequences for human CCR9 and CCL25 are shown in SEQ ID NOs: 196-199.

```
Human CCR9 Isoform A
                                          (SEQ ID NO: 196)
mtptdftspi pnmaddygse stssmedyvn fnftdfycek nnvrqfashf lpplywlvfi vgalgnslvi lvywyctrvk tmtdmfllnl aiadllflvt lpfwaiaaad qwkfqtfmck vvnsmykmnf yscvllimci svdryiaiaq amrahtwrek rllyskmvcf tiwvlaaalc ipeilysqik eesgiaictm vypsdestkl ksavltlkvi lgfflpfvvm accytiiiht liqakksskh kalkvtitvl tvfvlsqfpy ncillvqtid ayamfisnca vstnidicfq vtqtiaffhs clnpvlyvfv gerfrrdlvk tlknlgcisq aqwvsftrre gslklssmll ettsgalsl Human CCR9 Isoform B
                                          (SEQ ID NO: 197)
maddygsest ssmedyvnfn ftdfyceknn vrqfashflp plywlvfivg algnslvilv ywyctrvktm tdmfllnlai adllflvtlp fwaiaadqw kfqtfmckvv nsmykmnfys
```

```
cvllimcisv dryiaiaqam rahtwrekrl lyskmvcfti wvlaaalcip eilysqikee sgiaictmvy psdestklks avltlkvilg fflpfvvmac cytiiihtli qakksskhka lkvtitvltv fvlsqfpync illvqtiday amfisncays tnidicfqvt qtiaffhscl npvlyvfvge rfrrdlyktl knlgcisqaq wvsftrregs lklssmllet tsgalsl Human CCL25 Isoform 1
                                          (SEQ ID NO: 198)
qgvfedc clayhypigw avlrrawtyr iqevsgscnl paaifylpkr hrkvcgnpks revqramkll darnkvfakl hhntqtfqag phavkklssg nsklssskfs npissskrnv sllisansgl Human CCL25 Isoform 2
                                          (SEQ ID NO: 199)
qgvfedc clayhypigw avlrrawtyr iqevsgscnl paaifylpkr hrkvcgnpks revqramkll darnkvfakl hhntqtfqgp havkklssgn sklssskfsn pissskrnvs llisansgl
```

Antibodies

In some embodiments, the CCR9 inhibitor is an antibody or an antigen-binding fragment thereof (e.g., a Fab or a scFv). In some embodiments, an antibody or antigen-binding fragment described herein binds specifically to CCR9. In some embodiments, an antibody or antigen-binding fragment described herein binds specifically to CCL25. In some embodiments, an antibody or antigen-binding fragment described herein binds specifically to both CCR9 and CCL25.

In some embodiments, the antibody can be a humanized antibody, a chimeric antibody, a multivalent antibody, or a fragment thereof. In some embodiments, an antibody can be a scFv-Fc (Sokolowska-Wedzina et al., *Mol. Cancer Res.* 15 (8): 1040-1050, 2017), a VHH domain (Li et al., *Immunol. Lett.* 188:89-95, 2017), a VNAR domain (Hasler et al., *Mol. Immunol.* 75:28-37, 2016), a (scFv) 2, a minibody (Kim et al., *PLOS One* 10 (1): e113442, 2014), or a BiTE. In some embodiments, an antibody can be a DVD-Ig (Wu et al., *Nat. Biotechnol.* 25 (11): 1290-1297, 2007; WO 08/024188; and WO 07/024715), and a dual-affinity re-targeting antibody (DART) (Tsai et al., *Mol. Ther. Oncolytics* 3:15024, 2016), a triomab (Chelius et al., *MAbs* 2 (3): 309-319, 2010), kih IgG with a common LC (Kontermann et al., *Drug Discovery Today* 20 (7): 838-847, 2015), a crossmab (Regula et al., *EMBO Mol. Med.* 9 (7): 985, 2017), an ortho-Fab IgG (Kontermann et al., *Drug Discovery Today* 20 (7): 838-847, 2015), a 2-in-1-IgG (Kontermann et al., *Drug Discovery Today* 20 (7): 838-847, 2015), IgG-scFv (Cheal et al., *Mol. Cancer Ther.* 13 (7): 1803-1812, 2014), scFv2-Fc (Natsume et al., *J. Biochem.* 140 (3): 359-368, 2006), a bi-nanobody (Kontermann et al., *Drug Discovery Today* 20 (7): 838-847, 2015), tanden antibody (Kontermann et al., *Drug Discovery Today* 20 (7): 838-847, 2015), a DART-Fc (Kontermann et al., *Drug Discovery Today* 20 (7): 838-847, 2015), a scFv-HSA-scFv (Kontermann et al., *Drug Discovery Today* 20 (7): 838-847, 2015), DNL-Fab3 (Kontermann et al., *Drug Discovery Today* 20 (7): 838-847, 2015), DAF (two-in-one or four-in-one), DutaMab, DT-IgG, knobs-in-holes common LC, knobs-in-holes assembly, charge pair antibody, Fab-arm exchange antibody, SEEDbody, Triomab, LUZ-Y, Fcab, kA-body, orthogonal Fab, DVD-IgG, IgG (H)-scFv, scFv-(H) IgG, IgG (L)-scFv, scFv-(L)-IgG, IgG (L,H)-Fc, IgG (H)-V, V (H)-IgG, IgG (L)-V, V (L)-IgG, KIH IgG-scFab, 2scFv-IgG, IgG-2scFv, scFv4-Ig, Zybody, DVI-IgG, nanobody (e.g., antibodies derived from *Camelus bactriamus, Calelus dromaderius,* or *Lama paccos*) (U.S. Pat. No. 5,759,808; Stijlemans et al., *J. Biol. Chem.* 279:1256-1261, 2004; Dumoulin et al., *Nature* 424:783-788, 2003; and Pleschberger et al., *Bioconjugate Chem.* 14:440-448, 2003), nanobody-HSA, a diabody (e.g., Poljak, Structure 2 (12): 1121-1123, 1994; and Hudson et al., *J. Immunol. Methods* 23 (1-2): 177-189, 1999), a TandAb (Reusch et al., mAbs 6 (3): 727-738, 2014), scDiabody (Cuesta et al., *Trends in Biotechnol.* 28 (7): 355-362, 2010), scDiabody-CH3 (Sanz et al., *Trends in Immunol.* 25 (2): 85-91, 2004), Diabody-CH3, Triple Body, miniantibody, minibody, TriBi minibody, scFv-CH3 KIH, Fab-scFv, scFv-CH-CL-scFv, F(ab')2-scFV2, scFv-KIH, Fab-scFv-Fc, tetravalent HCAb, scDiabody-Fc, diabody-Fc, tandem scFv-Fc, intrabody (Huston et al., *Human Antibodies* 10 (3-4): 127-142, 2001; Wheeler et al., *Mol. Ther.* 8 (3): 355-366, 2003; and Stocks, *Drug Discov. Today* 9 (22): 960-966, 2004), dock and lock bispecific antibody, ImmTAC, HSAbody, scDiabody-HSA, tandem scFv, IgG-IgG, Cov-X-Body, and scFv1-PEG-scFv2.

Non-limiting examples of an antigen-binding fragment of an antibody include an Fv fragment, a Fab fragment, a F(ab')2 fragment, and a Fab' fragment. Additional examples of an antigen-binding fragment of an antibody is an antigen-binding fragment of an IgG (e.g., an antigen-binding fragment of IgG1, IgG2, IgG3, or IgG4) (e.g., an antigen-binding fragment of a human or humanized IgG, e.g., human or humanized IgG1, IgG2, IgG3, or IgG4); an antigen-binding fragment of an IgA (e.g., an antigen-binding fragment of IgA1 or IgA2) (e.g., an antigen-binding fragment of a human or humanized IgA, e.g., a human or humanized IgA1 or IgA2); an antigen-binding fragment of an IgD (e.g., an antigen-binding fragment of a human or humanized IgD); an antigen-binding fragment of an IgE (e.g., an antigen-binding fragment of a human or humanized IgE); or an antigen-binding fragment of an IgM (e.g., an antigen-binding fragment of a human or humanized IgM).

In some embodiments, an antibody can be an IgNAR, a bispecific antibody (Milstein and Cuello, *Nature* 305:537-539, 1983; Suresh et al., *Methods in Enzymology* 121:210, 1986; WO 96/27011; Brennan et al., *Science* 229:81, 1985; Shalaby et al., *J. Exp. Med.* 175:217-225, 1992; Kolstelny et al., *J. Immunol.* 148 (5): 1547-1553, 1992; Hollinger et al., *Proc. Natl. Acad. Sci. U.S.A.* 90:6444-6448, 1993; Gruber et al., *J. Immunol.* 152:5368, 1994; and Tutt et al., *J. Immunol.* 147:60, 1991), a bispecific diabody, a triabody (Schoonooghe et al., *BMC Biotechnol.* 9:70, 2009), a tetrabody, scFv-Fc knobs-into-holes, a scFv-Fc-scFv, a (Fab'scFv)$_2$, a V-IgG, a IvG-V, a dual V domain IgG, a heavy chain immunoglobulin or a camelid (Holt et al., *Trends Biotechnol.* 21 (11): 484-490, 2003), an intrabody, a monoclonal antibody (e.g., a human or humanized monoclonal antibody), a heteroconjugate antibody (e.g., U.S. Pat. No. 4,676,980), a linear antibody (Zapata et al., *Protein Eng.* 8 (10:1057-1062, 1995), a trispecific antibody (Tutt et al., *J. Immunol.* 147:60, 1991), a Fabs-in-Tandem immunoglobulin (WO 15/103072), or a humanized camelid antibody.

In other instances, the CCR9 inhibitor is a monoclonal antibody. For example, the CCR9 antibody can be 91R, see, e.g., Chamorro et al., MAbs 6 (4): 1000-1012, 2014. Additional non-limiting examples of CCR9 inhibitors are described in, e.g., U.S. Patent Application Publication Nos. 2012/0100554, 2012/0100154, 2011/0123603, 2009/0028866, and 2005/0181501.

In some embodiments, any of the antibodies or antigen-binding fragments described herein has a dissociation constant ($K_D$) of less than $1\times10^{-5}$ M (e.g., less than $0.5\times10^{-5}$ M, less than $1\times10^{-6}$ M, less than $0.5\times10^{-6}$ M, less than $1\times10^{-7}$ M, less than $0.5\times10^{-7}$ M, less than $1\times10^{-8}$ M, less than $0.5\times10^{-8}$ M, less than $1\times10^{-9}$ M, less than $0.5\times10^{-9}$ M, less than $1\times10^{-10}$ M, less than $0.5\times10^{-10}$ M, less than $1\times10^{-11}$ M, less than $0.5\times10^{-11}$ M, or less than $1\times10^{-12}$ M), e.g., as measured in phosphate buffered saline using surface plasmon resonance (SPR).

In some embodiments, any of the antibodies or antigen-binding fragments described herein has a $K_D$ of about $1\times10^{-12}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, about $0.5\times10^{-9}$ M, about $1\times10^{-10}$ M, about $0.5\times10^{-10}$ M, about $1\times10^{-1}$ M, or about $0.5\times10^{-11}$ M (inclusive); about $0.5\times10^{-11}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, about $0.5\times10^{-9}$ M, about $1\times10^{-10}$ M, about $0.5\times10^{-10}$ M, or about $1\times10^{-11}$ M (inclusive); about $1\times10^{-11}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, about $0.5\times10^{-9}$ M, about $1\times10^{-10}$ M, or about $0.5\times10^{-10}$ M (inclusive); about $0.5\times10^{-10}$ M to about $1\times10^{5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, about $0.5\times10^{-9}$ M, or about $1\times10^{-10}$ M (inclusive); about $1\times10^{-10}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, about $1\times10^{-9}$ M, or about $0.5\times10^{-9}$ M (inclusive); about $0.5\times10^{-9}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, about $0.5\times10^{-8}$ M, or about $1\times10^{-9}$ M (inclusive); about $1\times10^{-9}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, about $1\times10^{-8}$ M, or about $0.5\times10^{-8}$ M (inclusive); about $0.5\times10^{-8}$ M to about $1\times10^{-5}$ M, about $0.5\times10^{-5}$ M, about $1\times10^{-6}$ M, about $0.5\times10^{-6}$ M, about $1\times10^{-7}$ M, about $0.5\times10^{-7}$ M, or about $1\times10^{-8}$ M (inclusive); about $1\times10^{-8}$ M to about $1\times10^{-5}$ M, about $0.5\times10^{-5}$ M, about $1\times10^{-6}$ M, about $0.5\times10^{-6}$ M, about $1\times10^{-7}$ M, or about $0.5\times10^{-7}$ M (inclusive); about $0.5\times10^{-7}$ M to about $1\times10^{-5}$ M, about $0.5\times10^{-5}$ M, about $1\times10^{-6}$ M, about $0.5\times10^{-6}$ M, or about $1\times10^{-7}$ M (inclusive); about $1\times10^{-7}$ M to about $1\times10^{-5}$ M, about $0.5\times10^{-5}$ M, about $1\times10^{-6}$ M, or about $0.5\times10^{-6}$ M (inclusive); about $0.5\times10^{-6}$ M to about $1\times10^{-5}$ M, about $0.5\times10^{-5}$ M, or about $1\times10^{-6}$ M (inclusive); about $1\times10^{-6}$ M to about $1\times10^{-5}$ M or about $0.5\times10^{-5}$ M (inclusive); or about $0.5\times10^{-5}$ M to about $1\times10^{-5}$ M (inclusive), e.g., as measured in phosphate buffered saline using surface plasmon resonance (SPR).

In some embodiments, any of the antibodies or antigen-binding fragments described herein has a $K_{off}$ of about $1\times10^{-6}$ s$^{-1}$ to about $1\times10^{-3}$ s$^{-1}$, about $0.5\times10^{-3}$ s$^{-1}$, about $1\times10^{-4}$ s$^{-1}$, about $0.5\times10^{-4}$ s$^{-1}$, about $1\times10^{-5}$ s$^{-1}$, or about $0.5\times10^{-5}$ s$^{-1}$ (inclusive); about $0.5\times10^{-5}$ s$^{-1}$ to about $1\times10^{-3}$ s$^{-1}$, about $0.5\times10^{-3}$ s$^{-1}$, about $1\times10^{-4}$ s$^{-1}$, or about $0.5\times10^{-4}$ s$^{-1}$, or about $1\times10^{-5}$ s$^{-1}$ (inclusive); about $1\times10^{-5}$ s$^{-1}$ to about $1\times10^{-3}$ s$^{-1}$, about $0.5\times10^{-3}$ s$^{-1}$, about $1\times10^{-4}$ s$^{-1}$, or about $0.5\times10^{-4}$ s$^{-1}$ (inclusive); about $0.5\times10^{-4}$ s$^{-1}$ to about $1\times10^{-3}$ s$^{-1}$, about $0.5\times10^{-3}$ s$^{-1}$, or about $1\times10^{-4}$ s$^{-1}$ (inclusive); about $1\times10^{-4}$ s$^{-1}$ to about $1\times10^{-3}$ s$^{-1}$, or about $0.5\times10^{-3}$ s$^{-1}$ (inclusive); or about $0.5\times10^{-5}$ s$^{-1}$ to about $1\times10^{-3}$ s$^{-1}$ (inclusive), e.g., as measured in phosphate buffered saline using surface plasmon resonance (SPR).

In some embodiments, any of the antibodies or antigen-binding fragments described herein has a $K_{on}$ of about $1\times10^2$ M$^{-1}$s$^{-1}$ to about $1\times10^6$ M$^{-1}$s$^{-1}$, about $0.5\times10^6$ M$^{-1}$s$^{-1}$, about $1\times10^5$ M$^{-1}$s$^{-1}$, about $0.5\times10^5$ M$^{-1}$s$^{-1}$, about $1\times10^4$ M$^{-1}$s$^{-1}$, about $0.5\times10^4$ M$^{-1}$s$^{-1}$, about $1\times10^3$ M$^{-1}$s$^{-1}$, or about $0.5\times10^3$ M$^{-1}$s$^{-1}$ (inclusive); about $0.5\times10^3$ M$^{-1}$s$^{-1}$ to about $1\times10^6$ M$^{-1}$s$^{-1}$, about $0.5\times10^6$ M$^{-1}$s$^{-1}$, about $1\times10^5$ M$^{-1}$s$^{-1}$, about $0.5\times10^5$ M$^{-1}$s$^{-1}$, about $1\times10^4$ M$^1$s$^{-1}$, about $0.5\times10^4$ M$^{-1}$s$^{-1}$, or about $1\times10^3$ M$^{-1}$s$^{-1}$ (inclusive); about $1\times10^3$ M$^{-1}$s$^{-1}$ to about $1\times10^6$ M$^{-1}$s$^{-1}$, about $0.5\times10^6$ M$^{-1}$s$^{-1}$, about $1\times10^5$ M$^{-1}$s$^{-1}$, about $0.5\times10^5$ M$^{-1}$s$^{-1}$, about $1\times10^4$ M$^{-1}$s$^{-1}$, or about $0.5\times10^4$ M$^{-1}$s$^{-1}$ (inclusive); about $0.5\times10^4$ M$^{-1}$s$^{-1}$ to about $1\times10^6$ M$^{-1}$s$^{-1}$, about $0.5\times10^6$ M$^{-1}$s$^{-1}$, about $1\times10^5$ M$^{-1}$s$^{-1}$, about $0.5\times10^5$ M$^{-1}$s$^{-1}$, or about $1\times10^4$ M$^{-1}$s$^{-1}$ (inclusive); about $1\times10^4$ M$^{-1}$s$^{-1}$ to about $1\times10^6$ M$^{-1}$s$^{-1}$, about $0.5\times10^6$ M$^{-1}$s$^{-1}$, about $1\times10^5$ M$^{-1}$s$^{-1}$, or about $0.5\times10^5$ M$^{-1}$s$^{-1}$ (inclusive); about $0.5\times10^5$ M$^{-1}$s$^{-1}$ to about $1\times10^6$ M$^{-1}$s$^{-1}$, about $0.5\times10^6$ M$^{-1}$s$^{-1}$, or about $1\times10^5$ M$^{-1}$s$^{-1}$ (inclusive); about $1\times10^5$ M$^{-1}$s$^{-1}$ to about $1\times10^6$ M$^{-1}$s$^{-1}$, or about $0.5\times10^6$ M$^{-1}$s$^{-1}$ (inclusive); or about $0.5\times10^6$ M$^{-1}$s$^{-1}$ to about $1\times10^6$ M$^{-1}$s$^{-1}$ (inclusive), e.g., as measured in phosphate buffered saline using surface plasmon resonance (SPR).

Additional examples of CCR9 inhibitors that are antibodies or antigen-binding antibody fragments are known in the art.

Small Molecules

In some instances, the CCR9 inhibitor is a small molecule. For example, the CCR9 inhibitor can be Traficet-EN® (also called Vercirnon, CCX282, and GSK1605786) or Tu1652 CCX507. See, e.g., Eksteen et al., *IDrugs* 13 (7): 472-481, 2010; and Walters et al., *Gastroenterology* 144 (5): S-815, 2013.

Additional examples of CCR9 inhibitors that are small molecules are known in the art.

ELR Chemokine Inhibitors

ELR chemokines are CXC chemokines that have a glutamic acid-leucine-arginine (ELR) motif. See, e.g., Strieter et al., *J. Biol. Chem.* 270:27348-27357, 1995.

The term "ELR chemokine inhibitor" refers to an agent which decreases the ability of CXCR1 and/or CXCR2 to bind to one or more (e.g., two, three, four, five, six, seven, or eight) of CXCL1, CXCL2, CXCL3, CXCL4, CXCL5, CXCL6, CXCL7, and CXCL8.

In some embodiments, the ELR chemokine inhibitor can decrease the binding between CXCR1 and CXCL8 by blocking the ability of CXCR1 to interact with CXCL8. In some embodiments, the ELR chemokine inhibitor can decrease the binding between CXCR1 and CXCL6 by blocking the ability of CXCR1 to interact with CXCL6. In some embodiments, the ELR chemokine inhibitor can decrease the binding between CXCR1 and each of CXCL8 and CXCL6.

In some embodiments, the ELR chemokine inhibitor can decrease the binding between CXCR2 and CXCL1 by blocking the ability of CXCR2 to interact with CXCL1. In some embodiments, the ELR chemokine inhibitor can decrease the binding between CXCR2 and CXCL2 by blocking the ability of CXCR2 to interact with CXCL2. In some embodiments, the ELR chemokine inhibitor can decrease the binding between CXCR2 and CXCL3 by blocking the ability of CXCR2 to interact with CXCL3. In some embodiments, the ELR chemokine inhibitor can decrease the binding between CXCR2 and CXCL4 by blocking the ability of CXCR2 to interact with CXCL4. In some embodiments, the ELR chemokine inhibitor can decrease the binding between CXCR2 and CXCL5 by blocking the ability of CXCR2 to interact with CXCL5. In some embodiments, the ELR chemokine inhibitor can decrease the binding between CXCR2 and CXCL6 by blocking the ability of CXCR2 to interact with CXCL6. In some embodiments, the ELR chemokine inhibitor can decrease the binding between CXCR2 and CXCL7 by blocking the ability of CXCR2 to interact with CXCL7. In some embodiments, the ELR chemokine inhibitor can decrease the binding between CXCR2 and one or more (e.g., two, three, four, five, six, or seven) of CXCL1, CXCL2, CXCL3, CXCL4, CXCL5, CXCL6, and CXCL7.

In some embodiments, the ELR chemokine inhibitor can decrease the binding of CXCR1 to one or both of CXCL6 and CXCL8, and can decrease the binding to CXCR2 to one or more (e.g., two, three, four, five, six, or seven) of CXCL1, CXCL2, CXCL3, CXCL4, CXCL5, CXCL6, and CXCL7

In some instances, the ELR chemokine inhibitor is a small molecule. In some instances, the ELR chemokine inhibitor is an antibody or an antigen-binding antibody fragment.

Exemplary sequences for human CXCR1, human CXCR2, human CXCL1, human CXCL2, human CXCL3, human CXCL4, human CXCL5, human CXCL6, human CXCL7, and human CXCL8 are shown in SEQ ID NOs: 200-210.

Human CXCR1

(SEQ ID NO: 200)

msnitdpqmw dfddlnftgm ppadedyspc xletetlnky vviiayalvf llsllgnslv mlvilysrvg rsvtdvylln laladllfal tlpiwaaskv ngwifgtflc kvvsllkevn fysgilllac isvdrylaiv hatrtltqkr hlvkfvclgc wglsmnlslp fflfrqayhp nnsspvcyev lgndtakwrm vlrilphtfg fivplfvmlf cygftlrtlf kahmgqkhra mrvffavvli fllcwlpynl vlladtlmrt qviqescerr nnigraldat eilgflhscl npiiyafigq nfrhgflkil amhglvskef larhrvtsyt sssvnvssnl Human CXCR2

(SEQ ID NO: 201)

medfnmesds fedfwkgedl snysysstlp pflldaapce pesleinkyf vviiyalvfl lsllgnslvm lvilysrvgr svtdvyllnl aladllfalt lpiwaaskvn gwifgtflck vvsllkevnf ysgilllaci svdrylaivh atrtltqkry lvkficlsiw glslllalpv llfrrtvyss nvspacyedm gnntanwrml lrilpqsfgf ivpllimlfc ygftlrtlfk ahmgqkhram rvifavvlif llcwlpynlv lladtlmrtq viqetcerrn hidraldate ilgilhscln pliyafigqk frhgllkila ihgliskdsl pkdsrpsfvg sssghtsttl -continued Human CXCL1
(SEQ ID NO: 202)
maraalsaap snprllrval lllllvaagr raagasvate lrcqclqtlq gihpkniqsv nvkspgphca qteviatlkn grkaclnpas pivkkiiekm lnsdksn Human CXCL2
(SEQ ID NO: 203)
maratlsaap snprllrval lllllvaasr raagaplate lrcqclqtlq gihlkniqsv kvkspgphca qteviatlkn gqkaclnpas pmvkkiiekm lkngksn Human CXCL3
(SEQ ID NO: 204)
asyyte lrcqclqtlq gihlkniqsv nvrspgphca qteviatlkn gkkaclnpas pmvqkiieki lnkgstn Human CXCL4
(SEQ ID NO: 205)
mssaagfcas rpgllflgll llplvvafas aeaeedgdlq cicvkttsqv rprhitslev ikagphcpta qliatlkngr kicldlqapl ykkiikklle s Human CXCL5
(SEQ ID NO: 206)
msllssraar vpgpssslca llvlllltq pgpiasagpa aavlrelrcv clqttqgvhp kmisnlqvfa igpqcskvev vaslkngkei cldpeapflk kviqkildgg nken Human CXCL6
(SEQ ID NO: 207)
gpv savltelrct clrvtlrynp ktigklqvfp agpqcskvev vaslkngkqv cldpeapflk kviqkildsg nkkn Human CXCL7
(SEQ ID NO: 208)
mslrldttps cnsarplhal qvllllsll talasstkgq tkrnlakgke esldsdlyae lrcmciktts gihpkniqsl evigkgthcn qveviatlkd grkicldpda prikkivqkk lagdesad Human CXCL8 Isoform 1
(SEQ ID NO: 209)
egavlprsak elrcqcikty skpfhpkfik elrviesgph canteiivkl sdgrelcldp kenwvqrvve kflkraens Human CXCL8 Isoform 2
(SEQ ID NO: 210)
egavlprsak elrcqcikty skpfhpkfik elrviesgph canteiivkl sdgrelcldp kenwvqrvve kflkr Antibodies In some embodiments, the ELR chemokine inhibitor is an antibody or an antigen-binding fragment thereof (e.g., a Fab or a scFv). In some embodiments, an antibody or antigen-binding fragment described herein binds specifically to CXCR1 and/or CXCR2. In some embodiments, an antibody or antigen-binding fragment described herein binds specifically to one or more (e.g., two, three, four, five, six, seven, or eight) of: CXCL1, CXCL2, CXCL3, CXCL4, CXCL5, CXCL6, CXCL7, and CXCL8 (IL-8).

In some embodiments, the antibody can be a humanized antibody, a chimeric antibody, a multivalent antibody, or a fragment thereof. In some embodiments, an antibody can be a scFv-Fc (Sokolowska-Wedzina et al., *Mol. Cancer Res.* 15 (8): 1040-1050, 2017), a VHH domain (Li et al., *Immunol. Lett.* 188:89-95, 2017), a VNAR domain (Hasler et al., *Mol. Immunol.* 75:28-37, 2016), a (scFv) 2, a minibody (Kim et al., *PLOS One* 10 (1): e113442, 2014), or a BiTE. In some embodiments, an antibody can be a DVD-Ig (Wu et al., *Nat. Biotechnol.* 25 (11): 1290-1297, 2007; WO 08/024188; and WO 07/024715), and a dual-affinity re-targeting antibody (DART) (Tsai et al., *Mol. Ther. Oncolytics* 3:15024, 2016), a triomab (Chelius et al., MAbs 2 (3): 309-319, 2010), kih IgG with a common LC (Kontermann et al., *Drug Discovery Today* 20 (7): 838-847, 2015), a crossmab (Regula et al., *EMBO Mol. Med.* 9 (7): 985, 2017), an ortho-Fab IgG (Kontermann et al., *Drug Discovery Today* 20 (7): 838-847, 2015), a 2-in-1-IgG (Kontermann et al., *Drug Discovery Today* 20 (7): 838-847, 2015), IgG-scFv (Cheal et al., *Mol. Cancer Ther.* 13 (7): 1803-1812, 2014), scFv2-Fc (Natsume et al., *J. Biochem.* 140 (3): 359-368, 2006), a bi-nanobody (Kontermann et al., *Drug Discovery Today* 20 (7): 838-847, 2015), tanden antibody (Kontermann et al., *Drug Discovery Today* 20 (7): 838-847, 2015), a DART-Fc (Kontermann et al., *Drug Discovery Today* 20 (7): 838-847, 2015), a scFv-HSA-scFv (Kontermann et al., *Drug Discovery Today* 20 (7): 838-847, 2015), DNL-Fab3 (Kontermann et al., *Drug Discovery Today* 20 (7): 838-847, 2015), DAF (two-in-one or four-in-one), DutaMab, DT-IgG, knobs-in-holes common LC, knobs-in-holes assembly, charge pair antibody, Fab-arm exchange antibody, SEEDbody, Triomab, LUZ-Y, Fcab, kλ-body, orthogonal Fab, DVD-IgG, IgG (H)-scFv, scFv-(H) IgG, IgG (L)-scFv, scFv-(L)-IgG, IgG (L,H)-Fc, IgG (H)-V, V (H)-IgG, IgG (L)-V, V (L)-IgG, KIH IgG-scFab, 2scFv-IgG, IgG-2scFv, scFv4-Ig, Zybody, DVI-IgG, nanobody (e.g., antibodies derived from *Camelus bactriamus, Calelus dromaderius,* or *Lama paccos*) (U.S. Pat. No. 5,759, 808; Stijlemans et al., *J. Biol. Chem.* 279:1256-1261, 2004; Dumoulin et al., *Nature* 424:783-788, 2003; and Pleschberger et al., *Bioconjugate Chem.* 14:440-448, 2003), nanobody-HSA, a diabody (e.g., Poljak, Structure 2 (12): 1121-1123, 1994; and Hudson et al., *J. Immunol. Methods* 23 (1-2): 177-189, 1999), a TandAb (Reusch et al., mAbs 6 (3): 727-738, 2014), scDiabody (Cuesta et al., *Trends in Biotechnol.* 28 (7): 355-362, 2010), scDiabody-CH3 (Sanz et al., *Trends in Immunol.* 25 (2): 85-91, 2004), Diabody-CH3, Triple Body, miniantibody, minibody, TriBi minibody, scFv-CH3 KIH, Fab-scFv, scFv-CH-CL-scFv, F(ab')2-scFV2, scFv-KIH, Fab-scFv-Fc, tetravalent HCAb, scDiabody-Fc, diabody-Fc, tandem scFv-Fc, intrabody (Huston et al., *Human Antibodies* 10 (3-4): 127-142, 2001; Wheeler et al., *Mol. Ther.* 8 (3): 355-366, 2003; and Stocks, *Drug Discov. Today* 9 (22): 960-966, 2004), dock and lock bispecific antibody, ImmTAC, HSAbody, scDiabody-HSA, tandem scFv, IgG-IgG, Cov-X-Body, and scFv1-PEG-scFv2.

Non-limiting examples of an antigen-binding fragment of an antibody include an Fv fragment, a Fab fragment, a F(ab')$_2$ fragment, and a Fab' fragment. Additional examples of an antigen-binding fragment of an antibody is an antigen-binding fragment of an IgG (e.g., an antigen-binding fragment of IgG1, IgG2, IgG3, or IgG4) (e.g., an antigen-binding fragment of a human or humanized IgG, e.g., human or humanized IgG1, IgG2, IgG3, or IgG4); an antigen-binding fragment of an IgA (e.g., an antigen-binding fragment of IgA1 or IgA2) (e.g., an antigen-binding fragment of a human or humanized IgA, e.g., a human or humanized IgA1 or IgA2); an antigen-binding fragment of an IgD (e.g., an antigen-binding fragment of a human or humanized IgD);

an antigen-binding fragment of an IgE (e.g., an antigen-binding fragment of a human or humanized IgE); or an antigen-binding fragment of an IgM (e.g., an antigen-binding fragment of a human or humanized IgM).

In some embodiments, an antibody can be an IgNAR, a bispecific antibody (Milstein and Cuello, *Nature* 305:537-539, 1983; Suresh et al., *Methods in Enzymology* 121:210, 1986; WO 96/27011; Brennan et al., *Science* 229:81, 1985; Shalaby et al., *J. Exp. Med.* 175:217-225, 1992; Kolstelny et al., *J. Immunol.* 148 (5): 1547-1553, 1992; Hollinger et al., *Proc. Natl. Acad. Sci. U.S.A.* 90:6444-6448, 1993; Gruber et al., *J. Immunol.* 152:5368, 1994; and Tutt et al., *J. Immunol.* 147:60, 1991), a bispecific diabody, a triabody (Schoonooghe et al., *BMC Biotechnol.* 9:70, 2009), a tetrabody, scFv-Fc knobs-into-holes, a scFv-Fc-scFv, a (Fab'scFv)$_2$, a V-IgG, a IvG-V, a dual V domain IgG, a heavy chain immunoglobulin or a camelid (Holt et al., *Trends Biotechnol.* 21 (11): 484-490, 2003), an intrabody, a monoclonal antibody (e.g., a human or humanized monoclonal antibody), a heteroconjugate antibody (e.g., U.S. Pat. No. 4,676, 980), a linear antibody (Zapata et al., *Protein Eng.* 8 (10:1057-1062, 1995), a trispecific antibody (Tutt et al., *J. Immunol.* 147:60, 1991), a Fabs-in-Tandem immunoglobulin (WO 15/103072), or a humanized camelid antibody.

An ELR chemokine inhibitor can be, e.g., a monoclonal antibody. A non-limiting example of an ELR inhibitor is TAB-099MZ. Additional examples of ELR chemokine inhibitors that are antibodies or antigen-binding antibody fragments are described in, e.g., U.S. Pat. No. 9,290,570; and U.S. Patent Application Publication Nos. 2004/0170628, 2010/0136031, 2015/0160227, 2015/0224190, 2016/0060347, 2016/0152699, 2016/0108117, 2017/0131282, 2016/0060347, 2014/0271647, 2014/0170156, 2012/0164143, 2010/0254941, 2009/0130110, 2008/0118517, 2004/0208873, 2003/0021790, 2002/0082396, and 2001/0006637, each of which is herein incorporated by reference (e.g., the portions describing ELR chemokine inhibitors).

In some embodiments, any of the antibodies or antigen-binding fragments described herein has a dissociation constant ($K_D$) of less than $1 \times 10^{-5}$ M (e.g., less than $0.5 \times 10^{-5}$ M, less than $1 \times 10^{-6}$ M, less than $0.5 \times 10^{-6}$ M, less than $1 \times 10^{-7}$ M, less than $0.5 \times 10^{-7}$ M, less than $1 \times 10^{-8}$ M, less than $0.5 \times 10^{-8}$ M, less than $1 \times 10^{-9}$ M, less than $0.5 \times 10^{-9}$ M, less than $1 \times 10^{-10}$ M, less than $0.5 \times 10^{-10}$ M, less than $1 \times 10^{-11}$ M, less than $0.5 \times 10^{-11}$ M, or less than $1 \times 10^{-12}$ M), e.g., as measured in phosphate buffered saline using surface plasmon resonance (SPR).

In some embodiments, any of the antibodies or antigen-binding fragments described herein has a $K_D$ of about $1 \times 10^{-12}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$ M, about $0.5 \times 10^{-9}$ M, about $1 \times 10^{-10}$ M, about $0.5 \times 10^{-10}$ M, about $1 \times 10^{-11}$ M, or about $0.5 \times 10^{-11}$ M (inclusive); about $0.5 \times 10^{-11}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$ M, about $0.5 \times 10^{-9}$ M, about $1 \times 10^{-10}$ M, about $0.5 \times 10^{-10}$ M, or about $1 \times 10^{-11}$ M (inclusive); about $1 \times 10^{-11}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$ M, about $0.5 \times 10^{-9}$ M, about $1 \times 10^{-10}$ M, or about $0.5 \times 10^{-10}$ M (inclusive); about $0.5 \times 10^{-10}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$ M, about $0.5 \times 10^{-9}$ M, or about $1 \times 10^{-10}$ M (inclusive); about $1 \times 10^{-10}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, about $1 \times 10^{-9}$ M, or about $0.5 \times 10^{-9}$ M (inclusive); about $0.5 \times 10^{-9}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, about $0.5 \times 10^{-8}$ M, or about $1 \times 10^{-9}$ M (inclusive); about $1 \times 10^{-9}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, about $1 \times 10^{-8}$ M, or about $0.5 \times 10^{-8}$ M (inclusive); about $0.5 \times 10^{-8}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, about $0.5 \times 10^{-7}$ M, or about $1 \times 10^{-8}$ M (inclusive); about $1 \times 10^{-8}$ M to about $1 \times 10^{-5}$ M, about $0.5 \times 10^{-5}$ M, about $1 \times 10^{-6}$ M, about $0.5 \times 10^{-6}$ M, about $1 \times 10^{-7}$ M, or about $0.5 \times 10^{-7}$ M (inclusive); about $0.5 \times 10^{-7}$ M to about $1 \times 10^5$ M, about $0.5 \times 10^{-5}$ M, about $1 \times 10^{-6}$ M, about $0.5 \times 10^{-6}$ M, or about $1 \times 10^{-7}$ M (inclusive); about $1 \times 10^{-7}$ M to about $1 \times 10^{-5}$ M, about $0.5 \times 10^{-5}$ M, about $1 \times 10^{-6}$ M, or about $0.5 \times 10^{-6}$ M (inclusive); about $0.5 \times 10^{-6}$ M to about $1 \times 10^{-5}$ M, about $0.5 \times 10^5$ M, or about $1 \times 10^{-6}$ M (inclusive); about $1 \times 10^{-6}$ M to about $1 \times 10^{-5}$ M or about $0.5 \times 10^{-5}$ M (inclusive); or about $0.5 \times 10^{-5}$ M to about $1 \times 10^{-5}$ M (inclusive), e.g., as measured in phosphate buffered saline using surface plasmon resonance (SPR).

In some embodiments, any of the antibodies or antigen-binding fragments described herein has a $K_{off}$ of about $1 \times 10^{-6}$ s$^{-1}$ to about $1 \times 10^{-3}$ s$^{-1}$, about $0.5 \times 10^{-3}$ s$^{-1}$, about $1 \times 10^{-4}$ s$^{-1}$, about $0.5 \times 10^{-4}$ s$^{-1}$, about $1 \times 10^{-5}$ s$^{-1}$, or about $0.5 \times 10^{-5}$ s$^{-1}$ (inclusive); about $0.5 \times 10^{-5}$ s$^1$ to about $1 \times 10^{-3}$ s$^{-1}$, about $0.5 \times 10^{-3}$ s$^{-1}$, about $1 \times 10^4$ s$^{-1}$, about $0.5 \times 10^{-4}$ s$^{-1}$, or about $1 \times 10^{-5}$ s$^{-1}$ (inclusive); about $1 \times 10^{-5}$ s$^1$ to about $1 \times 10^{-3}$ s$^{-1}$, about $0.5 \times 10^{-3}$ s$^{-1}$, about $1 \times 10^{-4}$ s$^{-1}$, or about $0.5 \times 10^{-4}$ s$^{-1}$ (inclusive); about $0.5 \times 10^{-4}$ s$^{-1}$ to about $1 \times 10^{-3}$ s$^{-1}$, about $0.5 \times 10^{-3}$ s$^{-1}$, or about $1 \times 10^{-4}$ s$^{-1}$ (inclusive); about $1 \times 10^{-4}$ s$^{-1}$ to about $1 \times 10^{-3}$ s$^{-1}$, or about $0.5 \times 10^{-3}$ s$^{-1}$ (inclusive); or about $0.5 \times 10^{-5}$ s$^{-1}$ to about $1 \times 10^{-3}$ s$^{-1}$ (inclusive), e.g., as measured in phosphate buffered saline using surface plasmon resonance (SPR).

In some embodiments, any of the antibodies or antigen-binding fragments described herein has a $K_{on}$ of about $1 \times 10^2$ M$^{-1}$s$^{-1}$ to about $1 \times 10^6$ M$^{-1}$s$^{-1}$, about $0.5 \times 10^6$ M$^{-1}$s$^{-1}$, about $1 \times 10^5$ M$^{-1}$s$^{-1}$, about $0.5 \times 10^5$ M$^{-1}$s$^{-1}$, about $1 \times 10^4$ M$^1$s$^{-1}$, about $0.5 \times 10^4$ M$^{-1}$s$^{-1}$, about $1 \times 10^3$ M$^{-1}$s$^{-1}$, or about $0.5 \times 10^3$ M$^{-1}$s$^{-1}$ (inclusive); about $0.5 \times 10^3$ M$^{-1}$s$^{-1}$ to about $1 \times 10^6$ M$^{-1}$s$^{-1}$, about $0.5 \times 10^6$ M$^{-1}$s$^{-1}$, about $1 \times 10^5$ M$^{-1}$s$^{-1}$, about $0.5 \times 10^5$ M$^{-1}$s$^{-1}$, about $1 \times 10^4$ M$^1$s$^{-1}$, about $0.5 \times 10^4$ M$^{-1}$s$^{-1}$, or about $1 \times 103$ M$^{-1}$s$^{-1}$ (inclusive); about $1 \times 103$ M$^{-1}$s$^{-1}$ to about $1 \times 10^6$ M$^{-1}$s$^{-1}$, about $0.5 \times 10^6$ M$^{-1}$s$^{-1}$, about $1 \times 10^5$ M$^{-1}$s$^{-1}$, about $0.5 \times 10^5$ M$^{-1}$s$^{-1}$, about $1 \times 10^4$ M$^{-1}$s$^{-1}$, or about $0.5 \times 10^4$ M$^{-1}$s$^{-1}$ (inclusive); about $0.5 \times 10^4$ M$^{-1}$s$^{-1}$ to about $1 \times 10^6$ M$^{-1}$s$^{-1}$, about $0.5 \times 10^6$ M$^{-1}$s$^{-1}$, about $1 \times 10^5$ M$^{-1}$s$^{-1}$, about $0.5 \times 10^5$ M$^{-1}$s$^{-1}$, or about $1 \times 10^4$ M$^{-1}$s$^{-1}$ (inclusive); about $1 \times 10^4$ M$^{-1}$s$^{-1}$ to about $1 \times 10^6$ M$^{-1}$s$^{-1}$, about $0.5 \times 10^6$ M$^{-1}$s$^{-1}$, about $1 \times 10^5$ M$^{-1}$s$^{-1}$, or about $0.5 \times 10^5$ M$^{-1}$s$^{-1}$ (inclusive); about $0.5 \times 10^5$ M$^{-1}$s$^{-1}$ to about $1 \times 10^6$ M$^{-1}$s$^{-1}$, about $0.5 \times 10^6$ M$^{-1}$s$^{-1}$, or about $1 \times 10^5$ M$^{-1}$s$^{-1}$ (inclusive); about $1 \times 10^5$ M$^{-1}$s$^{-1}$ to about $1 \times 10^6$ M$^{-1}$s$^{-1}$, or about $0.5 \times 10^6$ M$^{-1}$s$^{-1}$ (inclusive); or about $0.5 \times 10^6$ M$^{-1}$s$^{-1}$ to about $1 \times 10^6$ M$^{-1}$s$^{-1}$ (inclusive), e.g., as measured in phosphate buffered saline using surface plasmon resonance (SPR).

Additional examples of ELR chemokine inhibitors that are antibodies or antigen-binding antibody fragments are known in the art.

Small Molecules

In some instances, the ELR chemokine inhibitor is, e.g., a small molecule. For example, the ELR chemokine inhibitor can be, e.g., LY-3041658 or repertaxin (Reparixin; DF 1681Y). Additional non-limiting examples of ELR chemokine inhibitors that are small molecules are described in, e.g., U.S. Patent Application Publication Nos. 2007/0248594, 2006/0014794, 2004/0063709, 2004/0034229, 2003/0204085, 2003/0097004, 2004/0186142, 2004/0235908, 2006/0025453, 2017/0224679, 2017/0190681, 2017/0144996, and 2017/0128474, each of which are incorporated by reference (e.g., the portions describing the ELR chemokine inhibitors).

In some embodiments, the ELR chemokine inhibitor is a peptide, e.g., any of the peptides described in U.S. Patent Application Publication Nos. 2009/0270318, 2009/0118469, and 2007/0160574, 2007/0021593, 2003/0077705, and 2007/0181987, each of which is incorporated by reference (e.g., the portions describing the ELR chemokine inhibitors).

Phosphodiesterase 4 (PDE4) Inhibitors

The term "PDE4 inhibitor" refers to an agent which decreases PDE4 activity in vitro or in a mammalian cell, e.g., as compared to the level of PDE4 activity in the absence of the agent; and/or decreases the level of a PDE4 protein in a mammalian cell contacted with the agent, e.g., as compared to the same mammalian cell not contacted with the agent. A non-limiting example of PDE4 activity is the degradation of cAMP.

Small Molecules

In some embodiments, a PDE4 inhibitor is a small molecule. In some embodiments, a PDE4 inhibitor can be a small molecule (e.g., an organic, an inorganic, or bioinorganic molecule) having a molecule weight of less than 900 Daltons (e.g., less than 500 Daltons). In some embodiments, a PDE4 inhibitor can be an inhibitory nucleic acid.

Non-limiting examples of small molecules that are PDE4 inhibitors are shown in Table 7.

TABLE 7

Exemplary Small Molecule PDE4 Inhibitors

| Drug Name | Originator Company | Structure | Other Drug Names | Indications |
|---|---|---|---|---|
| apremilast | Celgene Corp | 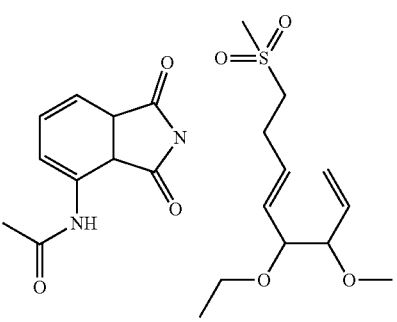 | CC-10004; CC-110004; CDC-104; Otezla; apremilast; lead selCID (2), Celgene; selCID (COPD), Celgene | Asthma; Atopic dermatitis; Crohns disease; Inflammatory disease; Rheumatoid arthritis |
| CC-1088 | Celgene Corp | 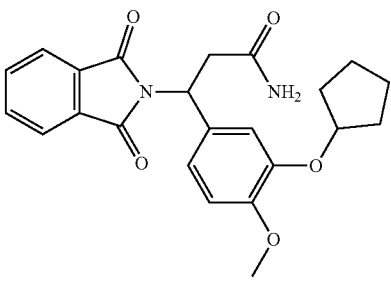 [SMILES: COc1ccc(C(CC(N)=O)N2C(=O)c3ccccc3C2=O)cc1OC1CCCC1] | CC-1088; CC-5048; CC-801; CDC-801; lead SelCID (1), Celgene | Crohns disease; Inflammatory disease; Myelodysplastic syndrome |
| tetomilast | Otsuka Pharmaceutical Co Ltd | 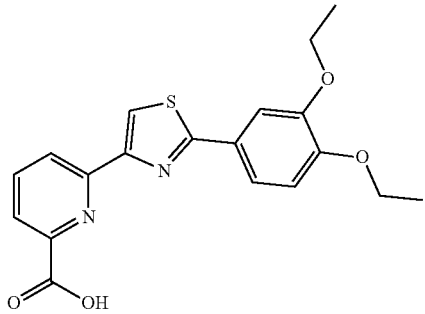 [SMILES: CCOc1ccc(-c2nc(-c3cccc(C(=O)O)n3)cs2)cc1OCC] | OPC-6535; tetomilast | Chronic obstructive pulmonary disease; Crohns disease; Inflammatory bowel disease; Respiratory disease; Ulcerative colitis |

TABLE 7-continued

Exemplary Small Molecule PDE4 Inhibitors

| Drug Name | Originator Company | Structure | Other Drug Names | Indications |
|---|---|---|---|---|
| KF-19514 | Kyowa Hakko Kogyo Co Ltd | 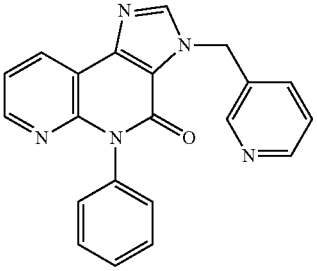 [SMILES: O=c1c2c(ncn2Cc2cccnc2)c2cccnc2n1-c1ccccc1] | KF-19514; PDE 4 inhibitors (asthma), Kyowa | Allergic rhinitis; Asthma; Respiratory disease |
| PF-06266047 | Pfizer Inc | | PF-06266047 | Schizophrenia |
| SKF-107806 | SmithKline Beecham plc | | SKF-107806 | Asthma |
| PDB-093 | Wyeth-Ayerst Pharmaceuticals Inc | 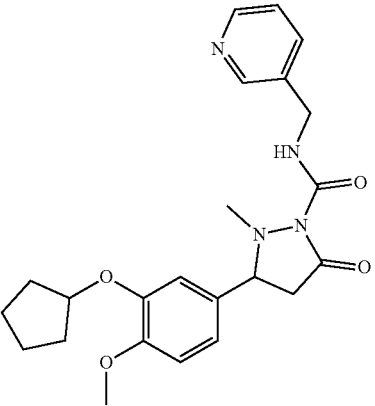 [SMILES: COc1ccc(C2CC(=O)N(C(=O)NCc3cccnc3)N2C)cc1OC1CCCC1] | PDB-093 | Asthma |
| PDE4 inhibitors (inhalant formulation, chronic obstructive pulmonary disease), AstraZeneca | Astra Zeneca plc | 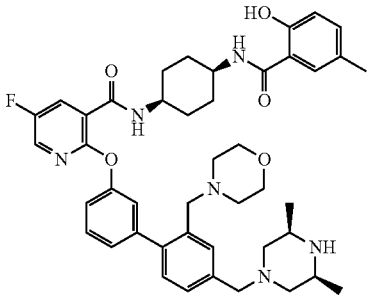 [SMILES: Cc1ccc(O)c(C(=O)N[C@H]2CC[C@@H](NC(=O)c3cc(F)cnc3Oc3cccc(-c4ccc(CN5C[C@@H](C)N[C@@H](C)C5)cc4CN4CCOCC4)c3)CC2)c1] | PDE4 inhibitors (inhalant formulation, chronic obstructive pulmonary disease), AstraZeneca | Chronic obstructive pulmonary disease |
| tolafentrine | Takeda GmbH | 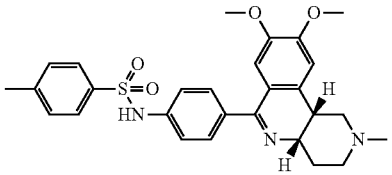 | BY-4070; tolafentrine | Asthma |
| TAK-648 | Takeda Pharmaceutical Co Ltd | | TAK-648 | Diabetic nephropathy; Non-insulin dependent diabetes |
| CH-928 | UCB Celltech | | CH-928 | Asthma |
| CH-673 | UCB Celltech | | CH-673 | Asthma |

TABLE 7-continued

Exemplary Small Molecule PDE4 Inhibitors

| Drug Name | Originator Company | Structure | Other Drug Names | Indications |
|---|---|---|---|---|
| CH-422 | UCB Celltech | | CH-422 | Asthma |
| ABI-4 | Pfizer Inc | 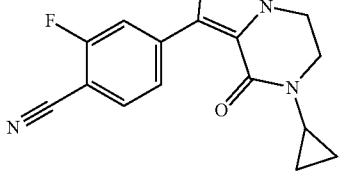 | 18F-PF-06445974; ABI-4; Fluorine-18-PF-06445974; PDE4 inhibitor (psychotic disorders), Pfizer/Northeastern University; PF-06445974-[18F] | |
| roflumilast N-oxide (inhalant formulation, airway disorders), Incozen | Incozen Therapeutics Pvt Ltd | 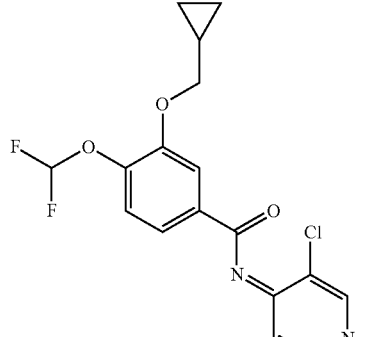 | roflumilast N-oxide; roflumilast N-oxide (inhalant formulation, airway disorders), Incozen | Respiratory disease |
| PDE4 allosteric inhibitors (mild cognitive impairment/traumatic brain injury), Tetra Discovery | Tetra Discovery Partners LLC | | PDE4 allosteric inhibitors (mild cognitive impairment/traumatic brain injury), Tetra Discovery | |
| PDE4 inhibitors (inflammatory disorders), Kyorin Pharmaceuticals | Kyorin Pharmaceutical Co Ltd | 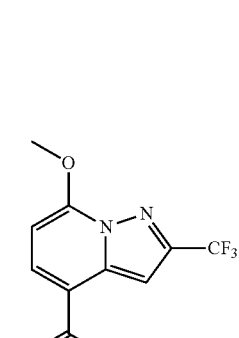 | PDE4 inhibitors (inflammatory disorders), Kyorin Pharmaceuticals | Inflammatory disease |
| BYK-321084 | Takeda Pharma A/S | | BYK-321084 | Psoriasis |

TABLE 7-continued
Exemplary Small Molecule PDE4 Inhibitors
| Drug Name | Originator Company | Structure | Other Drug Names | Indications |
|---|---|---|---|---|
| WAY-127093B | Wyeth-Ayerst Pharmaceuticals Inc | 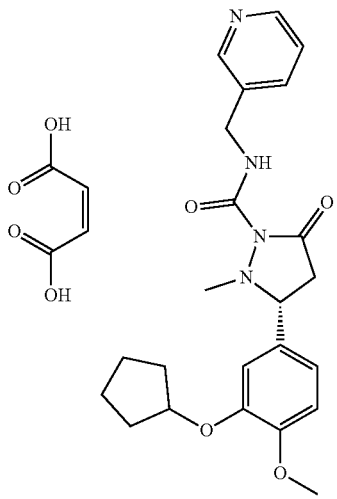 [SMILES: O=C(O)/C=C\C(=O)O ; COc1ccc([C@H]2CC(=O)N(C(=O)NCc3cccnc3)N2C)cc1OC1CCCC1] | WAY-127093B | Asthma |
| NCS-613 | Centre National de la Recherche Scientifique (CNRS) | 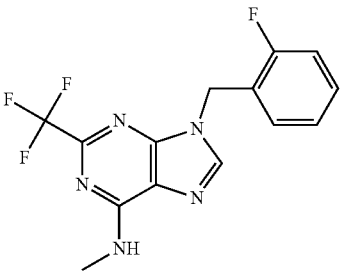 [SMILES: CNc1nc(C(F)(F)F)nc2c1ncn2Cc1ccccc1F] | NCS-613 | Cardiac failure |
| SDZ-ISQ-844 | Novartis AG | 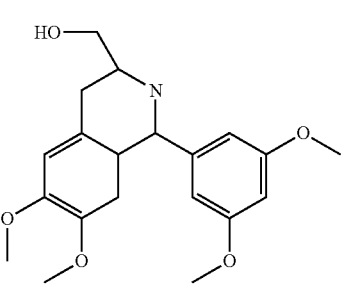 [SMILES: COC1=C(OC)CC2C(=C1)CC(CO)NC2c1cc(OC)cc(OC)c1] | SDZ-ISQ-844 | Asthma |

TABLE 7-continued

Exemplary Small Molecule PDE4 Inhibitors

| Drug Name | Originator Company | Structure | Other Drug Names | Indications |
|---|---|---|---|---|
| dual long-acting beta2-adrenoceptor agonists/ PDE4 inhibitors (inhalant, COPD), Gilead | Gilead Sciences Inc | 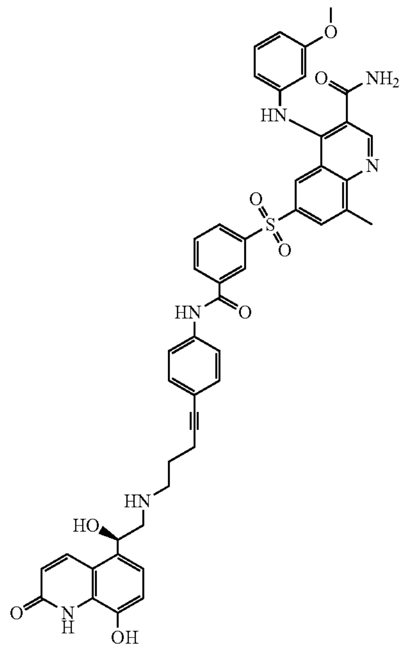 [SMILES: COc1cccc(Nc2c(C(N)=O)cnc3c(C)cc(S(=O)(=O)c4cccc(C(=O)Nc5ccc(C#CCCCNC[C@H](O)c6ccc(O)c7[nH]c(=O)ccc67)cc5)c4)cc23)c1] | GS-5759; dual long-acting beta2-adrenoceptor agonists/PDE4 inhibitors (inhalant, COPD), Gilead | Chronic obstructive pulmonary disease |
| Ro-20-1724 | Roche Holding AG | 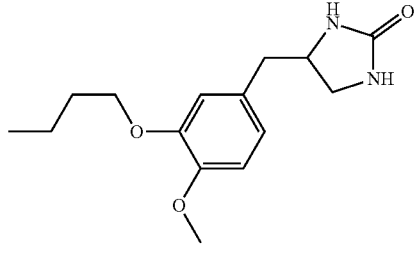 [SMILES: CCCCOc1cc(CC2CNC(=O)N2)ccc1OC] | Ro-20-1724 | Asthma; Psoriasis |
| Hemay-005 | Tianjin Hemay Bio-Tech Co Ltd | | Hemay-005; TNF alpha and IL-1 dual antagonist (inflammation), Tianjin Hemay Bio-Tech/Hainan Hailing Chemipharma Corporation | |
| PDE3/PDE4 inhibitors, Kyorin | Kyorin Holdings Inc | 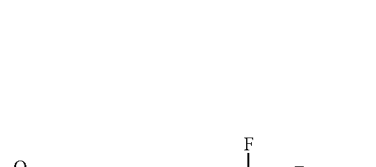 | KCA-1490; PDE3/PDE4 inhibitors, Kyorin | Respiratory disease |

TABLE 7-continued

Exemplary Small Molecule PDE4 Inhibitors

| Drug Name | Originator Company | Structure | Other Drug Names | Indications |
|---|---|---|---|---|
| phosphodiesterase inhibitors, Syntex | Roche Palo Alto | | PDE4 inhibitors, Syntex; TVX-2706; nitraquazone; phosphodiesterase inhibitors, Syntex | Inflammatory disease |
| filaminast | Wyeth-Ayerst Pharmaceuticals Inc | 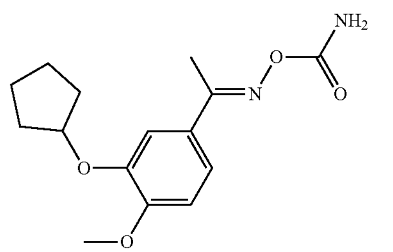 [SMILES: COc1ccc(/C(C)=N/OC(N)=O)cc1OC1CCCC1] | PDA-641; WAY-PDA-641; filaminast | Asthma; Inflammatory disease |
| LASSBio-596 | LASSBio | 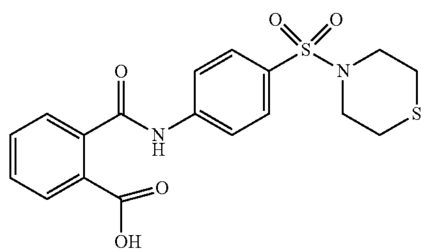 [SMILES: O=C(O)c1ccccc1C(=O)Nc1ccc(S(=O)(=O)N2CCSCC2)cc1] | LASSBio-596; PDE4/PDE5 inhibitor (acute lung injury/asthma), LASSBio | Asthma |
| ASP-3258 | Astellas Pharma Inc | 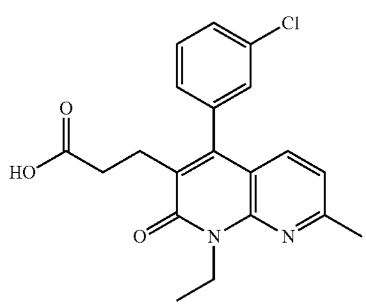 [SMILES: CCn1c(=O)c(CCC(=O)O)c(-c2cccc(Cl)c2)c2ccc(C)nc21] | ASP-3258; PDE 4 inhibitor (airway inflammation), Astellas; phosphodiesterase 4 inhibitor (airway inflammation), Astellas | Respiratory tract inflammation |
| TAS-203 | Taiho Pharmaceutical Co Ltd | 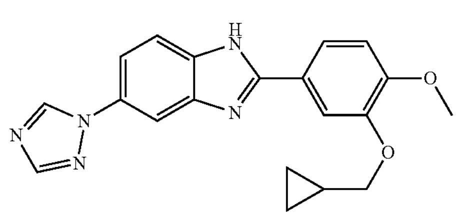 [SMILES: COc1ccc(-c2nc3cc(-n4cncn4)ccc3[nH]2)cc1OCC1CC1] | PDE 4 inhibitor (airway inflammation), Taiho; TAS-203; phosphodiesterase 4 inhibitor (airway inflammation), Taiho | Respiratory tract inflammation |
| PDE4 inhibitor (inflammatory disease/ autoimmune disease), Anacor Pharmaceuticals | Anacor Pharmaceuticals Inc | | AN-3889; AN-5322; AN-6414; AN-6415; PDE4 inhibitor (inflammatory disease/autoimmune disease), Anacor Pharmaceuticals | |

TABLE 7-continued

Exemplary Small Molecule PDE4 Inhibitors

| Drug Name | Originator Company | Structure | Other Drug Names | Indications |
| --- | --- | --- | --- | --- |
| lotamilast | Eisai Co Ltd | 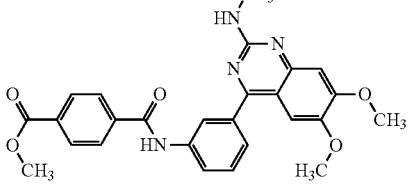 | E-6005; RVT-501; lotamilast | |
| GPD-1116 | ASKA Pharmaceutical Co Ltd | 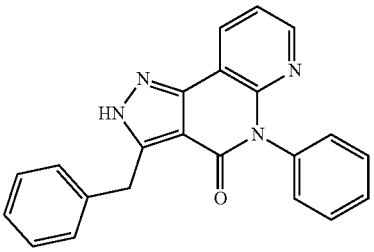 [SMILES: O=c1c2c(Cc3ccccc3)[nH]nc2c2cccnc2n1-c1ccccc1] | GPD-1116 | Asthma; Chronic obstructive pulmonary disease; Emphysema |
| cipamfylline | Smith Kline Beecham plc | 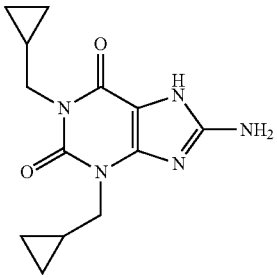 [SMILES: Nc1nc2c([nH]1)c(=O)n(CC1CC1)c(=O)n2CC1CC1] | BRL-61063; HEP-688; cipamfylline | Asthma; Atopic dermatitis |
| Phosphodiesterase 3, 4 and 7 inhibitors (oral, COPD), Spring Bank Pharmaceuticals | Spring Bank Pharmaceuticals Inc | | Phosphodiesterase 3, 4 and 7 inhibitors (oral, COPD), Spring Bank Pharmaceuticals; SMNH compounds (oral, COPD), Spring Bank Pharmaceuticals; nucleotide based program (oral, COPD), Spring Bank Pharmaceuticals; small molecule nucleic acid hybrids (oral, COPD), Spring Bank Pharmaceuticals | Chronic obstructive pulmonary disease |
| ZL-N-91 | Zhejiang University | | ZL-N-91 | Lung inflammation |
| PDE 4 inhibitors (inflammation), Almirall | Almirall Prodesfarma SA | 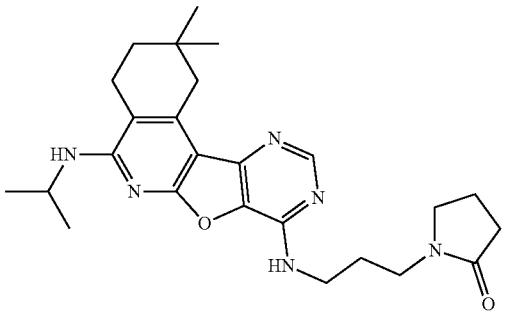 [SMILES: CC(C)Nc1nc2oc3c(NCCCN4CCCC4=O)ncnc3c2c2c1CCC(C)(C)C2] | PDE 4 inhibitors (inflammation), Almirall | Inflammatory disease |

TABLE 7-continued

Exemplary Small Molecule PDE4 Inhibitors

| Drug Name | Originator Company | Structure | Other Drug Names | Indications |
|---|---|---|---|---|
| CDP-840 | UCB Celltech | 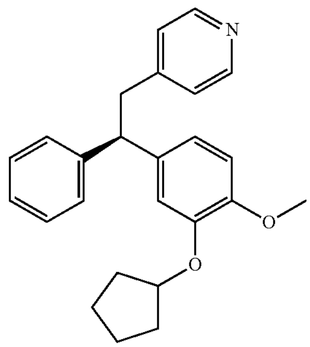 [SMILES: COc1ccc([C@H](Cc2ccncc2)c2ccccc2)cc1OC1CCCC1] | CDP-840 | Asthma |
| GSK-356278 | GlaxoSmith Kline plc | 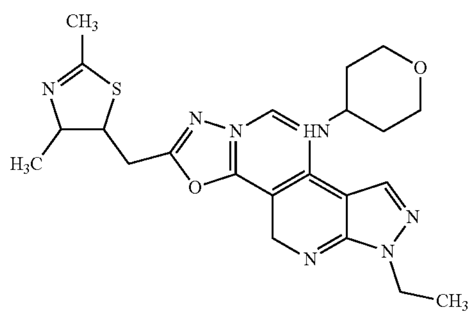 | 356278; GSK-356278; PDE4 inhibitor (oral, depression/anxiety, GlaxoSmithKline | Anxiety disorder; Depression; Huntingtons chorea |
| cilomilast | SmithKline Beecham plc | 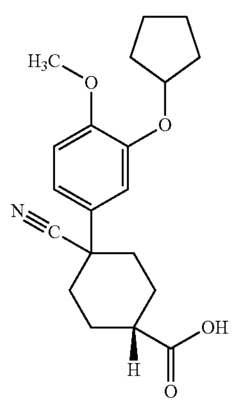 | Ariflo; SB-207499; cilomilast; oral phosphodiesterase 4 inhibitor (asthma/COPD), GSK | Asthma; Chronic obstructive pulmonary disease |
| PDE4 inhibitors (oral, COPD), GlaxoSmith Kline | GlaxoSmith Kline plc | 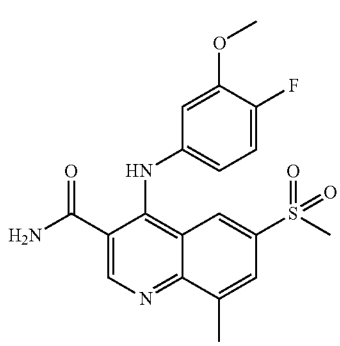 [SMILES: COc1cc(Nc2c(C(N)=O)cnc3c(C)cc(S(C)(=O)=O)cc23)ccc1F] | PDE4 inhibitors (oral, COPD), GlaxoSmithKline | Chronic obstructive pulmonary disease |

TABLE 7-continued

Exemplary Small Molecule PDE4 Inhibitors

| Drug Name | Originator Company | Structure | Other Drug Names | Indications |
|---|---|---|---|---|
| dual PDE4/L-type calcium channel inhibitors (hypertension), University of South Carolina | University of South Carolina | 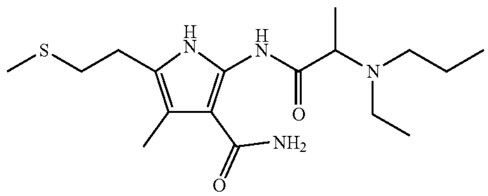 [SMILES: CCCN(CC)C(C)C(=O)Nc1[nH]c(CCSC)c(C)c1C(N)=O] | MNP-001; MS-23; MSP-001; dual PDE4/L-type calcium channel inhibitors (hypertension), University of South Carolina | Hypertension |
| PDE-4 inhibitor (asthma), Crystal Genomics | Crystal Genomics Inc | | PDE-4 inhibitor (asthma), CrystalGenomics | Asthma |
| PDE 4 inhibitors (dermatitis/rheumatoid arthritis), Kyowa Hakko Kirin | Kyowa Hakko Kirin Co Ltd | 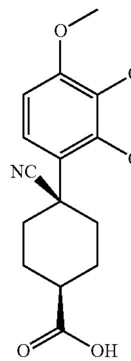 | K-34; KF-66490; PDE 4 inhibitors (dermatitis/rheumatoid arthritis), Kyowa Hakko Kirin | Atopic dermatitis; Rheumatoid arthritis |
| cilomilast (ophthalmic disease), Alcon | GlaxoSmithKline plc | 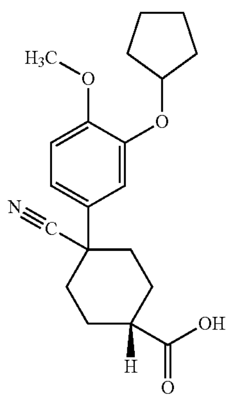 | AL-38583; cilomilast; cilomilast (ophthalmic disease), Alcon; cilomilast (ophthalmic disease), GSK | Allergic conjunctivitis; Ocular disease; Xerophthalmia |
| OCID-2987 | Orchid Pharma Ltd | | OCID-2987; PDE IV inhibitor (inflammation), Orchid; PDE4 inhibitor (inflammation), Orchid; phosphodiesterase IV inhibitor (inflammation), Orchid | Asthma; Chronic obstructive pulmonary disease; Inflammatory disease |
| roflumilast (dermatological, psoriasis/atopic dermatitis), Nycomed | Takeda Pharmaceuticals International GmbH | 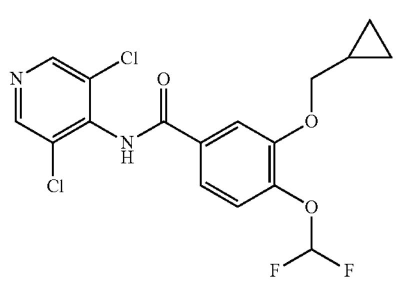 [SMILES: O=C(Nc1c(Cl)cncc1Cl)c1ccc(OC(F)F)c(OCC2CC2)c1] | roflumilast; roflumilast (dermatological, psoriasis/atopic dermatitis), Nycomed | Atopic dermatitis; Psoriasis |

TABLE 7-continued

Exemplary Small Molecule PDE4 Inhibitors

| Drug Name | Originator Company | Structure | Other Drug Names | Indications |
|---|---|---|---|---|
| PDE 4 inhibitor (inflammation), Takeda Pharmaceuticals International | Takeda Pharmaceuticals International GmbH | | PDE 4 inhibitor (inflammation), Takeda Pharmaceuticals International | Inflammatory disease |
| AN-2898 | Anacor Pharmaceuticals Inc | 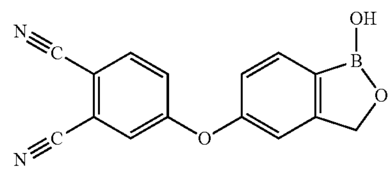 [SMILES: N#Cc1ccc(Oc2ccc3c(c2)COB3O)cc1C#N] | AN-2898; PDE4 inhibitor (topical, psoriasis/atopic dermatitis), Anacor | Atopic dermatitis; Psoriasis |
| dual p38/PDE4 inhibitors (inflammation), c-a-i-r biosciences | c-a-i-r biosciences GmbH | 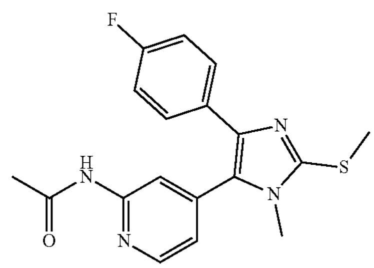 [SMILES: CSc1nc(-c2ccc(F)cc2)c(-c2ccnc(NC(C)=O)c2)n1C] | CBS-3595; dual p38/PDE4 inhibitors (inflammation), c-a-i-r biosciences; dual p38/phosphodiesterase 4 inhibitors (inflammation), c-a-i-r biosciences | Inflammatory disease |
| ASP-9831 | Astellas Pharma Inc | 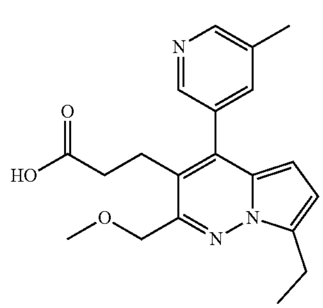 [SMILES: CCc1ccc2c(-c3cncc(C)c3)c(CCC(=O)O)c(COC)nn12] | ASP-9831; PDE4 inhibitor (hepatitis), Astellas; PDE4 inhibitor (non-alcoholic steatohepatitis), Astellas | Non-alcoholic steatohepatitis |
| phosphodiesterase 4 inhibitors (vascular inflammation), VIA Pharmaceuticals | VIA Pharmaceuticals Inc | | phosphodiesterase 4 inhibitors (vascular inflammation), VIA Pharmaceuticals | Vasculitis |
| E-4021 | Eisai Co Ltd | 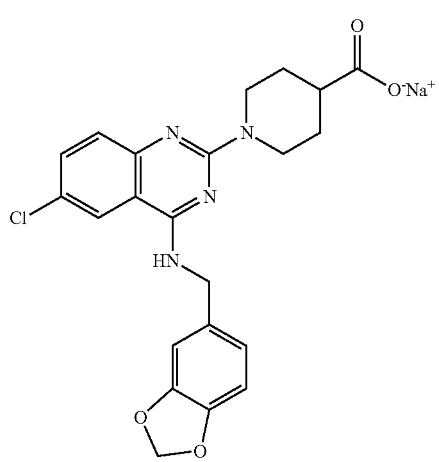 | 4-Piperidinecarboxylic acid, 1-[4-[(1,3-benzodioxol-5-ylmethyl)amino]-6-chloro-2-quinazolinyl]-; E-4021 | Angina; Cardiac failure |

TABLE 7-continued

Exemplary Small Molecule PDE4 Inhibitors

| Drug Name | Originator Company | Structure | Other Drug Names | Indications |
|---|---|---|---|---|
| piclamilast | Rhone-Poulenc SA | 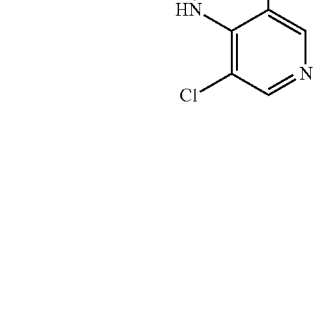 | RP-73401; RPR-73401; piclamilast | Arthritis; Asthma |
| CD-160130 | Curacyte AG | | CD-160130; PDE-4 inhibitor (oral, B-CLL), BlackSwan Pharma; PDE-4 inhibitor (oral, B-CLL), Curacyte Discovery; PDE-4 inhibitor (oral, B-cell chronic lymphocytic leukemia), Curacyte Discovery | Chronic lymphocytic leukemia |
| GSK-256066 (allergic rhinitis, intranasal formulation), GlaxoSmithKline | GlaxoSmithKline plc | 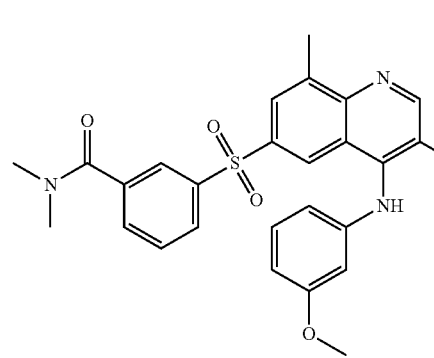 | 256066; 256066 (allergic rhinitis, intranasal formulation), GlaxoSmithKline; GSK-256066; GSK-256066 (allergic rhinitis, intranasal formulation), GlaxoSmithKline | Allergic rhinitis |
| 4AZA-PDE4 | 4 AZA Bioscience NV | | 4AZA-PDE4 | Immune disorder |
| YM-393059 | Astellas Pharma Inc | 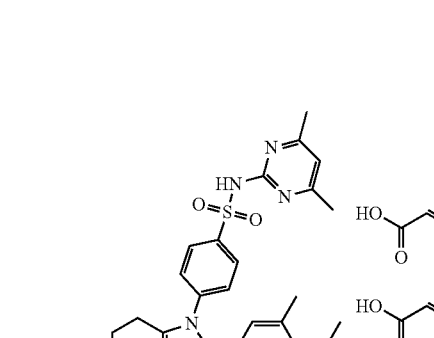 | YM-393059; dual PDE7A/PDE4 inhibitors (immune disorder), Astellas | Immune disorder |

TABLE 7-continued

Exemplary Small Molecule PDE4 Inhibitors

| Drug Name | Originator Company | Structure | Other Drug Names | Indications |
|---|---|---|---|---|
| revamilast | Glenmark Pharmaceuticals Ltd | 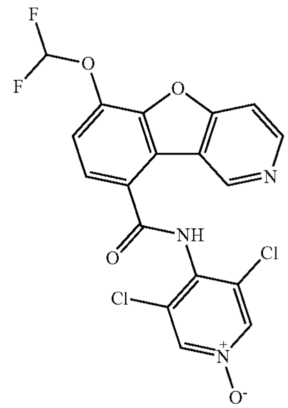 | GRC-4039; PDE 4 inhibitor (inflammation), Glenmark; phosphodiesterase 4 inhibitor (inflammation), Glenmark; revamilast; revamilast (inflammation), Glenmark | Asthma; Inflammatory disease; Multiple sclerosis; Rheumatoid arthritis |
| AN-2728 | Anacor Pharmaceuticals Inc | 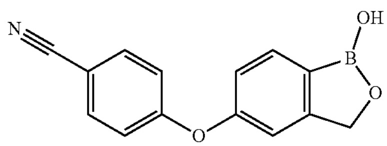 [SMILES: N#Cc1ccc(Oc2ccc3c(c2)COB3O)cc1] | AN-2728; EUCRISA; EUCRISA; Eucrysa; Eucrysa; PF-06930164; crisaborole | |
| MK-0952 | Merck & Co Inc | 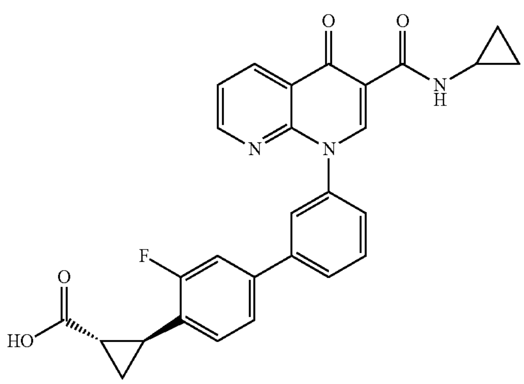 [SMILES: O=C(NC1CC1)c1cn(-c2cccc(-c3ccc([C@H]4C[C@@H]4C(=O)O)c(F)c3)c2)c2ncccc2c1=O] | MK-0952; MK-952; PDE4 inhibitor (AD), Merck & Co; phosphodiesterase type 4 inhibitor (Alzheimer's disease), Merck & Co | Alzheimers disease |
| ibudilast (oral, neuropathic pain/opiate dependence/ neurodegeneration/ TBI/drug dependence), MediciNova | Avigen Inc | | AV-411; MN-166; glial activation inhibitor (oral, neuropathic pain/opiate dependence), Avigen; ibudilast; ibudilast (oral, neuropathic pain/opiate dependence/ alcohol dependence), Avigen; ibudilast (oral, neuropathic pain/ opiate dependence/ neurodegeneration/ TBI/drug dependence), MediciNova; neurodegeneration disease therapy, Avigen; neuropathic pain therapy, Avigen | |
| GP-0203 | Centre National de la Recherche Scientifique (CNRS) | | GP-0203; PDE 4 inhibitor (COPD/asthma), CNRS | Asthma; Chronic obstructive pulmonary disease |

TABLE 7-continued

Exemplary Small Molecule PDE4 Inhibitors

| Drug Name | Originator Company | Structure | Other Drug Names | Indications |
|---|---|---|---|---|
| dual PDE 3/4 inhibitors (oral, asthma), Scottish Biomedical | Scottish Biomedical Ltd | | dual PDE 3/4 inhibitors (oral, asthma), Scottish Biomedical; dual phosphodiesterase 3/4 inhibitors (oral, asthma), Scottish Biomedical | Asthma |
| ELB-526 | elbion AG | | ELB-526; inhaled PDE 4 inhibitor (lung inflammation), elbion; inhaled phosphodiesterase 4 inhibitor (lung inflammation), elbion | Lung inflammation |
| theophylline (SODAS/PharmaZome), Elan | Elan Corp plc | (structure of theophylline) | Teonova; Theolan; once-daily theophylline (SODAS), Elan; theophylline; theophylline (PharmaZome), Elan; theophylline (SODAS), Elan; theophylline (SODAS/PharmaZome), Elan; theophylline, Elan; twice-daily theophylline (PharmaZone), Elan | |
| CHF-6001 | Chiesi Farmaceutici SpA | (structure) | CHF-5480; CHF-6001; PDE 4 inhibitors (inhalant formulation, COPD/asthma), Chiesi | |
| elbimilast | elbion AG | (structure) | AWD-12-353; ELB-353; PDE4 inhibitor, BioTie; PDE4 inhibitor, elbion; elbimilast; ronomilast | |

TABLE 7-continued

Exemplary Small Molecule PDE4 Inhibitors

| Drug Name | Originator Company | Structure | Other Drug Names | Indications |
|---|---|---|---|---|
| AWD-12-281 (topical cream), elbion/Glaxo SmithKline | elbion AG | 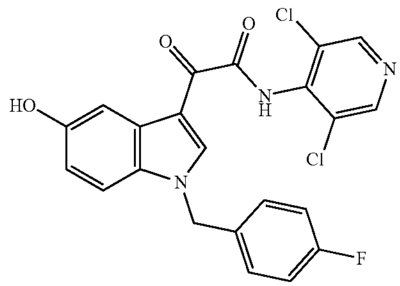 [SMILES: O=C(Nc1c(Cl)cncc1Cl)C(=O)c1cn(Cc2ccc(F)cc2)c2ccc(O)cc12] | 842470; AWD-12-281; AWD-12-281 (dermatitis), elbion/GlaxoSmithKline; AWD-12-281 (topical cream), elbion/GlaxoSmithKline; GW-842470 | Atopic dermatitis |
| ibudilast (multiple sclerosis/ amyotrophic lateral sclerosis), MediciNova | Kyorin Pharmaceutical Co Ltd | 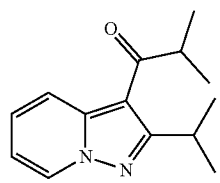 [SMILES: CC(C)C(=O)c1c(C(C)C)nn2ccccc12] | Ketas; MN-166; ibudilast; ibudilast (multiple sclerosis), MediciNova; ibudilast (multiple sclerosis/amyotrophic lateral sclerosis), MediciNova | Neurological disease |
| PDE 4 inhibitors (asthma), Dainippon Sumitomo | Dainippon Pharmaceutical Co Ltd | 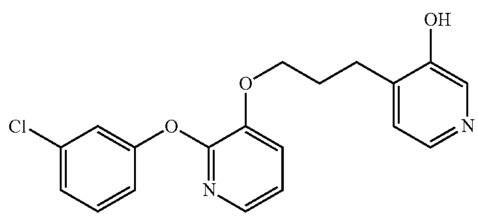 [SMILES: Oc1cnccc1CCCOc1cccnc1Oc1cccc(Cl)c1] | OS-0217; PDE 4 inhibitors (asthma), Dainippon; PDE 4 inhibitors (asthma), Dainippon Sumitomo | Asthma |
| oglemilast | Glenmark Pharmaceuticals Ltd | 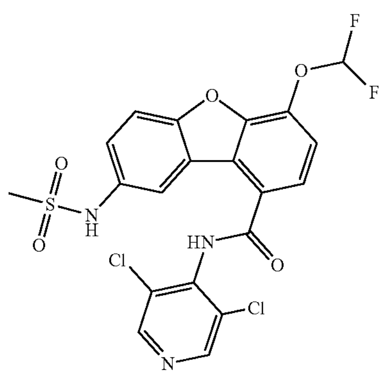 [SMILES: CS(=O)(=O)Nc1ccc2oc3c(OC(F)F)ccc(C(=O)Nc4c(Cl)cncc4Cl)c3c2c1] | GRC-3886; oglemilast; oglemilast (oral, COPD/asthma), Glenmark | Asthma; Chronic obstructive pulmonary disease; Rheumatoid arthritis |
| R-1627 | Roche Holding AG | | R-1627 | Alzheimers disease |
| ND-1510 | Neuro3d SA | | ND-1510 | Depression |
| ND-1251 | Neuro3d SA | | ND-1251 | Depression |
| PDE4 inhibitors (asthma), Purdue | Purdue Pharma LP | | PDE4 inhibitors (asthma), Purdue | Asthma |
| WAY-122331 | Wyeth-Ayerst Pharmaceuticals Inc | 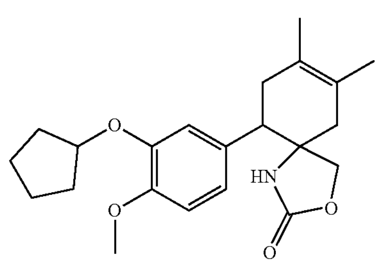 [SMILES: COc1ccc(C2CC(C)=C(C)CC23COC(=O)N3)cc1OC1CCCC1] | WAY-122331 | Cardiac failure |

TABLE 7-continued

Exemplary Small Molecule PDE4 Inhibitors

| Drug Name | Originator Company | Structure | Other Drug Names | Indications |
|---|---|---|---|---|
| GRC-3566 | Glenmark Pharmaceuticals Ltd | | GRC-3566 | Asthma; Chronic obstructive pulmonary disease |
| tofimilast | Pfizer Inc | 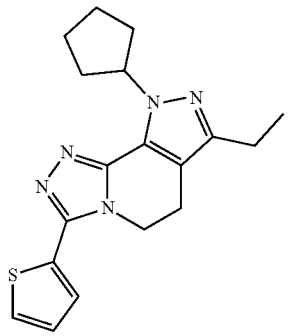 [SMILES: CCc1nn(C2CCCC2)c2c1CCn1c(-c3cccs3)nnc1-2] | CP-325366; tofimilast | Allergy; Respiratory disease |
| BAY-61-9987 | Bayer AG | | BAY-61-9987; low affinity phosphodiesterase 4 inhibitor, Bayer | Chronic obstructive pulmonary disease; Respiratory disease |
| rolipram | Bayer Schering Pharma AG | | ME-3167; ZK-62711; rolipram | Asthma; Depression; HIV infection; Multiple sclerosis; Neurodegenerative disease; Tardive dyskinesia |
| MEM-1414 | Memory Pharmaceuticals Corp | | MEM-1414; PDE 4 inhibitor (Alzheimer's), Memory; PDE 4 inhibitor (Alzheimer's), Memory/Roche; R-1533 | Alzheimers disease; Asthma |
| adenosine A3 antagonists, Novartis | Novartis AG | 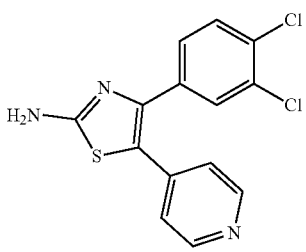 [SMILES: Nc1nc(-c2ccc(Cl)c(Cl)c2)c(-c2ccncc2)s1] | CGH-2466; CGS-2466; adenosine A3 antagonists, Novartis | Asthma |
| RPL-554 | King's College London | 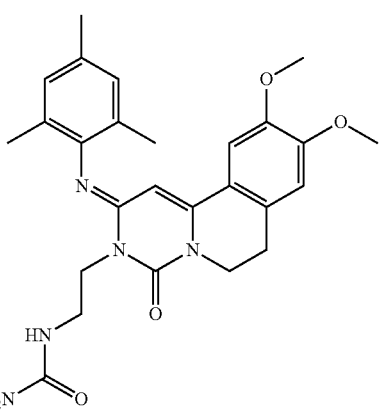 | PDE 3/PDE 4 inhibitors, Kings College; PDE3/4 inhibitors (nasal, respiratory disease), Verona Pharma; PDE3/4 inhibitors (respiratory therapeutics), Rhinopharma; RPL-554; RPL-565; VMX-554; VMX-565; VRP-554; dual MRP4 and PDE3/4 inhibitors (nasal, respiratory disease), Verona Pharma; trequinsin analogs (respiratory therapeutics), Kings College/Vernalis/Rhinopharma | Allergic rhinitis |

TABLE 7-continued

Exemplary Small Molecule PDE4 Inhibitors

| Drug Name | Originator Company | Structure | Other Drug Names | Indications |
|---|---|---|---|---|
| CT-5357 | UCB Celltech | 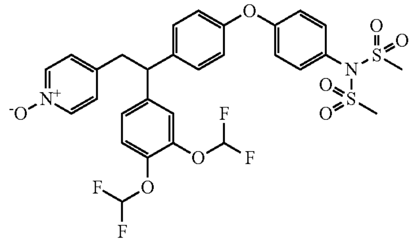 | CT-5357 | Inflammatory disease |
| etazolate | Diaxonhit | 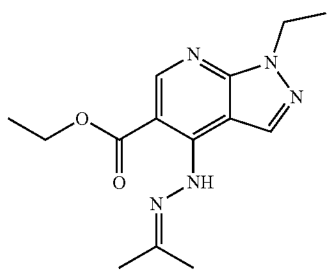 [SMILES: CCOC(=O)c1cnc2c(cnn2CC)c1NN=C(C)C] | EHT-0202; SQ-20009; etazolate; etazolate hydrochloride | Alzheimers disease; Motor neurone disease; Neurodegenerative disease |
| Org-30029 | MSD OSS BV | 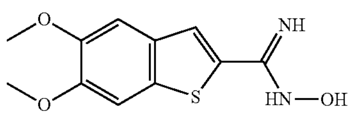 [SMILES: COc1cc2cc(C(=N)NO)sc2cc1OC] | Org-30029 | Asthma; Cardiac failure |
| PDE4 inhibitors (respiratory tract inflammation), Zambon | Zambon Co SpA | 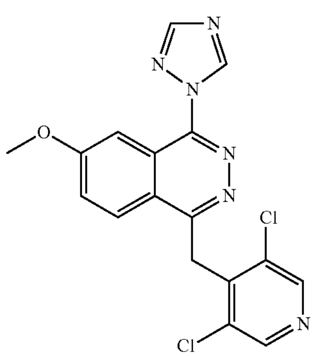 [SMILES: COc1ccc2c(Cc3c(Cl)cncc3Cl)nnc(-n3cncn3)c2c1] | PDE4 inhibitors (respiratory tract inflammation), Zambon; Z-15370; Z-15370A | Respiratory tract inflammation |
| Org-20241 | MSD OSS BV | 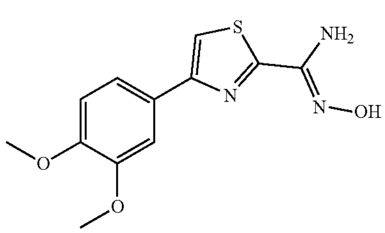 [SMILES: COc1ccc(-c2csc(/C(N)=N/O)n2)cc1OC] | Org-20241 | Asthma |

TABLE 7-continued

Exemplary Small Molecule PDE4 Inhibitors

| Drug Name | Originator Company | Structure | Other Drug Names | Indications |
|---|---|---|---|---|
| PDE3/PDE4 inhibitors (inflammatory diseases), Leiden/Amsterdam Center for Drug Research/Altana | Leiden/Amsterdam Center for Drug Research | 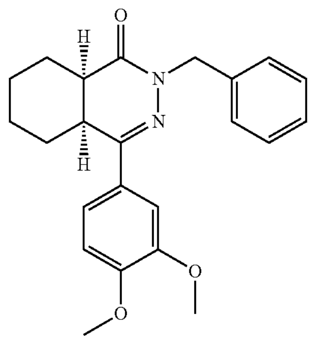 [SMILES: COc1ccc(C2=NN(Cc3ccccc3)C(=O)[C@@H]3CCCC[C@H]23)cc1OC] | PDE3/PDE4 inhibitors (inflammatory diseases), Leiden/Amsterdam Center for Drug Research/Altana; PDE3/PDE4 inhibitors (inflammatory diseases), Leiden/Amsterdam Center for Drug Research/Byk Gulden | Asthma; Rheumatoid arthritis |
| arofylline | Almirall Prodesfarma SA | 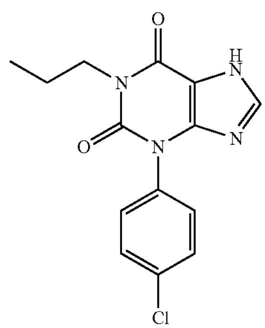 [SMILES: CCCn1c(=O)c2[nH]cnc2n(-c2ccc(Cl)cc2)c1=O] | LAS-31025; arofylline | Asthma; Bronchitis; Chronic obstructive airway disease |
| KW-4490 | Kyowa Hakko Kogyo Co Ltd | 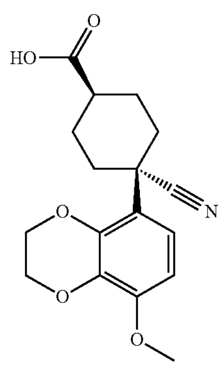 [SMILES: COc1ccc([C@]2(C#N)CC[C@H](C(=O)O)CC2)c2c1OCCO2] | KW-4490 | Asthma |
| HT-0712 | Inflazyme Pharmaceuticals | 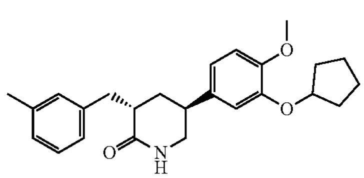 [SMILES: COc1ccc([C@H]2CNC(=O)[C@H](Cc3cccc(C)c3)C2)cc1OC1CCCC1] | HT-0712; IPL-455903; small-molecule PDE4 inhibitors (memory disorders), Inflazyme/Helicon | Amnesia; Cognitive disorder |

TABLE 7-continued

Exemplary Small Molecule PDE4 Inhibitors

| Drug Name | Originator Company | Structure | Other Drug Names | Indications |
|---|---|---|---|---|
| PDE 4 inhibitors (asthma/COPD/ rheumatoid arthritis), Merck Frosst | UCB Celltech | 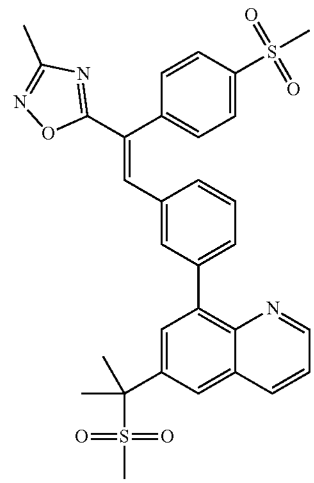 [SMILES: Cc1noc(/C(=C/c2cccc(-c3cc(C(C)(C)S(C)(=O)=O)cc4cccnc34)c2)c2ccc(S(C)(=O)=O)cc2)n1] | CT-2450; CT-2820; CT-3883; CT-5210; L-454560; L-787258; L-791943; L-826141; L-869298; MK-0359; PDE 4 inhibitors (asthma/ COPD/rheumatoid arthritis), Merck Frosst; PDE 4 inhibitors, Celltech/Merck Frosst | Asthma; Chronic obstructive pulmonary disease; Rheumatoid arthritis |
| PDE inhibitors, Vivus | VIVUS Inc | | PDE 3 inhibitors, Vivus; PDE 4 inhibitors, Vivus; PDE inhibitors, Vivus; PDE5 inhibitors, Vivus; erectile dysfunction therapy, Vivus | Erectile dysfunction |
| OX-914 | Inflazyme Pharmaceuticals | | BLX-028914; BLX-914; IPL-4088; IPL-4182; IPL-42 series; IPL-4722; OX-914; PDE4 inhibitors (inflammation), Biolipox; PDE4 inhibitors (inflammation), Inflazyme; PDE4 inhibitors (inflammation), Orexo | Asthma; Chronic obstructive pulmonary disease; Inflammatory disease; Seasonal allergic rhinitis |
| SDZ-PDI-747 | Novartis AG | 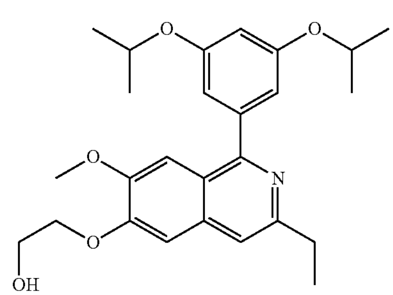 [SMILES: CCc1cc2cc(OCCO)c(OC)cc2c(-c2cc(OC(C)C)cc(OC(C)C)c2)n1] | SDZ-PDI-747 | Atopic dermatitis |
| AP-0679 | The Green Cross Corp | | AP-0679 | Asthma |

TABLE 7-continued

Exemplary Small Molecule PDE4 Inhibitors

| Drug Name | Originator Company | Structure | Other Drug Names | Indications |
|---|---|---|---|---|
| Sch-351591 | UCB Celltech | 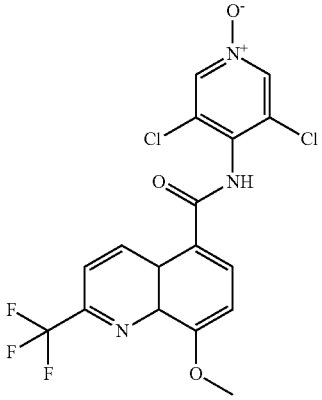 [SMILES: COC1=CC=C(C(=O)Nc2c(Cl)c[n+]([O-])cc2Cl)C2C=CC(C(F)(F)F)=NC12] | D-4396; PDE 4 inhibitors, Schering-Plough/ Celltech; PDE 4 inhibitors, Schering-Plough/Chiroscience; Sch-351591; Sch-365351 | Asthma; Chronic obstructive pulmonary disease; Inflammatory disease |
| TA-7906 | Tanabe Seiyaku Co Lto | 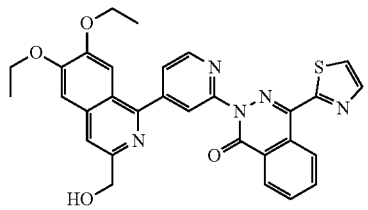 [SMILES: CCOc1cc2cc(CO)nc(-c3ccnc(-n4nc(-c5nccs5)c5ccccc5c4=O)c3)c2cc1OCC] | PDE4 inhibitor (skin disease), Maruho; PDE4 inhibitors (inflammation), Tanabe Seiyaku; T-2585; T-2585.HCl; TA-7906 | Atopic dermatitis; Dermatological disease; Inflammatory disease |
| PDE4/MMP inhibitors, Rhone-Poulenc | Rhone-Poulenc Rorer Inc | 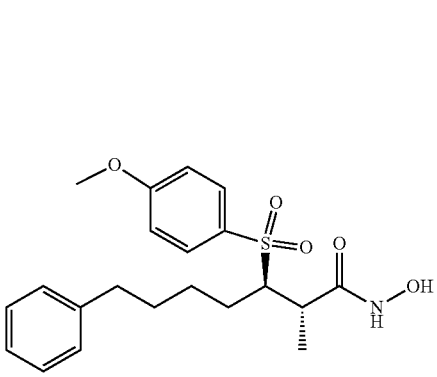 [SMILES: COc1ccc(S(=O)(=O)[C@H](CCCCc2ccccc2)[C@@H](C)C(=O)NO)cc1] | HMR-1571; PDE4/MMP inhibitors, Rhone-Poulenc | Atherosclerosis; Atopic dermatitis; Multiple sclerosis; Psoriasis; Rheumatoid arthritis |
| lirimilast | Bayer AG | 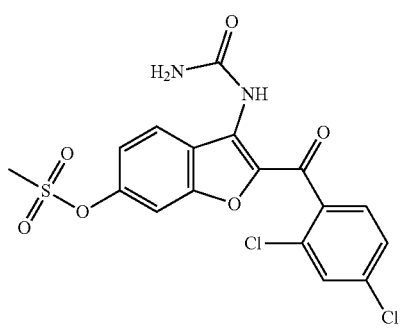 [SMILES: CS(=O)(=O)Oc1ccc2c(NC(N)=O)c(C(=O)c3ccc(Cl)cc3Cl)oc2c1] | BAY-19-8004; lirimilast | Asthma; Chronic obstructive pulmonary disease |
| daxalipram | Bayer Schering Pharma AG | 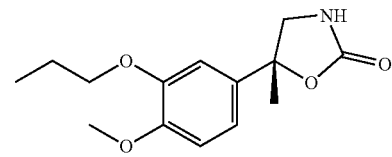 [SMILES: CCCOc1cc([C@]2(C)CNC(=O)O2)ccc1OC] | Mesopram; PDE 4 inhibitor (multiple sclerosis), Schering AG; SH-636; ZK-117137; daxalipram | Multiple sclerosis |

TABLE 7-continued

Exemplary Small Molecule PDE4 Inhibitors

| Drug Name | Originator Company | Structure | Other Drug Names | Indications |
|---|---|---|---|---|
| roflumilast | Takeda GmbH | 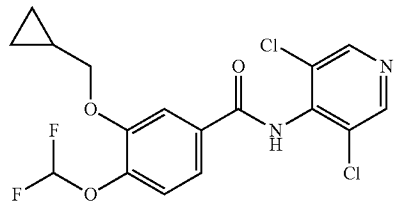 [SMILES: O=C(Nc1c(Cl)cncc1Cl)c1ccc(OC(F)F)c(OCC2CC2)c1] | APTA-2217; B9302-107; BY-217; BYK-20869; Daliresp; Dalveza; Daxas; Libertek; Xevex; roflumilast; roflumist | Non-insulin dependent diabetes; Pulmonary fibrosis |
| PDE 4 inhibitors (asthma), Novartis | Novartis UK Ltd | 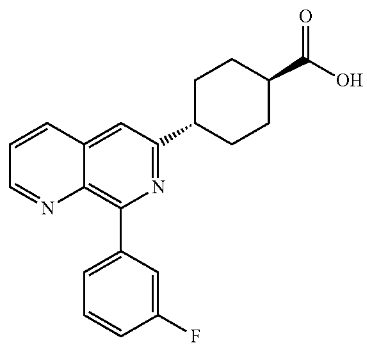 [SMILES: O=C(O)[C@H]1CC[C@H](c2cc3cccnc3c(-c3cccc(F)c3)n2)CC1] | NVP-ABE-171; PDE 4 inhibitors (asthma), Novartis; rolipram analogs, Novartis | Asthma; Chronic obstructive pulmonary disease |
| PDE III/IV inhibitors, Novartis | Novartis Pharma AG | | PDE III/IV inhibitors, Novartis | Asthma; Inflammatory disease |
| SelCIDs, Celgene | Celgene Corp | 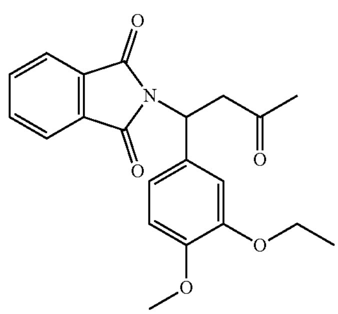 [SMILES: CCOc1cc(C(CC(C)=O)N2C(=O)c3ccccc3C2=O)ccc1OC] | CC-10036; CC-10083; CC-110007; CC-110036; CC-110037; CC-110038; CC-110049; CC-110052; CC-110083; CC-11069; CC-111050; CC-13039; CC-14046; CC-17034; CC-17035; CC-17075; CC-17085; CC-18062; CC-7075;PDE4/TNFalpha inhibitors, Celgene; SelCIDs, Celgene; selective cytokine inhibitory drugs, Celgene | Autoimmune disease; Cancer; Congestive heart failure; Inflammatory disease; Respiratory disease |
| RPR-117658 | Rhone-Poulenc Rorer Ltd | 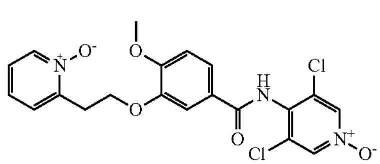 | RPR-117658 | Inflammatory disease |

TABLE 7-continued

Exemplary Small Molecule PDE4 Inhibitors

| Drug Name | Originator Company | Structure | Other Drug Names | Indications |
|---|---|---|---|---|
| AWD-12-281 (inhaled), elbion/Glaxo SmithKline | ASTA Medica AG | 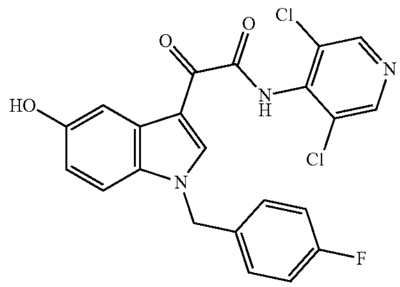 [SMILES: O=C(Nc1c(Cl)cncc1Cl)C(=O)c1cn(Cc2ccc(F)cc2)c2ccc(O)cc12] | 842470; AWD-12-281; AWD-12-281 (COPD), elbion/GlaxoSmithKline; AWD-12-281 (asthma), elbion/GlaxoSmithKline; AWD-12-281 (inhaled), elbion/GlaxoSmithKline; AWD-12-343; GW-842470 | Asthma; Chronic obstructive pulmonary disease |
| 256066 (asthma, COPD, inhalant formulation), GlaxoSmithKline | SmithKline Beecham Pharmaceuticals | 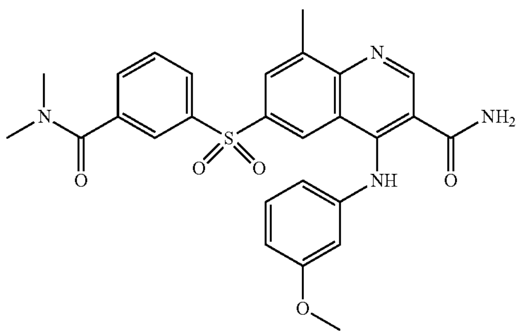 [SMILES: COc1cccc(Nc2c(C(N)=O)cnc3c(C)cc(S(=O)(=O)c4cccc(C(=O)N(C)C)c4)cc23)c1] | 256066; 256066 (asthma, COPD, inhalant formulation), GlaxoSmithKline; GSK-256066; GSK-256066 (asthma, COPD, inhalant formulation), GlaxoSmithKline; PDE 4 inhibitors (inhaled, COPD/asthma/allergic rhinitis), GlaxoSmithKline; SB-207499 analogs, GSK | Asthma; Chronic obstructive pulmonary disease; Inflammatory disease |
| PDE4 inhibitors, Aventis | Aventis Pharma AG | | PDE4 inhibitors, Aventis; PDE4 inhibitors, RPR; PDE4 inhibitors, Rhone-Poulenc Rorer | Autoimmune disease |
| arofylline derivatives, Almirall | Almirall Prodesfarma SA | 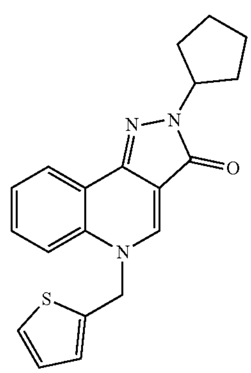 [SMILES: O=c1c2cn(Cc3cccs3)c3ccccc3c-2nn1C1CCCC1] | arofylline derivatives, Almirall | Asthma; Inflammatory disease |
| RPR-132294 | Rhone-Poulenc Rorer Ltd | 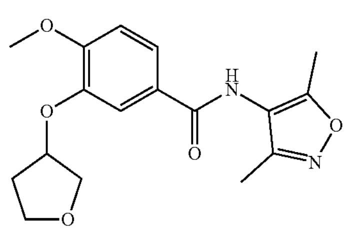 [SMILES: COc1ccc(C(=O)Nc2c(C)noc2C)cc1OC1CCOC1] | RPR-132294; RPR-132703 | Respiratory disease |
| ibudilast eye drops (ocular allergy), MSD Japan/Kyorin | Kyorin Pharmaceutical Co Ltd | 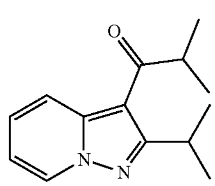 [SMILES: CC(C)C(=O)c1c(C(C)C)nn2ccccc12] | Eyevinal; KC-404; Ketas (ocular); ibudilast; ibudilast eye drops (ocular allergy), Banyu/Kyorin; ibudilast eye drops (ocular allergy), MSD Japan/Kyorin | |

TABLE 7-continued

Exemplary Small Molecule PDE4 Inhibitors

| Drug Name | Originator Company | Structure | Other Drug Names | Indications |
|---|---|---|---|---|
| PDE 4 inhibitors (2), Pfizer | Pfizer Inc | 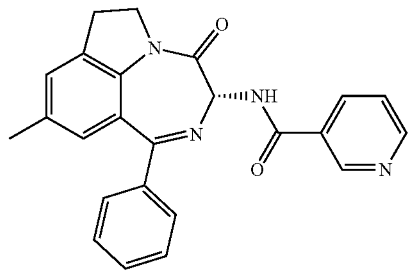 [SMILES: Cc1cc2c3c(c1)C(c1ccccc1)=N[C@@H](NC(=O)c1cccnc1)C(=O)N3CC2] | CI-1018; CI-1044; PD-168787; PD-189659; PD-190036; PD-190749; PDE 4 inhibitors (2), Pfizer | Asthma; Inflammatory disease |
| YM-976 | Yamanouchi Pharmaceutical Co Ltd | 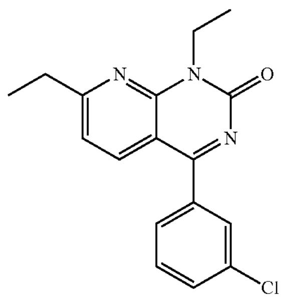 [SMILES: CCc1ccc2c(-c3cccc(Cl)c3)nc(=O)n(CC)c2n1] | PDE IV inhibitors, Yamanouchi; YM-976; phosphodiesterase inhibitors, Yamanouchi | Asthma |
| XT-611 | Kanazawa University | 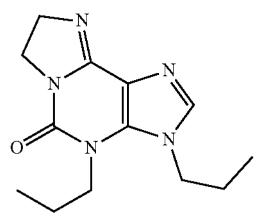 [SMILES: CCCN1C(=O)N2CCN=C2c2ncn(CCC)c21] | PDE IV inhibitor, Kanazawa University; XT-611 | Osteoporosis |
| losartan derivatives, Almirall | Almirall Prodesfarma SA | | losartan derivatives, Almirall | Asthma |
| DWP-205 derivatives, Daewoong | Daewoong Pharmaceutical Co Ltd | 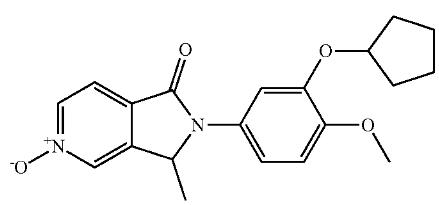 | DWP-205 derivatives, Daewoong; DWP-205297; phosphodiesterase 4 inhibitors, Daewoong | Arthritis; Asthma |
| WAY-126120 | Wyeth-Ayerst Pharmaceuticals Inc | | PDE IV inhibitor, Wyeth-Ayerst; WAY-126120 | Asthma |
| YM-58997 | Yamanouchi Pharmaceutical Co Ltd | 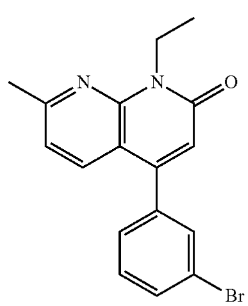 [SMILES: CCn1c(=O)cc(-c2cccc(Br)c2)c2ccc(C)nc21] | YM-58997 | Asthma |

TABLE 7-continued

Exemplary Small Molecule PDE4 Inhibitors

| Drug Name | Originator Company | Structure | Other Drug Names | Indications |
|---|---|---|---|---|
| CP-293321 | Pfizer Inc | | CP-293321 | Inflammatory disease |
| V-11294A | Napp Pharmaceutical Group Ltd | 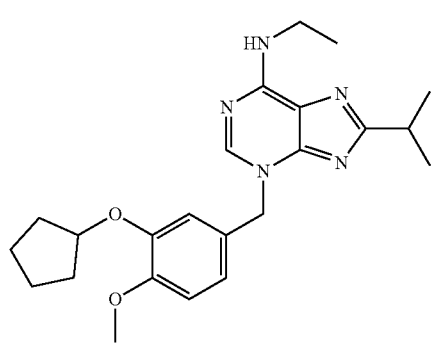 [SMILES: CCNc1ncn(Cc2ccc(OC)c(OC3CCCC3)c2)c2nc(C(C)C)nc1-2] | V-11294A; rolipram derivatives, Napp | Depression; Inflammatory disease |
| CH-3697 | Chiroscience R & D Ltd | | CH-3697 | Asthma |
| CP-353164 | Pfizer Inc | 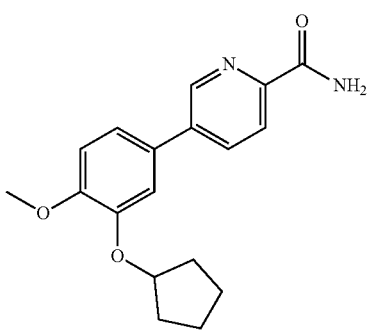 [SMILES: COc1ccc(-c2ccc(C(N)=O)nc2)cc1OC1CCCC1] | CP-353164 | Rheumatoid arthritis |
| atizoram | Pfizer Inc | 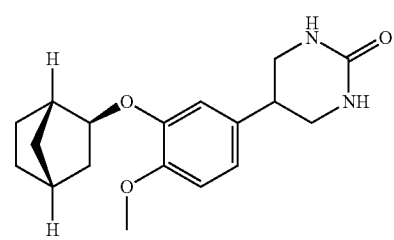 [SMILES: COc1ccc(C2CNC(=O)NC2)cc1O[C@H]1C[C@@H]2CC[C@H]1C2] | CP-80633; atizoram | Asthma; Dermatitis |
| D-4418 | Chiroscience R & D Ltd | 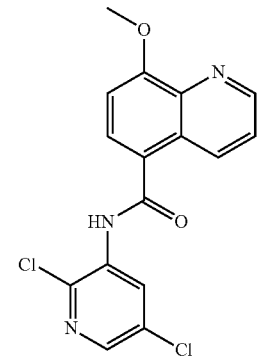 [SMILES: COc1ccc(C(=O)Nc2cc(Cl)cnc2Cl)c2cccnc12] | D-4418 | Asthma; Inflammatory disease |

TABLE 7-continued

Exemplary Small Molecule PDE4 Inhibitors

| Drug Name | Originator Company | Structure | Other Drug Names | Indications |
|---|---|---|---|---|
| RPR-114597 | Rhone-Poulenc Rorer Inc | 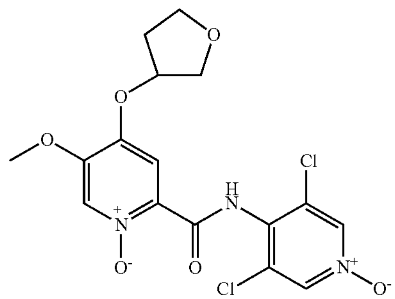 | RPR-114597 | Inflammatory disease |
| PDE 4 inhibitors (inflammation), Eli Lilly | ICOS Corp | | IC-197; IC-246; IC-247; IC-485; IC-86518; IC-86518/IC-86521; IC-86521; PDE 4 inhibitors (inflammation), Eli Lilly; PDE 4 inhibitors, ICOS | Chronic obstructive pulmonary disease; Inflammatory disease; Rheumatoid arthritis |
| PDE 4 inhibitors, Pfizer | Pfizer Inc | 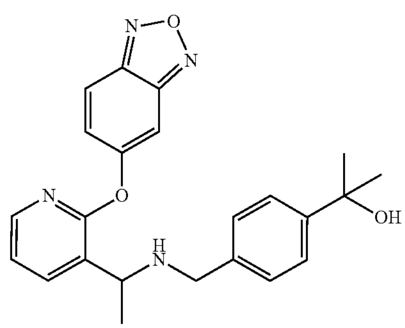 [SMILES: CC(NCc1ccc(C(C)(C)O)cc1)c1cccnc1Oc1ccc2nonc2c1] | BHN; CP-220629; PDE 4 inhibitors, Pfizer; UK-500001 | Asthma; Chronic obstructive pulmonary disease |
| ZL-n-91, Guangzhou Sinogen Pharmaceutical | Guangzhou Sinogen Pharmaceutical Co Ltd | | ZL-n-91, Guangzhou Sinogen Pharmaceutical | |
| D-22888 | ASTA Medica AG | 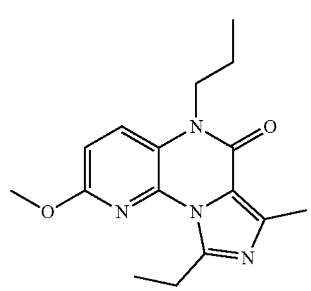 | AWD-12-232; D-22888 | Allergy; Asthma |
| PDE4 inhibitor (diabetic nephropathy), Takeda Pharmaceutical | Takeda Pharmaceutical Co Ltd | | PDE4 inhibitor (diabetic nephropathy), Takeda Pharmaceutical | |

TABLE 7-continued

Exemplary Small Molecule PDE4 Inhibitors

| Drug Name | Originator Company | Structure | Other Drug Names | Indications |
|---|---|---|---|---|
| GW-3600 | GlaxoSmith Kline Inc | 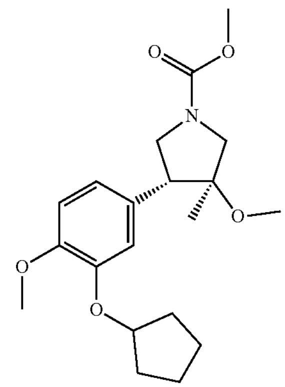 [SMILES: COC(=O)N1C[C@@H](c2ccc(OC)c(OC3CCCC3)c2)[C@](C)(OC)C1] | GW-3600 phosphodiesterase 4 inhibitor, Glaxo | Asthma; Inflammatory disease; Rheumatoid arthritis |

Additional examples of a small molecule that is a PDE4 inhibitor include: Apremilast (CC-10004; CC-110004; CDC-104; Otezla®; lead selCID (2); selCID); CC-1088 (CC-1088; CC-5048; CC-801; CDC-801; lead SelCID (1)); Tetomilast (OPC-6535); KF-19514; PF-06266047; SKF-107806; PDB-093; Tolafentrine (BY-4070); TAK-648; CH-928; CH-673; CH-422; ABI-4 (18F-PF-06445974; Fluorine-18-PF-06445974); roflumilast; Roflumilast N-oxide (APTA-2217; B9302-107; BY-217; BYK-20860; Daliresp®; Dalveza; Daxas®; Libertek; Xevex; roflumist); NVP-ABE-171; BYK-321084; WAY-127093B; NCS-613; SDZ-ISQ-844; GS-5759; Ro-20-1724; Hemay-005; KCA-1490; TVX-2706; Nitraquazone; Filaminast (PDA-641; WAY-PDA-641); LASSBio-596; ASP-3258; TAS-203; AN-2889; AN-5322; AN-6414; AN-6415; Iotamilast (E-6005; RVT-501); GPD-1116; Cipamfylline (BRL-61063; HEP-688); MNP-001; MS-23; MSP-001; K-34; KF-66490; AL-38583 (cilomast); ZL-N-91; Almirall; CDP-840; GSK-356728; Cilomilast (Ariflo; SB-207499); OCID-2987; AN-2898; CBS-3595; ASP-9831 (ASP9831); E-4021 (4-Piperidinecarboxylic acid, 1-[4-[(1,3-benzodioxol-5-ylmethyl)amino]-6-chloro-2-quinazolinyl]); Piclamilast (RP-73401; RPR-73401); CD-160130; GSK-256066 (256066); 4AZA-PDE4; YM-393059; Revamilast (GRC-4039); AN-2728 (PF-06930164; crisaborole (Eucrisa™)); MK-0952 (MK-952); Ibudilast (AV-411; MN-166; KC-404); GP-0203; ELB-526; Theophylline (Tconova); CHF-6001 (CHF-5480); Elbimilast (AWD-12-353; ELB-353; ronomilast); AWD-12-281 (842470); OS-0217; Oglemilast (GRC-3886); R-1627; ND-1510; ND-1251; WAY-122331; GRC-3566; Tofimilast (CP-325366); BAY-61-9987; Rolipram (ME-3167; ZK-62711); MEM-1414 (R-1533); Adenosine A3 antagonists (CGH-2466); RPL-554 (RPL-565; VMX-554; VMX-565; VRP-554; trequinsin analog); CT-5357; Etazolate (EHT-0202; SQ-20009; ctazolate hydrochloride); Z-15370 (Z-15370A); Org-30029; Org-20241; Arofylline (LAS-31025); Arofylline derivatives; KW-4490; HT-0712 (IPL-455903); HT-0712; IPL-455903; CT-2450; CT-2820; CT-3883; CT-5210; L-454560; L-787258; L-791943; L-826141; L-869298; MK-0359; OX-914 (BLX-028914; BLX-914; IPL-4088; IPL-4182; IPL-4722); SDZ-PDI-747; AP-0679; Sch-351591 (D-4396; Sch-365351); TA-7906 (T-2585; TA-7906); HMR-1571; Lirimilast (BAY-19-8004); Daxalipram (Mesopram; SH-636; ZK-117137); SelCIs (CC-10036; CC-10083; CC-110007; CC-110036; CC-110037; CC-110038; CC-110049; CC-110052; CC-110083; CC-11069; CC-111050; CC-13039; CC-14046; CC-17034; CC-17035; CC-17075; CC-17085; CC-18062; CC-7075); RPR-117658; AWD-12-281 (842470; AWD-12-343; GW842470X); 256066 (GSK-256066; SB-207499); RPR-132294 (RPR-132703); CI-1018; CI-1044; PD-168787; PD-189659; PD-190036; PD-190749; YM-976; XT-611; Losartan derivatives; DWP-205 derivatives (DWP-205297); WAY-126120; YM-58997; CP-293321; V-11294A; CH-3697; CP-353164; Atizoram (CP-80633); D-4418; RPR-114597; IC-197; IC-246; IC-247; IC-485; IC-86518; IC-86518/IC-86521; IC-86521; CP-220629; ZL-n-91; D-22888 (AWD-12-232); GW-3600; GSK356278; TPI 1100; BPN14770; and MK-0873. Sec, e.g., Schafter et al. (2014) Cellular Signaling 26 (9): 2016-2029); Gurney et al. (2011) Handb Exp Pharmacol 204:167-192; Spadaccini et al. (2017) Intl J Mol Sciences 18:1276; Bickston et al. (2012) Expert Opinion Invest Drugs 21:12, 1845-1849; Keshavarzian et al. (2007) Expert Opinion Invest Drugs 16:9, 1489-1506.

Additional examples of small molecules that are PDE4 inhibitors are described in, e.g., U.S. Patent Application Publication Nos. 2017/0348311, 20176/0319558, 2016/0213642, 2015/0328187, 2015/0306079, 2015/0272949, 2015/0272936, 2015/0080359, 2015/0051254, 2014/0350035, 2014/0148420, 2014/0121221, 2013/0252928, 2013/0237527, 2013/0225609, 2012/0309726, 2012/0196867, 2012/0088743, 2012/0059031, 2012/0035143, 2012/0028932, 2011/0021478, 2011/0021476, 2010/0234382, 2010/0129363, 2010/0069392, 2010/0056604, 2010/0048616, 2010/0048615, 2009/0099148, 2009/0093503, 2008/0287522, 2008/0255209, 2008/0255186, 2008/0221111, 2007/0232637, 2007/0208181, 2007/0167489, 2006/0269600, 2006/0183764, 2006/0154934, 2006/0094723, 2006/0079540, 2005/0267135, 2005/0234238, 2005/0033521, 2003/0229134, 2003/0220352, 2003/0212112, 2003/0158189, 2003/0069260, 2003/0050329, 2002/0058687, and 2002/0028842. Additional examples of small molecules that are PDE4 inhibitors are known in the art.

Inhibitory Nucleic Acids

In some embodiments, a PDF4 inhibitor can be an inhibitory nucleic acid. In some embodiments, the inhibitory nucleic acid can be an antisense nucleic acid, a ribozyme, and a small interfering RNA (siRNA). Examples of aspects of these different oligonucleotides are described below. Any of the examples of inhibitory nucleic acids that can decrease expression of PDE4 mRNA in a mammalian cell can be synthesized in vitro.

Inhibitory nucleic acids that can decrease the expression of PDE4 mRNA expression in a mammalian cell include antisense nucleic acid molecules, i.e., nucleic acid molecules whose nucleotide sequence is complementary to all or part of an PDE4 mRNA (e.g., complementary to all or a part of any one of SEQ ID NOs: 211-215).

```
Human PDE4 mRNA Transcript Variant 1
                                                            (SEQ ID NO: 211)
   1 cggccgggcg cacccgcggg gccctgggct cgctggcttg cgcgcagctg agcggggtgt
  61 aggttggaag ggccagggcc ccctggggcg caagtgggggg ccggcgccat ggaaccccccg
 121 accgtccccct cggaaaggag cctgtctctg tcactgcccg ggccccggga gggccaggcc
 181 accctgaagc ctcccccgca gcacctgtgg cggcagcctc ggacccccat ccgtatccag
 241 cagcgcggct actccgacag cgcggagcgc gccgagcggg agcggcagcc gcaccggccc
 301 atagagcgcg ccgatgccat ggacaccagc gaccggcccg gcctgcgcac gacccgcatg
 361 tcctggccct cgtccttcca tggcactggc accggcagcg gcggcgcggg cggaggcagc
 421 agcaggcgct cgaggcaga gaatgggccg acaccatctc ctggccgcag cccctggac
 481 tcgcaggcga gcccaggact cgtgctgcac gccggggcgg ccaccagcca gcgccgggag
 541 tccttcctgt accgctcaga cagcgactat gacatgtcac ccaagaccat gtcccggaac
 601 tcatcggtca ccagcgaggc gcacgctgaa gacctcatcg taacaccatt tgctcaggtg
 661 ctggccagcc tccggagcgt ccgtagcaac ttctcactcc tgaccaatgt gcccgttccc
 721 agtaacaagc ggtccccgct gggcggcccc acccctgtct gcaaggccac gctgtcagaa
 781 gaaacgtgtc agcagttggc ccgggagact ctggaggagc tggactggtg tctggagcag
 841 ctggagacca tgcagaccta tcgctctgtc agcgagatgg cctcgcacaa gttcaaaagg
 901 atgttgaacc gtgagctcac acacctgtca gaaatgagca ggtccggaaa ccaggtctca
 961 gagtacattt ccacaacatt cctggacaaa cagaatgaag tggagatccc atcacccacg
1021 atgaaggaac gagaaaaaca gcaagcgccg cgaccaagac cctcccagcc gccccccgccc
1081 cctgtaccac acttacagcc catgtcccaa atcacagggt tgaaaaagtt gatgcatagt
1141 aacagcctga caactctaa cattccccga tttggggtga agaccgatca agaagagctc
1201 ctggcccaag aactggagaa cctgaacaag tggggcctga acatctttttg cgtgtcggat
1261 tacgctggag gccgctcact cacctgcatc atgtacatga tattccagga gcgggacctg
1321 ctgaagaaat tccgcatccc tgtggacacg atggtgacat acatgctgac gctggaggat
1381 cactaccacg ctgacgtggc ctaccataac agcctgcacg cagctgacgt gctgcagtcc
1441 acccacgtac tgctgccac gcctgcacta gatgcagtgt tcacggacct ggagattctc
1501 gccgccctct tcgcggctgc catccacgat gtggatcacc ctggggtctc caaccagttc
1561 ctcatcaaca ccaattcgga gctggcgctc atgtacaacg atgagtcggt gctcgagaat
1621 caccacctgg ccgtgggctt caagctgctg caggaggaca actgcgacat cttccagaac
1681 ctcagcaagc gccagcggca gagcctacgc aagatggtca tcgacatggt gctggccacg
1741 gacatgtcca agcacatgac cctcctggct gacctgaaga ccatggtgga gaccaagaaa
1801 gtgaccagct caggggtcct cctgctagat aactactccg accgcatcca ggtcctccgg
1861 aacatggtgc actgtgccga cctcagcaac cccaccaagc cgctggagct gtaccgccag
1921 tggacagacc gcatcatggc cgagttcttc cagcagggtg accgagagcg cgagcgtggc
1981 atggaaatca gccccatgtg tgacaagcac actgcctccg tggagaagtc tcaggtgggt
2041 tttattgact acattgtgca cccattgtgg gagacctggg cggaccttgt ccacccagat
2101 gcccaggaga tcttggacac tttggaggac aaccgggact ggtactacag cgccatccgg
```

-continued

```
2161 cagagcccat ctccgccacc cgaggaggag tcaaggggc caggccaccc accctgcct
2221 gacaagttcc agtttgagct gacgctggag gaggaagagg aggaagaaat atcaatggcc
2281 cagataccgt gcacagccca agaggcattg actgcgcagg gattgtcagg agtcgaggaa
2341 gctctggatg caaccatagc ctgggaggca tccccggccc aggagtcgtt ggaagttatg
2401 gcacaggaag catccctgga ggccgagctg gaggcagtgt atttgacaca gcaggcacag
2461 tccacaggca gtgcacctgt ggctccggat gagttctcgt cccgggagga attcgtggtt
2521 gctgtaagcc acagcagccc ctctgccctg gctcttcaaa gccccttct ccctgcttgg
2581 aggaccctgt ctgtttcaga gcatgccccg ggcctcccgg gcctcccctc cacggcggcc
2641 gaggtggagg cccaacgaga gcaccaggct gccaagaggg cttgcagtgc ctgcgcaggg
2701 acatttgggg aggacacatc cgcactccca gctcctggtg gcgggggtc aggtggagac
2761 cctacctgat ccccagacct ctgtccctgt tcccctccac tcctcccctc actccctgc
2821 tcccccgacc acctcctcct ctgcctcaaa gactcttgtc ctcttgtccc tcctgagaaa
2881 aaagaaaacg aaaagtgggg ttttttctg ttttcttttt ttccccttc cctgcccc
2941 cacccacggg gccttttttt ggaggtgggg gctggggaat gaggggctga ggtcccggaa
3001 gggatttat ttttttgaat tttaattgta acattttag aaaagaaca aaaaagaaa
3061 aaaaaagaa agaaacacag caactgtaga tgctcctgtt cctggttccc gctttccact
3121 tccaaatccc tcccctcacc ttcccccact gccccccaag ttccaggctc agtcttccag
3181 ccgcctgggg agtctctacc tgggcccaag caggtgtggg gcctccttct gggctttct
3241 tctgaattta gaggatttct agaacgtggt caggaatagc cattctaggc ggggctgggg
3301 ccagggtggg gggcagtcac tgtgggaggt cccagctcca gcccccctct ggtttgctgc
3361 ctcctctccc ctctaaaaaa gtcttccgct tgattttgca caatcccggc gatactcctg
3421 gcgatactga ctagaaagtc agggagctgg gggagctgtt cactttagga tacggggtg
3481 cctcctccac tctccatccc ctttccctc cactttgggt tcactttgaa ttttctccgt
3601 tttttggggc agtggctctg atccactcac cccccgccc cccgcccac ttctagctgc
3661 ttctcctctt gtttctgcct taataattcc cacggccaca ggcaaggggg ttgcagtggc
3721 cgcctgcacc ttggatgagg cagggccagg cgcccagaac cccatcctg gccgcacccc
3781 cctttccagg gtcctccgga ccccaccttc cacactctga tcacagcccc cctaccttt
3841 gccctaggag gaagcaataa tggtgtatac cctcattctc attcctgggc agcccttcct
3901 tccaccctgg caccaaaata atttctcctc catccgtacc ttgcctagcc tctccctctc
3961 ccccagctag tccctgagca atacggcaga cagatgcaag accatttttc tccaagccat
4021 gggggactgt ttggaaggaa agcccctct ctccctcctc ccctcgccct cggcctggtt
4081 ctgcagctgg accgacctca ttcatcgcct gccccctacc caattctgag cacacggtac
4141 tgtagccccc agttcctccc tagccttcca tccctctgtc cacccaggg ggaggtaacc
4201 ccgcactcac actcccttga tgctgtctgt acagggttca tattttgtag cgaaagtcgt
4261 ttttgtccca gccggcgatc ggagtgggcc ttttctttct ttttgttcat tctttacctt
4321 ttttctttt ctttctttct tttttgtaca tactgtaagg ttggtttgta aattattcta
4381 cggaggcaaa aagggaaaat aaaaacttgc ccttccctgg ctgacccagt cgggaaggta
4441 gggaaggagg tctcccgttg ggagagtctc tgttcctgct gtattataca aactgtacca
4501 tagtcctggg aaaagggtgg actcaccgct gttgttttat gggaagtcgt gtcatcctag
4561 gggttggggc tgggcagagc ctgtcccctc cccccttctc caggagccag ggggtgactg
```

-continued

```
4621 gagagacaga cccacccca agcagggctc ctctccccag ggtgagcaca ggacctctgt 4681 aagctgcttg tgtattgtcc actttgacga tcagtcattc ggtccgttga tcaataatcc 4741 ttcgatcttg tctccaatta aaccgaggct ttcaccgata aaaaaaaaaa aaaa
```

Human PDE4 mRNA Transcript Variant 2

(SEQ ID NO: 212)

```
   1 atggcgcggc cgcgcggcct aggccgcatc ccggagctgc aactggtggc cttcccggtg 61 gcggtggcgg ctgaggacga ggcgttcctg cccgagcccc tggccccgcg cgcgccccgc 121 cgcccgcgtt cgccgccctc ctcgccgtc ttcttcgcca gcccgtcccc aactttccgc 181 agacgccttc ggcttctccg cagctgccag gatttgggcc gccaggcttg ggctggggct 241 ggcttcgagg cagagaatgg gccgacacca tctcctggcc gcagcccct ggactcgcag 301 gcgagcccag gactcgtgct gcacgccggg gcggccacca gccagcgccg ggagtccttc 361 ctgtaccgct cagacagcga ctatgacatg tcacccaaga ccatgtcccg gaactcatcg 421 gtcaccagcg aggcgcacgc tgaagacctc atcgtaacac catttgctca ggtgctggcc 481 agcctccgga gcgtccgtag caacttctca ctcctgacca atgtgcccgt tcccagtaac 541 aagcggtccc cgctgggcgg ccccacccct gtctgcaagg ccacgctgtc agaagaaacg 601 tgtcagcagt tggcccggga gactctggag gagctggact ggtgtctgga gcagctggag 661 accatgcaga cctatcgctc tgtcagcgag atggcctcgc acaagttcaa aaggatgttg 721 aaccgtgagc tcacacacct gtcagaaatg agcaggtccg aaaccaggt ctcagagtac 781 atttccacaa cattcctgga caaacagaat gaagtggaga tcccatcacc cacgatgaag 841 gaacgagaaa acagcaagc gccgcgacca agacccctcc agccgccccc gccccctgta 901 ccacacttac agcccatgtc ccaaatcaca gggttgaaaa agttgatgca tagtaacagc 961 ctgaacaact ctaacattcc ccgatttggg gtgaagaccg atcaagaaga gctcctggcc 1021 caagaactgg agaacctgaa caagtggggc ctgaacatct tttgcgtgtc ggattacgct 1081 ggaggccgct cactcacctg catcatgtac atgatattcc aggagcggga cctgctgaag 1141 aaattccgca tccctgtgga cacgatggtg acatacatgc tgacgctgga ggatcactac 1201 cacgctgacg tggcctacca taacagcctg cacgcagctg acgtgctgca gtccacccac 1261 gtactgctgg ccacgcctgc actagatgca gtgttcacgg acctggagat ctcgccgcc 1321 ctcttcgcgg ctgccatcca cgatgtggat caccctgggg tctccaacca gttcctcatc 1381 aacaccaatt cggagctggc gctcatgtac aacgatgagt cggtgctcga aatcaccac 1441 ctggccgtgg gcttcaagct gctgcaggag acaactgcg acatcttcca gaacctcagc 1501 aagcgccagc ggcagagcct acgcaagatg gtcatcgaca tggtgctggc cacggacatg 1561 tccaagcaca tgaccctcct ggctgacctg aagaccatgg tggagaccaa gaaagtgacc 1621 agctcagggg tcctcctgct agataactac tccgaccgca tccaggtcct ccggaacatg 1681 gtgcactgtg ccgacctcag caaccccacc aagccgctgg agctgtaccg ccagtggaca 1741 gaccgcatca tggccgagtt cttccagcag ggtgaccgag agcgcgagcg tggcatggaa 1801 atcagcccca tgtgtgacaa gcacactgcc tccgtggaga agtctcaggt gggtttattt 1861 gactacattt gcacccatt gtgggagacc tggcgggacc ttgtccaccc agatgcccag 1921 gagatcttgg acactttgga ggacaaccgg gactggtact acagcgccat ccggcagagc 1981 ccatctccgc cacccgagga ggagtcaagg gggccaggcc acccacccct gcctgacaag 2041 ttccagtttg agctgacgct ggaggaggaa gaggaggaag aaatatcaat ggcccagata 2101 ccgtgcacag cccaagaggc attgactgcg cagggattgt caggagtcga ggaagctctg 2161 gatgcaacca tagcctggga ggcatccccg gcccaggagt cgttggaagt tatggcacag
```

-continued

```
2221 gaagcatccc tggaggccga gctggaggca gtgtatttga cacagcaggc acagtccaca
2281 ggcagtgcac ctgtggctcc ggatgagttc tcgtcccggg aggaattcgt ggttgctgta
2341 agccacagca gcccctctgc cctggctctt caaagccccc ttctccctgc ttggaggacc
2401 ctgtctgttt cagagcatgc cccgggcctc ccgggcctcc cctccacggc ggccgaggtg
2461 gaggcccaac gagagcacca ggctgccaag agggcttgca gtgcctgcgc agggacattt
2521 gggaggaca catccgcact cccagctcct ggtggcgggg ggtcaggtgg agaccctacc
2581 tgatcccag acctctgtcc ctgttcccct ccactcctcc cctcactccc ctgctccccc
2641 gaccacctcc tcctctgcct caaagactct tgtcctcttg tccctcctga gaaaaagaa
2701 aacgaaaagt ggggtttttt tctgttttct ttttttcccc tttccccctg cccccaccca
2761 cggggccttt ttttggaggt gggggctggg gaatgagggg ctgaggtccc ggaagggatt
2821 ttattttttt gaattttaat tgtaacattt ttagaaaaag aacaaaaaaa gaaaaaaaa
2881 agaaagaaac acagcaactg tagatgctcc tgttcctggt tcccgctttc cacttccaaa
2941 tccctcccct caccttcccc cactgccccc caagttccag gctcagtctt ccagccgcct
3001 ggggagtctc tacctgggcc caagcaggtg tggggcctcc ttctgggctt ttcttctgaa
3061 tttagaggat ttctagaacg tggtcaggaa tagccattct aggcggggct ggggccaggg
3121 tgggggggcag tcactgtggg aggtcccagc tccagccccc ctctggtttg ctgcctcctc
3181 tcccctctaa aaaagtcttc cgcttgattt tgcacaatcc cggcgatact cctggcgata
3241 ctgactagaa agtcagggag ctgggggagc tgttcacttt aggatacggg ggtggtatgg
3301 aagggagcgt tcacaccgcc agcctcgggc ctgggatttg aggagggccc tagacctcct
3361 ccactctcca tcccccttcc cttccacttt gggttcactt tgaattttct ccgttttttg
3421 gggcagtggc tctgatccac tcaccccccc gcccccgcc ccacttctag ctgcttctcc
3481 tcttgtttct gccttaataa ttcccacggc cacaggcaag ggggttgcag tggccgcctg
3541 caccttggat gaggcagggc caggcgccca gaacccccat cctggccgca ccccccttc
3601 cagggtcctc cggaccccac cttccacact ctgatcacag ccccctacc ttttgcccta
3661 ggaggaagca ataatggtgt ataccctcat tctcattcct gggcagccct tccttccacc
3721 ctggcaccaa aataatttct cctccatccg taccttgcct agcctctccc tctcccccag
3781 ctagtccctg agcaatacgg cagacagatg caagaccatt tttctccaag ccatggggga
3841 ctgtttggaa ggaaagcccc ctctctccct cctcccctcg ccctcggcct ggttctgcag
3901 ctggaccgac ctcattcatc gcctgccccc tacccaattc tgagcacacg gtactgtagc
3961 ccccagttcc tccctagcct tccatccctc tgtccacccc aggggaggt aaccccgcac
4021 tcacactccc ttgatgctgt ctgtacaggg ttcatatttt gtagcgaaag tcgttttttgt
4081 cccagccggc gatcggagtg ggccttttct ttcttttttgt tcattcttta cctttttttc
4141 ttttctttct ttcttttttg tacatactgt aaggttggtt tgtaaattat tctacggagg
4201 caaaagggaa aaataaaaac ttgcccttcc ctggctgacc cagtcgggaa ggtagggaag
4261 gaggtctccc gttgggagag tctctgttcc tgctgtatta tacaaactgt accatagtcc
4321 tgggaaaagg gtggactcac cgctgttgtt ttatgggaag tcgtgtcatc ctagggggttg
4381 gggctgggca gagcctgtcc cctccccct tctccaggag ccaggggtg actgagaga
4441 cagacccacc cccaagcagg gctcctctcc ccagggtgag cacaggacct ctgtaagctg
4501 cttgtgtatt gtccactttg acgatcagtc attcggtccg ttgatcaata atccttcgat
4561 cttgtctcca attaaaccga ggctttcacc gataaaaaaa aaaaaaaa
```

-continued

Human PDE4 mRNA Transcript Variant 3

(SEQ ID NO: 213)

```
   1 atgcgctccg gtgcagcgcc ccgggcccgg ccccggcccc ctgccctggc actgccccccc
  61 acgggccccg agtccctgac ccacttcccc ttcagcgatg aggacacccg tcggcaccct
 121 ccgggcagat ctgtcagctt cgaggcagag aatgggccga caccatctcc tggccgcagc
 181 cccctggact cgcaggcgag cccaggactc gtgctgcacg ccggggcggc caccagccag
 241 cgccgggagt ccttcctgta ccgctcagac agcgactatg acatgtcacc caagaccatg
 301 tcccggaact catcggtcac cagcgaggcg cacgctgaag acctcatcgt aacaccattt
 361 gctcaggtgc tggccagcct ccggagcgtc cgtagcaact tctcactcct gaccaatgtg
 421 cccgttccca gtaacaagcg gtccccgctg ggcggcccca cccctgtctg caaggccacg
 481 ctgtcagaag aaacgtgtca gcagttggcc cgggagactc tggaggagct ggactggtgt
 541 ctggagcagc tggagaccat gcagacctat cgctctgtca gcgagatggc ctcgcacaag
 601 ttcaaaagga tgttgaaccg tgagctcaca cacctgtcag aaatgagcag gtccggaaac
 661 caggtctcag agtacatttc cacaacattc ctggacaaac agaatgaagt ggagatccca
 721 tcacccacga tgaaggaacg agaaaaacag caagcgccgc gaccaagacc ctcccagccg
 781 cccccgcccc ctgtaccaca cttacagccc atgtcccaaa tcacagggtt gaaaagttg
 841 atgcatagta acagcctgaa caactctaac attccccgat ttggggtgaa gaccgatcaa
 901 gaagagctcc tggcccaaga actggagaac ctgaacaagt ggggcctgaa catcttttgc
 961 gtgtcggatt acgctggagg ccgctcactc acctgcatca tgtacatgat attccaggag
1021 cgggacctgc tgaagaaatt ccgcatccct gtggacacga tggtgacata catgctgacg
1081 ctggaggatc actaccacgc tgacgtggcc taccataaca gcctgcacgc agctgacgtg
1141 ctgcagtcca cccacgtact gctggccacg cctgcactag atgcagtgtt cacggacctg
1201 gagattctcg ccgccctctt cgcggctgcc atccacgatg tggatcaccc tggggtctcc
1261 aaccagttcc tcatcaacac caattcggag ctggcgctca gtgtacaacga tgagtcggtg
1321 ctcgagaatc accacctggc cgtgggcttc aagctgctgc aggaggacaa ctgcgacatc
1381 ttccagaacc tcagcaagcg ccagcggcag agcctacgca agatggtcat cgacatggtg
1441 ctggccacgg acatgtccaa gcacatgacc ctcctggctg acctgaagac catggtggag
1501 accaagaaag tgaccagctc aggggtcctc ctgctagata actactccga ccgcatccag
1561 gtcctccgga acatggtgca ctgtgccgac ctcagcaacc ccaccaagcc gctggagctg
1621 taccgccagt ggacagaccg catcatggcc gagttcttcc agcagggtga ccgagagcgc
1681 gagcgtggca tggaaatcag ccccatgtgt gacaagcaca ctgcctccgt ggagaagtct
1741 caggtggggt ttattgacta cattgtgcac ccattgtggg agacctgggc ggaccttgtc
1801 cacccagatg cccaggagat cttggacact ttggaggaca accgggactg gtactacagc
1861 gccatccggc agagcccatc tccgccaccc gaggaggagt caaggggcc aggccaccca
1921 cccctgcctg acaagttcca gtttgagctg acgctggagg aggaagagga ggaagaaata
1981 tcaatggccc agataccgtg cacagcccaa gaggcattga ctgcgcaggg attgtcagga
2041 gtcgaggaag ctctggatgc aaccatagcc tgggaggcat ccccggccca ggagtcgttg
2101 gaagttatgg cacaggaagc atccctggag gccgagctgg aggcagtgta tttgacacag
2161 caggcacagt ccacaggcag tgcacctgtg gctccggatg agttctcgtc ccgggaggaa
2221 ttcgtggttg ctgtaagcca cagcagcccc tctgccctgg ctcttcaaag cccccttctc
2281 cctgcttgga ggaccctgtc tgtttcagag catgccccgg gctcccgggg cctcccctcc
2341 acggcggccg aggtggaggc ccaacgagag caccaggctg ccaagagggc ttgcagtgcc
```

```
2401 tgcgcaggga catttgggga ggacacatcc gcactcccag ctcctggtgg cgggggtca
2461 ggtggagacc ctacctgatc cccagacctc tgtccctgtt ccctccact cctccctca
2521 ctcccctgct cccccgacca cctcctcctc tgcctcaaag actcttgtcc tcttgtccct
2581 cctgagaaaa aagaaaacga aaagtggggt ttttttctgt tttcttttt tcccctttcc
2641 ccctgccccc acccacgggg cctttttttg gaggtggggg ctgggaatg aggggctgag
2701 gtcccggaag ggattttatt tftttgaatt ttaattgtaa cattttaga aaagaacaa
2761 aaaagaaaa aaaaagaaa gaaacacagc aactgtagat gctcctgttc ctggttcccg
2821 ctttccactt ccaaatccct ccctcacct tccccactg ccccaagt tccaggctca
2881 gtcttccagc cgcctgggga gtctctacct gggcccaagc aggtgtgggg cctccttctg
2941 ggcttttctt ctgaatttag aggatttcta gaacgtggtc aggaatagcc attctaggcg
3001 gggctgggggc cagggtgggg ggcagtcact gtgggaggtc ccagctccag ccccctctg
3061 gtttgctgcc tcctctcccc tctaaaaaag tcttccgctt gattttgcac aatcccggcg
3121 atactcctgg cgatactgac tagaaagtca gggagctggg ggagctgttc actttaggat
3181 acggggtgg tatggaaggg agcgttcaca ccgccagcct cgggcctggg atttgaggag
3241 ggccctagac ctcctccact ctccatcccc ttttccttcc actttgggtt cactttgaat
3301 tttctccgtt ttttgggca gtggctctga tccactcacc ccccgcccc ccgccccact
3361 tctagctgct tctcctcttg tttctgcctt aataattccc acggcacag gcaagggggt
3421 tgcagtggcc gcctgcacct tggatgaggc agggccaggc gcccagaacc cccatcctgg
3481 ccgcaccccc attccaggg tcctccggac cccaccttcc acactctgat cacagccccc
3541 ctacctttg ccctaggagg aagcaataat ggtgtatacc ctcattctca ttcctgggca
3601 gcccttcctt ccaccctggc accaaaataa tttctcctcc atccgtacct tgcctagcct
3661 ctccctctcc cccagctagt ccctgagcaa tacggcagac agatgcaaga ccatttttct
3721 ccaagccatg ggggactgtt tggaaggaaa gcccctctc tccctcctcc cctcgccctc
3781 ggcctggttc tgcagctgga ccgacctcat tcatcgcctg cccctaccc aattctgagc
3841 acacggtact gtagccccca gttcctccct agccttccat ccctctgtcc accccagggg
3901 gaggtaaccc cgcactcaca ctcccttgat gctgtctgta cagggttcat attttgtagc
3961 gaaagtcgtt tttgtcccag ccggcgatcg gagtgggcct tttctttctt tttgttcatt
4021 ctttaccttt ttttctttc tttattctt ttttgtacat actgtaaggt tggtttgtaa
4081 attattctac ggaggcaaaa agggaaaata aaaacttgcc cttccctggc tgacccagtc
4141 gggaaggtag ggaaggaggt ctcccgttgg gagagtctct gttcctgctg tattatacaa
4201 actgtaccat agtcctggga aaaggtgga ctcaccgctg ttgttttatg ggaagtcgtg
4261 tcatcctagg ggttgggggct gggcagagcc tgtcccctcc cccttctcc aggagccagg
4321 gggtgactga agagacagac ccaccccccaa gcagggctcc tctccccagg gtgagcacag
4381 gacctctgta agctgcttgt gtattgtcca ctttgacgat cagtcattcg gtccgttgat
4441 caataatcct tcgatcttgt ctccaattaa accgaggctt tcaccgataa aaaaaaaaa
4501 aaa
```

Human PDE4 mRNA Transcript Variant 4

(SEQ ID NO: 214)

```
  1 tccgcagcct cctcctggga cccttgccct gcccccctcc catgggcacg gacccccac
 61 cgcctccacc cactgccgcg ggggggcccg ttggggcccca gggctggcgg gccatgtaac
121 cagggctgct gctgggagcg cggaggggaa gggagccccc agccctgctg ggccggccca
```

-continued

```
 181 ggcccctccg cggctccccc ttccactacc cacctgcccg gcaccccctc cccagtggtt
 241 gttaacccct ggactcccca agcccagcct ctgtgtgcag cagccccagg cgggctaagt
 301 ctccaagatg cccttggtgg atttcttctg cgagacctgc tctaagcctt ggctggtggg
 361 ctggtgggac cagttcaaaa ggatgttgaa ccgtgagctc acacacctgt cagaaatgag
 421 caggtccgga aaccaggtct cagagtacat ttccacaaca ttcctggaca aacagaatga
 481 agtggagatc ccatcaccca cgatgaagga acgagaaaaa cagcaagcgc gcgaccaag
 541 accctcccag ccgcccccgc cccctgtacc acacttacag cccatgtccc aaatcacagg
 601 gttgaaaaag ttgatgcata gtaacagcct gaacaactct aacattcccc gatttggggt
 661 gaagaccgat caagaagagc tcctggccca agaactggaa aacctgaaca agtggggcct
 721 gaacatcttt tgcgtgtcgg attacgctgg aggccgctca ctcacctgca tcatgtacat
 781 gatattccag gagcgggacc tgctgaagaa attccgcatc cctgtggaca cgatggtgac
 841 atacatgctg acgctggagg atcactacca cgctgacgtg gcctaccata acagcctgca
 901 cgcagctgac gtgctgcagt ccacccacgt actgctggcc acgcctgcac tagatgcagt
 961 gttcacggac ctggagattc tcgccgccct cttcgcggct gccatccacg atgtggatca
1021 ccctggggtc tccaaccagt tcctcatcaa caccaattcg gagctggcgc tcatgtacaa
1081 cgatgagtcg gtgctcgaga atcaccacct ggccgtgggc ttcaagctgc tgcaggagga
1141 caactgcgac atcttccaga acctcagcaa gcgccagcgg cagagcctac gcaagatggt
1201 catcgacatg gtgctggcca cggacatgtc caagcacatg accctcctgg ctgacctgaa
1261 gaccatggtg gagaccaaga aagtgaccag ctcaggggtc ctcctgctag ataactactc
1321 cgaccgcatc caggtcctcc ggaacatggt gcactgtgcc gacctcagca ccccaccaa
1381 gccgctggga ctgtaccgcc agtggacaga ccgcatcatg gccgagttct tccagcaggg
1441 tgaccgagag cgcgagcgtg gcatggaaat cagccccatg tgtgacaagc acactgcctc
1501 cgtggagaag tctcaggtgg gttttattga ctacattgtg cacccattgt gggagacctg
1561 ggcggacctt gtccacccag atgcccagga gatcttggac actttggagg acaaccggga
1621 ctggtactac agcgccatcc ggcagagccc atctccgcca cccgaggagg agtcaagggg
1681 gccaggccac ccaccctgc ctgacaagtt ccagtttgag ctgacgctgg aggaggaaga
1741 ggaggaagaa atatcaatgg cccagatacc gtgcacagcc caagaggcat tgactgcgca
1801 gggattgtca ggagtcgagg aagctctgga tgcaaccata gcctgggagg catccccggc
1861 ccaggagtcg ttggaagtta tggcacagga agcatccctg gaggccgagc tggaggcagt
1921 gtatttgaca cagcaggcac agtccacagg cagtgcacct gtggctccgg atgagttctc
1981 gtcccgggag gaattcgtgg ttgctgtaag ccacagcagc ccctctgccc tggctcttca
2041 aagcccccctt ctccctgctt ggaggaccct gtctgtttca gagcatgccc cgggcctccc
2101 gggcctcccc tccacggcgg ccgaggtgga ggcccaacga gagcaccagg ctgccaagag
2161 ggcttgcagt gcctgcgcag ggacatttgg ggaggacaca tccgcactcc cagctcctgg
2221 tggcgggggg tcaggtggag accctacctg atccccagac ctctgtccct gttccctcc
2281 actcctcccc tcactcccct gctccccga ccacctcctc ctctgcctca aagactcttg
2341 tcctcttgtc cctcctgaga aaaagaaaa cgaaagtgg ggttttttc tgttttcttt
2401 ttttccccctt tccccctgcc cccacccacg gggcttttt ttggaggtgg gggctgggga
2461 atgaggggct gaggtccggg aagggattt attttttga attttaattg taacatttt
2521 agaaaaagaa caaaaaaaga aaaaaaaag aaagaaacac agcaactgta gatgctcctg
2581 ttcctggttc ccgctttcca cttccaaatc cctcccctca ccttccccca ctgcccccca
```

```
2641 agttccaggc tcagtcttcc agccgcctgg ggagtctcta cctgggccca agcaggtgtg
2701 gggcctcctt ctgggctttt cttctgaatt tagaggattc ctagaacgtg gtcaggaata
2761 gccattctag gcggggctgg ggccagggtg gggggcagtc actgtgggag gtcccagctc
2821 cagccccct ctggtttgct gcctcctctc ccctctaaaa aagtcttccg cttgattttg
2881 cacaatcccg gcgatactcc tggcgatact gactagaaag tcagggagct gggggagctg
2941 ttcactttag gatacggggg tggtatggaa gggagcgttc acaccgccag cctcgggcct
3001 gggatttgag gagggcccta gacctcctcc actctccatc cccttcccct tccactttgg
3061 gttcactttg aattttctcc gtataggg gcagtggctc tgatccactc acccccgc
3121 cccccgcccc acttctagct gcttctcctc ttgtttctgc cttaataatt cccacggcca
3181 caggcaaggg ggttgcagtg gccgcctgca ccttggatga ggcagggcca ggcgcccaga
3241 accccatcc tggccgcacc cccctttcca gggtcctccg gaccccacct tccacactct
3301 gatcacagcc cccctacctt ttgccctagg aggaagcaat aatggtgtat accctcattc
3361 tcattcctgg gcagcccttc cttccaccct ggcaccaaaa taatttctcc tccatccgta
3421 ccttgcctag cctctccctc tcccccagct agtccctgag caatacggca gacagatgca
3481 agaccatttt tctccaagcc atgggggact gtttggaagg aaagcccct ctctccctcc
3541 tccctcgcc ctcggcctgg ttctgcagct ggaccgacct cattcatcgc ctgcccccta
3601 cccaattctg agcacacggt actgtagccc ccagttcctc cctagccttc catccctctg
3661 tccaccccag ggggaggtaa ccccgcactc acactccctt gatgctgtct gtacagggtt
3721 catattttgt agcgaaagtc gtttttgtcc cagccggcga tcggagtggg cctttcttt
3781 cttttttgttc attctttacc tttttttctt ttctttcttt cttttttgta catactgtaa
3841 ggttggtttg taaattattc tacgaggca aaaagggaaa ataaaaactt gcccttccct
3901 ggctgaccca gtcgggaagg tagggaagga ggtctcccgt tgggagagtc tctgttcctg
3961 ctgtattata caaactgtac catagtcctg ggaaaagggt ggactcaccg ctgttgtttt
4021 atgggaagtc gtgtcatcct aggggttggg gctgggcaga gcctgtcccc tccccccttc
4081 tccaggagcc aggggtgac tggagagaca gacccacccc caagcagggc tcctctcccc
4141 agggtgagca caggacctct gtaagctgct tgtgtattgt ccactttgac gatcagtcat
4201 tcggtccgtt gatcaataat ccttcgatct tgtctccaat taaaccgagg ctttcaccga
4261 taaaaaaaaa aaaaaa
```

Human PDE4 mRNA Transcript Variant 5
                                                        (SEQ ID NO: 215)
```
  1 cgtcacgccc caggagaggc aataggaggc cctggccctg ccgacatggc caccgcagtc
 61 ccaacgcgc gctaggttgg cgagatgaag aggagtcgca gtgccctgtc cgtggcaggg
121 accggggacg agaggtcgag ggagaccccc gaatccgacc gtgccaacat gctgggggcc
181 gacctgcgtc gccctcgccg ccgcctctcg tccggtcctg gctgggctg ggcccagcct
241 gagccctcgg accctggggt ccctctgccg ccacggccca ccacctgcc gctgctgatc
301 ccaccgcgga tttccatcac cagggccgag aacgacagct cgaggcaga gaatgggccg
361 acaccatctc ctggccgcag ccccctggac tcgcaggcga gcccaggact cgtgctgcac
421 gccggggcgc ccaccagcca gcgccgggag tccttcctgt accgctcaga cagcgactat
481 gacatgtcac ccaagaccat gtcccggaac tcatcggtca ccagcgaggc gcacgctgaa
541 gacctcatcg taacaccatt tgctcaggtg ctggccagcc tcggagcgt ccgtagcaac
601 ttctcactcc tgaccaatgt gcccgttccc agtaacaagc ggtccccgct gggcggcccc
```

-continued

```
 661 acccctgtct gcaaggccac gctgtcagaa gaaacgtgtc agcagttggc ccgggagact
 721 ctggaggagc tggactggtg tctggagcag ctggagacca tgcagaccta tcgctctgtc
 781 agcgagatgg cctcgcacaa gttcaaaagg atgttgaacc gtgagctcac acacctgtca
 841 gaaatgagca ggtccggaaa ccaggtctca gagtacattt ccacaacatt cctggacaaa
 901 cagaatgaag tggagatccc atcacccacg atgaaggaac gagaaaaaca gcaagcgccg
 961 cgaccaagac cctcccagcc gccccgccc cctgtaccac acttacagcc catgtcccaa
1021 atcacagggt tgaaaaagtt gatgcatagt aacagcctga caactctaa cattccccga
1081 tttggggtga agaccgatca agaagagctc ctggcccaag aactggagaa cctgaacaag
1141 tggggcctga acatcttttg cgtgtcggat tacgctggag gccgctcact cacctgcatc
1201 atgtacatga tattccagga gcgggacctg ctgaagaaat tccgcatccc tgtggacacg
1261 atggtgacat acatgctgac gctggaggat cactaccacg ctgacgtggc ctaccataac
1321 agcctgcacg cagctgacgt gctgcagtcc acccacgtac tgctggccac gcctgcacta
1381 gatgcagtgt tcacggacct ggagattctc gccgccctct tcgcggctgc catccacgat
1441 gtggatcacc ctggggtctc caaccagttc ctcatcaaca ccaattcgga gctggcgctc
1501 atgtacaacg atgagtcggt gctcgagaat caccacctgg ccgtgggctt caagctgctg
1561 caggaggaca actgcgacat cttccagaac ctcagcaagc gccagcggca gagcctacgc
1621 aagatggtca tcgacatggt gctggccacg acatgtccca agcacatgac cctcctggct
1681 gacctgaaga ccatggtgga gaccaagaaa gtgaccagct caggggtcct cctgctagat
1741 aactactccg accgcatcca ggtcctccgg aacatggtgc actgtgccga cctcagcaac
1801 cccaccaagc cgctggagct gtaccgccag tggacagacc gcatcatggc cgagttcttc
1861 cagcagggtg accgagagcg cgagcgtggc atggaaatca gccccatgtg tgacaagcac
1921 actgcctccg tggagaagtc tcaggtgggt tttattgact acattgtgca cccattgtgg
1981 gagacctggg cggaccttgt ccacccagat gcccaggaga tcttggacac tttggaggac
2041 aaccgggact ggtactacag cgccatccgg cagagcccat ctccgccacc cgaggaggag
2101 tcaaggggc caggccaccc acccctgcct gacaagttcc agtttgagct gacgctggag
2161 gaggaagagg aggaagaaat atcaatggcc cagataccgt gcacagccca agaggcattg
2221 actgcgcagg gattgtcagg agtcgaggaa gctctggatg caaccatagc ctgggaggca
2281 tccccggccc aggagtcgtt ggaagttatg gcacaggaag catccctgga ggccgagctg
2341 gaggcagtgt atttgacaca gcaggcacag tccacaggca gtgcacctgt ggctccggat
2401 gagttctcgt cccgggagga attcgtggtt gctgtaagcc acagcagccc ctctgccctg
2461 gctcttcaaa gccccttct ccctgcttgg aggaccctgt ctgtttcaga gcatgccccg
2521 ggcctcccgg gcctccctc cacggcggcc gaggtggagg cccaacgaga gcaccaggct
2581 gccaagaggg cttgcagtgc ctgcgcaggg acatttgggg aggacacatc cgcactccca
2641 gctcctggtg gcgggggtc aggtggagac cctacctgat ccccagacct ctgtccctgt
2701 tcccctccac tcctcccctc actccccctg tcccccgacc acctcctcct ctgcctcaaa
2761 gactcttgtc ctcttgtccc tcctgagaaa aagaaaacg aaaagtgggg ttttttctg
2821 tattctttt ttccccttc cccctgcccc cacccacggg gcctttttt ggaggtgggg
2881 gctgggaat gaggggctga ggtccgaa gggattttat tttttgaat tttaattgta
2941 acatttttag aaaagaaca aaaaagaaa aaaaaaagaa agaaacacag caactgtaga
3001 tgctcctgtt cctggttccc gctttccact tccaaatccc tcccctcacc ttccccact
3061 gccccccaag ttccaggctc agtcttccag ccgcctgggg agtctctacc tgggcccaag
```

```
3121 caggtgtggg gcctccttct gggcttttct tctgaattta gaggatttct agaacgtggt 3181 caggaatagc cattctaggc ggggctgggg ccagggtggg gggcagtcac tgtgggaggt 3241 cccagctcca gcccccctct ggtttgctgc ctcctctccc ctctaaaaaa gtcttccgct 3301 tgattttgca caatcccggc gatactcctg gcgatactga ctagaaagtc agggagctgg 3361 gggagctgtt cactttagga tacggggtg gtatggaagg gagcgttcac accgccagcc 3421 tcgggcctgg gatttgagga gggccctaga cctcctccac tctccatccc ctttccttc 3481 cactttgggt tcactttgaa ttttctccgt tttttgggc agtggctctg atccactcac 3541 cccccgccc ccgccccac ttctagctgc ttctcctctt gtttctgcct taataattcc 3601 cacggccaca ggcaagggg ttgcagtggc cgcctgcacc ttggatgagg cagggccagg 3661 cgcccagaac ccccatcctg gccgcacccc cctttccagg gtcctccgga ccccaccttc 3721 cacactctga tcacagcccc cctacctttt gccctaggag gaagcaataa tggtgtatac 3781 cctcattctc attcctgggc agcccttcct tccaccctgg caccaaaata atttctcctc 3841 catccgtacc ttgcctagcc tctccctctc ccccagctag tccctgagca atacggcaga 3901 cagatgcaag accatttttc tccaagccat gggggactgt ttggaaggaa agcccctct 3961 ctccctcctc ccctcgccct cggcctggtt ctgcagctgg accgacctca ttcatcgcct 4021 gcccctacc caattctgag cacacggtac tgtagccccc agttcctccc tagccttcca 4081 tccctctgtc caccccaggg ggaggtaacc ccgcactcac actcccttga tgctgtctgt 4141 acagggttca tattttgtag cgaaagtcgt ttttgtccca gccggcgatc ggagtgggcc 4201 ttttctttct ttttgttcat tctttacctt tttttcttt ctttctttct tttttgtaca 4261 tactgtaagg ttggtttgta aattattcta cggaggcaaa aagggaaaat aaaaacttgc 4321 ccttccctgg ctgacccagt cgggaaggta gggaaggagg tctcccgttg ggagagtctc 4381 tgttcctgct gtattataca aactgtacca tagtcctggg aaaagggtgg actcaccgct 4441 gttgttttat gggaagtcgt gtcatcctag gggttgggc tgggcagagc ctgtcccctc 4501 ccccttctc caggagccag ggggtgactg gagagacaga cccacccca agcagggctc 4561 ctctccccag ggtgagcaca ggacctctgt aagctgcttg tgtattgtcc actttgacga 4621 tcagtcattc ggtccgttga tcaataatcc ttcgatcttg tctccaatta aaccgaggct 4681 ttcaccgata aaaaaaaaa aaaa
```

An antisense nucleic acid molecule can be complementary to all or part of a non-coding region of the coding strand of a nucleotide sequence encoding a PDE4 protein. Non-coding regions (5' and 3' untranslated regions) are the 5' and 3' sequences that flank the coding region in a gene and are not translated into amino acids.

Based upon the sequences disclosed herein, one of skill in the art can easily choose and synthesize any of a number of appropriate antisense nucleic acids to target a nucleic acid encoding a PDE4 described herein. Antisense nucleic acids targeting a nucleic acid encoding a PDE4 can be designed using the software available at the Integrated DNA Technologies website.

An antisense nucleic acid can be, for example, about 5, 10, 15, 20, 25, 30, 35, 40, 45, or 50 nucleotides or more in length. An antisense oligonucleotide can be constructed using chemical synthesis and enzymatic ligation reactions using procedures known in the art. For example, an antisense nucleic acid can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used.

Examples of modified nucleotides which can be used to generate an antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3) w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest).

The antisense nucleic acid molecules described herein can be prepared in vitro and administered to a mammal, e.g., a human. Alternatively, they can be generated in situ such that they hybridize with or bind to cellular mRNA and/or genomic DNA encoding a PDE4 protein to thereby inhibit expression, e.g., by inhibiting transcription and/or translation. The hybridization can be by conventional nucleotide complementarities to form a stable duplex, or, for example, in the case of an antisense nucleic acid molecule that binds to DNA duplexes, through specific interactions in the major groove of the double helix. The antisense nucleic acid molecules can be delivered to a mammalian cell using a vector (e.g., a lentivirus, a retrovirus, or an adenovirus vector).

An antisense nucleic acid can be an α-anomeric nucleic acid molecule. An α-anomeric nucleic acid molecule forms specific double-stranded hybrids with complementary RNA in which, contrary to the usual, β-units, the strands run parallel to each other (Gaultier et al., *Nucleic Acids Res.* 15:6625-6641, 1987). The antisense nucleic acid can also comprise a 2'-O-methylribonucleotide (Inoue et al., *Nucleic Acids Res.* 15:6131-6148, 1987) or a chimeric RNA-DNA analog (Inoue et al., *FEBS Lett.* 215:327-330, 1987).

Another example of an inhibitory nucleic acid is a ribozyme that has specificity for a nucleic acid encoding a PDE4 protein (e.g., specificity for a PDE4 mRNA, e.g., specificity for SEQ ID NO: 1, 2, 3, 4, or 5). Ribozymes are catalytic RNA molecules with ribonuclease activity that are capable of cleaving a single-stranded nucleic acid, such as an mRNA, to which they have a complementary region. Thus, ribozymes (e.g., hammerhead ribozymes (described in Haselhoff and Gerlach, *Nature* 334:585-591, 1988)) can be used to catalytically cleave mRNA transcripts to thereby inhibit translation of the protein encoded by the mRNA. A ribozyme having specificity for a PDE4 mRNA can be designed based upon the nucleotide sequence of any of the PDE4 mRNA sequences disclosed herein. For example, a derivative of a Tetrahymena L-19 IVS RNA can be constructed in which the nucleotide sequence of the active site is complementary to the nucleotide sequence to be cleaved in a PDE4 mRNA (see, e.g., U.S. Pat. Nos. 4,987,071 and 5,116,742). Alternatively, a PDE4 mRNA can be used to select a catalytic RNA having a specific ribonuclease activity from a pool of RNA molecules. See, e.g., Bartel et al., *Science* 261:1411-1418, 1993.

An inhibitor nucleic acid can also be a nucleic acid molecule that forms triple helical structures. For example, expression of a PDE4 polypeptide can be inhibited by targeting nucleotide sequences complementary to the regulatory region of the gene encoding the PDE4 polypeptide (e.g., the promoter and/or enhancer, e.g., a sequence that is at least 1 kb, 2 kb, 3 kb, 4 kb, or 5 kb upstream of the transcription initiation start state) to form triple helical structures that prevent transcription of the gene in target cells. See generally Helene, *Anticancer Drug Des.* 6 (6): 569-84, 1991; Helene, *Ann. N.Y. Acad. Sci.* 660:27-36, 1992; and Maher, *Bioassays* 14 (12): 807-15, 1992.

In various embodiments, inhibitory nucleic acids can be modified at the base moiety, sugar moiety, or phosphate backbone to improve, e.g., the stability, hybridization, or solubility of the molecule. For example, the deoxyribose phosphate backbone of the nucleic acids can be modified to generate peptide nucleic acids (see, e.g., Hyrup et al., *Bioorganic Medicinal Chem.* 4 (1): 5-23, 1996). Peptide nucleic acids (PNAs) are nucleic acid mimics, e.g., DNA mimics, in which the deoxyribose phosphate backbone is replaced by a pseudopeptide backbone and only the four natural nucleobases are retained. The neutral backbone of PNAs allows for specific hybridization to DNA and RNA under conditions of low ionic strength. The synthesis of PNA oligomers can be performed using standard solid phase peptide synthesis protocols (see, e.g., Perry-O'Keefe et al., *Proc. Natl. Acad. Sci. U.S.A.* 93:14670-675, 1996). PNAs can be used as antisense or antigene agents for sequence-specific modulation of gene expression by, e.g., inducing transcription or translation arrest or inhibiting replication.

PNAs can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras can be generated which may combine the advantageous properties of PNA and DNA. Such chimeras allow DNA recognition enzymes, e.g., RNAse H and DNA polymerases, to interact with the DNA portion while the PNA portion would provide high binding affinity and specificity. PNA-DNA chimeras can be linked using linkers of appropriate lengths selected in terms of base stacking, number of bonds between the nucleobases, and orientation.

The synthesis of PNA-DNA chimeras can be performed as described in Finn et al., *Nucleic Acids Res.* 24:3357-63, 1996. For example, a DNA chain can be synthesized on a solid support using standard phosphoramidite coupling chemistry and modified nucleoside analogs. Compounds such as 5'-(4-methoxytrityl)amino-5'-deoxy-thymidine phosphoramidite can be used as a link between the PNA and the 5' end of DNA (Mag et al., *Nucleic Acids Res.* 17:5973-88, 1989). PNA monomers are then coupled in a stepwise manner to produce a chimeric molecule with a 5' PNA segment and a 3' DNA segment (Finn et al., *Nucleic Acids Res.* 24:3357-63, 1996). Alternatively, chimeric molecules can be synthesized with a 5' DNA segment and a 3' PNA segment (Peterser et al., *Bioorganic Med. Chem. Lett.* 5:1119-11124, 1975).

In some embodiments, the inhibitory nucleic acids can include other appended groups such as peptides, or agents facilitating transport across the cell membrane (see, Letsinger et al., *Proc. Natl. Acad. Sci. U.S.A.* 86:6553-6556, 1989; Lemaitre et al., *Proc. Natl. Acad. Sci. U.S.A.* 84:648-652, 1989; and WO 88/09810). In addition, the inhibitory nucleic acids can be modified with hybridization-triggered cleavage agents (see, e.g., Krol et al., *Bio/Techniques* 6:958-976, 1988) or intercalating agents (see, e.g., Zon, *Pharm. Res.* 5:539-549, 1988). To this end, the oligonucleotide may be conjugated to another molecule, e.g., a peptide, hybridization triggered cross-linking agent, transport agent, hybridization-triggered cleavage agent, etc.

Another means by which expression of a PDE4 mRNA can be decreased in a mammalian cell is by RNA interference (RNAi). RNAi is a process in which mRNA is degraded in host cells. To inhibit an mRNA, double-stranded RNA (dsRNA) corresponding to a portion of the gene to be silenced (e.g., a gene encoding a PDE4 polypeptide) is introduced into a mammalian cell. The dsRNA is digested into 21-23 nucleotide-long duplexes called short interfering RNAs (or siRNAs), which bind to a nuclease complex to form what is known as the RNA-induced silencing complex (or RISC). The RISC targets the homologous transcript by base pairing interactions between one of the siRNA strands and the endogenous mRNA. It then cleaves the mRNA about 12 nucleotides from the 3' terminus of the siRNA (see Sharp et al., *Genes Dev.* 15:485-490, 2001, and Hammond et al., *Nature Rev. Gen.* 2:110-119, 2001).

RNA-mediated gene silencing can be induced in a mammalian cell in many ways, e.g., by enforcing endogenous expression of RNA hairpins (see, Paddison et al., *Proc. Natl. Acad. Sci. U.S.A.* 99:1443-1448, 2002) or, as noted above, by transfection of small (21-23 nt) dsRNA (reviewed in Caplen, *Trends Biotech.* 20:49-51, 2002). Methods for modulating gene expression with RNAi are described, e.g., in U.S. Pat. No. 6,506,559 and US 2003/0056235, which are hereby incorporated by reference.

Standard molecular biology techniques can be used to generate siRNAs. Short interfering RNAs can be chemically synthesized, recombinantly produced, e.g., by expressing RNA from a template DNA, such as a plasmid, or obtained from commercial vendors, such as Dharmacon. The RNA used to mediate RNAi can include synthetic or modified nucleotides, such as phosphorothioate nucleotides. Methods of transfecting cells with siRNA or with plasmids engineered to make siRNA are routine in the art.

The siRNA molecules used to decrease expression of a PDE4 mRNA can vary in a number of ways. For example, they can include a 3' hydroxyl group and strands of 21, 22, or 23 consecutive nucleotides. They can be blunt ended or include an overhanging end at either the 3' end, the 5' end, or both ends. For example, at least one strand of the RNA molecule can have a 3' overhang from about 1 to about 6 nucleotides (e.g., 1-5, 1-3, 2-4 or 3-5 nucleotides (whether pyrimidine or purine nucleotides) in length. Where both strands include an overhang, the length of the overhangs may be the same or different for each strand.

To further enhance the stability of the RNA duplexes, the 3' overhangs can be stabilized against degradation (by, e.g., including purine nucleotides, such as adenosine or guanosine nucleotides or replacing pyrimidine nucleotides by modified analogues (e.g., substitution of uridine 2-nucleotide 3' overhangs by 2'-deoxythymidine is tolerated and does not affect the efficiency of RNAi). Any siRNA can be used in the methods of decreasing PDE4 mRNA, provided it has sufficient homology to the target of interest (e.g., a sequence present in any one of SEQ ID NOs: 1-5, e.g., a target sequence encompassing the translation start site or the first exon of the mRNA). There is no upper limit on the length of the siRNA that can be used (e.g., the siRNA can range from about 21 base pairs of the gene to the full length of the gene or more (e.g., about 20 to about 30 base pairs, about 50 to about 60 base pairs, about 60 to about 70 base pairs, about 70 to about 80 base pairs, about 80 to about 90 base pairs, or about 90 to about 100 base pairs).

Non-limiting examples of siRNAs targeting PDE4 are described in Takakura et al., *PLosOne* 10 (12): e0142981, 2015; Watanabe et al., *Cell Signal* 27 (7): 1517-1524, 2015; Suzuki et al., *PLos One* 11 (7): c0158967, 2016; Kai et al., *Mol. Ther. Nucl. Acids* 6:163-172, 2017). Sec, e.g., Cheng et al. *Exp Ther Med* 12 (4): 2257-2264, 2016; Peter et al., *J Immunol* 178) 8): 4820-4831; and Lynch et al. *J Biolog Chem* 280:33178-33189. Additional examples of PDE4 inhibitory nucleic acids are described in U.S. Patent Application Publication Nos. 2010/0216703 and 2014/0171487, which are incorporated by reference in its entirety.

In some embodiments, a therapeutically effective amount of an inhibitory nucleic acid targeting PDE4 can be administered to a subject (e.g., a human subject) in need thereof.

In some embodiments, the inhibitory nucleic acid can be about 10 nucleotides to about 40 nucleotides (e.g., about 10 to about 30 nucleotides, about 10 to about 25 nucleotides, about 10 to about 20 nucleotides, about 10 to about 15 nucleotides, 10 nucleotides, 11 nucleotides, 12 nucleotides, 13 nucleotides, 14 nucleotides, 15 nucleotides, 16 nucleotides, 17 nucleotides, 18 nucleotides, 19 nucleotides, 20 nucleotides, 21 nucleotides, 22 nucleotides, 23 nucleotides, 24 nucleotides, 25 nucleotides, 26 nucleotides, 27 nucleotides, 28 nucleotides, 29 nucleotides, 30 nucleotides, 31 nucleotides, 32 nucleotides, 33 nucleotides, 34 nucleotides, 35 nucleotides, 36 nucleotides, 37 nucleotides, 38 nucleotides, 39 nucleotides, or 40 nucleotides) in length. One skilled in the art will appreciate that inhibitory nucleic acids may comprise at least one modified nucleic acid at either the 5' or 3'end of DNA or RNA.

Any of the inhibitory nucleic acids described herein can be formulated for administration to the gastrointestinal tract. Sec, e.g., the formulation methods described in US 2016/0090598 and Schoellhammer et al., *Gastroenterology*, doi: 10.1053/j.gastro.2017.01.002, 2017.

In some embodiments, the inhibitory nucleic acid can be formulated in a nanoparticle (e.g., a nanoparticle including one or more synthetic polymers, e.g., Patil et al., *Pharmaceutical Nanotechnol.* 367:195-203, 2009). In some embodiments, the nanoparticle can be a mucoadhesive particle (e.g., nanoparticles having a positively-charged exterior surface) (Andersen et al., *Methods Mol. Biol.* 555:77-86, 2009). In some embodiments, the nanoparticle can have a neutrally-charged exterior surface.

In some embodiments, the inhibitory nucleic acid can be formulated, e.g., as a liposome (Buyens et al., *J. Control Release* 158 (3): 362-370, 2012), a micelle (e.g., a mixed micelle) (Tangsangasaksri et al., *BioMacromolecules* 17:246-255, 2016), a microemulsion (WO 11/004395), a nanoemulsion, or a solid lipid nanoparticle (Sahay et al., *Nature Biotechnol.* 31:653-658, 2013; Lin et al., *Nanomedicine* 9 (1): 105-120, 2014).

S1P Modulators

The term "S1P modulator" refers to an agent which modulates (reduces or increases) the activity of one or more sphingosine 1-phosphate receptor(s) (S1Ps) (e.g., one or more of any of sphingosine 1-phosphate receptor 1 (S1P1), sphingosine 1-phosphate receptor 2 (S1P2), sphingosine 1-phosphate receptor 3 (S1P3), sphingosine 1-phosphate receptor 4 (S1P4), and sphingosine 1-phosphate receptor 5 (S1P5)) and/or the expression of one or more S1Ps (e.g., one or more of any of S1P1, SP2, S1P3, S1P4, and S1P5), e.g., as compared to the level of S1P1 activity in the absence of the agent; and/or decreases the level of a S1P1 protein in a mammalian cell contacted with the agent, e.g., as compared to the same mammalian cell not contacted with the agent.

In some examples, the SIP modulator is ozanimod. The structure of ozanimod is shown below:

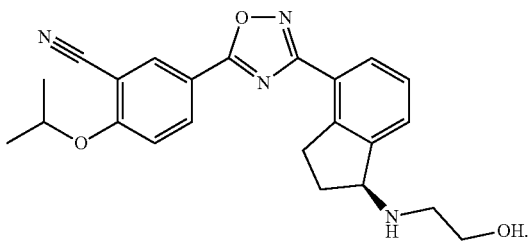 [SMILES: CC(C)Oc1ccc(-c2nc(-c3cccc4c3CC[C@@H]4NCCO)no2)cc1C#N]

In some examples, the SIP modulator is amiselimod. The structure of amiselimod is shown below:

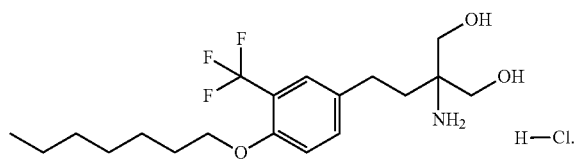 [SMILES: CCCCCCCOc1ccc(CCC(N)(CO)CO)cc1C(F)(F)F ; Cl]

In some embodiments, the SIP modulator is estrasimod. The structure of estrasimod is shown below:

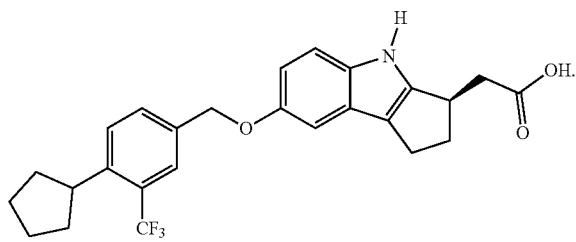 [SMILES: O=C(O)C[C@H]1CCc2c1[nH]c1ccc(OCc3ccc(C4CCCC4)c(C(F)(F)F)c3)cc21]

Additional examples of SIP modulators are known in the art.

Combination Therapy

The immune modulators disclosed herein may be optionally be used with additional agents in the treatment of the diseases disclosed herein. Nonlimiting examples of such agents for treating or preventing inflammatory bowel disease in such adjunct therapy (e.g., Crohn's disease, ulcerative colitis) include substances that suppress cytokine production, down-regulate or suppress self-antigen expression, or mask the MHC antigens. Examples of such agents include 2-amino-6-aryl-5-substituted pyrimidines (see U.S. Pat. No. 4,665,077); non-steroidal antiinflammatory drugs (NSAIDs); ganciclovir; tacrolimus; lucocorticoids such as Cortisol or aldosterone; immune modulators such as a cyclooxygenase inhibitor; a 5-lipoxygenase inhibitor; or a leukotriene receptor antagonist; purine antagonists such as azathioprine or mycophenolate mofetil (MMF); alkylating agents such as cyclophosphamide; bromocryptine; danazol; dapsone; glutaraldehyde (which masks the MHC antigens, as described in U.S. Pat. No. 4,120,649); anti-idiotypic antibodies for MHC antigens and MHC fragments; cyclosporine; 6-mercaptopurine; steroids such as corticosteroids or glucocorticosteroids or glucocorticoid analogs, e.g., prednisone, methylprednisolone, including SOLU-MEDROL®, methylprednisolone sodium succinate, and dexamethasone; dihydrofolate reductase inhibitors such as methotrexate (oral or subcutaneous); anti-malarial agents such as chloroquine and hydroxychloroquine; sulfasalazine; leflunomide; cytokine or cytokine receptor antibodies or antagonists including anti-interferon-alpha,-beta, or -gamma antibodies, anti-tumor necrosis factor (TNF)-alpha antibodies (infliximab (REMICADE®) or adalimumab), anti-TNF-alpha immunoadhesin (etanercept), anti-TNF-beta antibodies, anti-interleukin-2 (IL-2) antibodies and anti-IL-2 receptor antibodies, and anti-interleukin-6 (IL-6) receptor antibodies and antagonists; anti-LFA-1 antibodies, including anti-CD 1 1a and anti-CD 18 antibodies; anti-L3T4 antibodies; heterologous anti-lymphocyte globulin; pan-T antibodies, anti-CD3 or anti-CD4/CD4a antibodies; soluble peptide containing a LFA-3 binding domain (WO 90/08187 published Jul. 26, 1990); streptokinase; transforming growth factor-beta (TGF-beta); streptodomase; RNA or DNA from the host; FK506; RS-61443; chlorambucil; deoxyspergualin; rapamycin; T-cell receptor (Cohen et al, U.S. Pat. No. 5,114,721); T-cell receptor fragments (Offner et al, *Science*, 251:430-432 (1991); WO 90/11294; Janeway, *Nature*, 341: 482 (1989); and WO 91/01133); BAFF antagonists such as BAFF or BR3 antibodies or immunoadhesins and zTNF4 antagonists (for review, see Mackay and Mackay, *Trends Immunol*, 23:113-5 (2002) and see also definition below); biologic agents that interfere with T cell helper signals, such as anti-CD40 receptor or anti-CD40 ligand (CD 154), including blocking antibodies to CD40-CD40 ligand. (e.g., Durie et al, *Science*, 261:1328-30 (1993); Mohan et al, *J. Immunol*, 154:1470-80 (1995)) and CTLA4-Ig (Finck et al, Science, 265:1225-7 (1994)); and T-cell receptor antibodies (EP 340,109) such as T10B9. Non-limiting examples of adjunct agents also include the following: budenoside; epidermal growth factor; aminosalicylates; metronidazole; mesalamine; olsalazine; balsalazide; antioxidants; thromboxane inhibitors; IL-I receptor antagonists; anti-IL-1 monoclonal antibodies; growth factors; elastase inhibitors; pyridinyl-imidazole compounds; TNF antagonists; IL-4, IL-10, IL-13 and/or TGFβ cytokines or agonists thereof (e.g., agonist antibodies); IL-11; glucuronide- or dextran-conjugated prodrugs of prednisolone, dexamethasone or budesonide; ICAM-I antisense phosphorothioate oligodeoxynucleotides (ISIS 2302; Isis Pharmaceuticals, Inc.); soluble complement receptor 1 (TPIO; T Cell Sciences, Inc.); slow-release mesalazine; antagonists of platelet activating factor (PAF); ciprofloxacin; and lignocaine.

In other embodiments, an immune modulator as described herein can be administered with one or more of: an IL-12/IL-23 inhibitor, a CHST15 inhibitor, a IL-6 receptor inhibitor, a TNF inhibitor, an integrin inhibitor, a JAK inhibitor, a SMAD7 inhibitor, a IL-13 inhibitor, an IL-1 receptor inhibitor, a TLR agonist, an immunosuppressant, or a stem cell. In other embodiments, an immune modulator as described herein can be administered with a vitamin C infusion, one or more corticosteroids, and optionally thiamine.

Examples of particular combinations include the following. Unless otherwise specified, the first component (component (1)) is an immune modulator administered in an ingestible device, while the second component (component (2)) is administered either topically, for example, via an ingestible device, which may be the same or different ingestible device as the first component, or by another form of administration.

(1) Adalimumab; (2) methotrexate.
(1) Adalimumab; (2) methotrexate administered topically, for example, via an ingestible device.
(1) Adalimumab; (2) methotrexate administered systemically. In some embodiments, the systemic administration is intravenous administration. In some embodiments, the systemic administration is subcutaneous administration.
(1) Adalimumab; (2) methotrexate administered orally.
(1) Adalimumab; (2) methotrexate administered rectally.
(1) Methotrexate; (2) adalimumab.
(1) Methotrexate; (2) adalimumab administered topically, for example, via an ingestible device.
(1) Methotrexate; (2) adalimumab administered systemically. In some embodiments, the systemic administration is intravenous administration. In some embodiments, the systemic administration is subcutaneous administration.
(1) Methotrexate; (2) adalimumab administered orally.

(1) Methotrexate; (2) adalimumab administered rectally.
(1) Vedolizumab; (2) methotrexate.
(1) Vedolizumab; (2) methotrexate administered topically, for example, via an ingestible device.
(1) Vedolizumab; (2) methotrexate administered systemically. In some embodiments, the systemic administration is intravenous administration. In some embodiments, the systemic administration is subcutaneous administration.
(1) Vedolizumab; (2) methotrexate administered orally.
(1) Vedolizumab; (2) methotrexate administered rectally.
(1) Methotrexate; (2) vedolizumab.
(1) Methotrexate; (2) vedolizumab administered topically, for example, via an ingestible device.
(1) Methotrexate; (2) vedolizumab administered systemically. In some embodiments, the systemic administration is intravenous administration. In some embodiments, the systemic administration is subcutaneous administration.
(1) Methotrexate; (2) vedolizumab administered orally.
(1) Methotrexate; (2) vedolizumab administered rectally.
(1) Tacrolimus; (2) vedolizumab.
(1) Tacrolimus; (2) vedolizumab administered topically, for example, via an ingestible device.
(1) Tacrolimus; (2) vedolizumab administered systemically. In some embodiments, the systemic administration is intravenous administration. In some embodiments, the systemic administration is subcutaneous administration.
(1) Tacrolimus; (2) vedolizumab administered orally.
(1) Tacrolimus; (2) vedolizumab administered rectally.
(1) Vedolizumab; (2) tacrolimus.
(1) Vedolizumab; (2) tacrolimus administered topically, for example, via an ingestible device.
(1) Vedolizumab; (2) tacrolimus administered systemically. In some embodiments, the systemic administration is intravenous administration. In some embodiments, the systemic administration is subcutaneous administration.
(1) Vedolizumab; (2) tacrolimus administered orally.
(1) Vedolizumab; (2) tacrolimus administered rectally.
(1) A4 inhibitor; (2) vedolizumab. In some embodiments, the A4 inhibitor is Tysabri® (natalizumab).
(1) A4 inhibitor; (2) vedolizumab administered topically, for example, via an ingestible device. In some embodiments, the A4 inhibitor is Tysabri® (natalizumab).
(1) A4 inhibitor; (2) vedolizumab administered systemically. In some embodiments, the systemic administration is intravenous administration. In some embodiments, the systemic administration is subcutaneous administration. In some embodiments, the A4 inhibitor is Tysabri® (natalizumab).
(1) A4 inhibitor; (2) vedolizumab administered orally. In some embodiments, the A4 inhibitor is Tysabri® (natalizumab).
(1) A4 inhibitor; (2) vedolizumab administered rectally. In some embodiments, the A4 inhibitor is Tysabri® (natalizumab).
(1) Vedolizumab; (2) A4 inhibitor. In some embodiments, the A4 inhibitor is Tysabri® (natalizumab).
(1) Vedolizumab; (2) A4 inhibitor administered topically, for example, via an ingestible device. In some embodiments, the A4 inhibitor is Tysabri® (natalizumab).
(1) Vedolizumab; (2) A4 inhibitor administered systemically. In some embodiments, the A4 inhibitor is Tysabri® (natalizumab). In some embodiments, the systemic administration is intravenous administration. In some embodiments, the systemic administration is subcutaneous administration.
(1) Vedolizumab; (2) A4 inhibitor administered orally. In some embodiments, the A4 inhibitor is Tysabri® (natalizumab).
(1) Vedolizumab; (2) A4 inhibitor administered rectally. In some embodiments, the A4 inhibitor is Tysabri® (natalizumab).
(1) Anti-sense VCAM inhibitor; (2) Tysabri® (natalizumab).
(1) Anti-sense VCAM inhibitor; (2) Tysabri® (natalizumab) administered topically, for example, via an ingestible device.
(1) Anti-sense VCAM inhibitor; (2) Tysabri® (natalizumab) administered systemically. In some embodiments, the systemic administration is intravenous administration. In some embodiments, the systemic administration is subcutaneous administration.
(1) Anti-sense VCAM inhibitor; (2) Tysabri® (natalizumab) administered orally.
(1) Anti-sense VCAM inhibitor; (2) Tysabri® (natalizumab) administered rectally.
(1) Tysabri® (natalizumab); (2) anti-sense VCAM inhibitor.
(1) Tysabri® (natalizumab); (2) anti-sense VCAM inhibitor administered topically, for example, via an ingestible device.
(1) Tysabri® (natalizumab); (2) anti-sense VCAM inhibitor administered systemically. In some embodiments, the systemic administration is intravenous administration. In some embodiments, the systemic administration is subcutaneous administration.
(1) Tysabri® (natalizumab); (2) anti-sense VCAM inhibitor administered orally.
(1) Tysabri® (natalizumab); (2) anti-sense VCAM inhibitor administered rectally.
(1) Anti-sense VCAM inhibitor; (2) vedolizumab.
(1) Anti-sense VCAM inhibitor; (2) vedolizumab administered topically, for example, via an ingestible device.
(1) Anti-sense VCAM inhibitor; (2) vedolizumab administered systemically. In some embodiments, the systemic administration is intravenous administration. In some embodiments, the systemic administration is subcutaneous administration.
(1) Anti-sense VCAM inhibitor; (2) vedolizumab administered orally.
(1) Anti-sense VCAM inhibitor; (2) vedolizumab administered rectally.
(1) Vedolizumab; (2) anti-sense VCAM inhibitor.
(1) Vedolizumab; (2) anti-sense VCAM inhibitor administered topically, for example, via an ingestible device.
(1) Vedolizumab; (2) anti-sense VCAM inhibitor administered systemically. In some embodiments, the systemic administration is intravenous administration. In some embodiments, the systemic administration is subcutaneous administration.
(1) Vedolizumab; (2) anti-sense VCAM inhibitor administered orally.
(1) Vedolizumab; (2) anti-sense VCAM inhibitor administered rectally.
(1) Cyclosporin; (2) vedolizumab.
(1) Cyclosporin; (2) vedolizumab administered topically, for example, via an ingestible device.
(1) Cyclosporin; (2) vedolizumab administered systemically. In some embodiments, the systemic administra- (1) Cyclosporin; (2) vedolizumab administered orally.
(1) Cyclosporin; (2) vedolizumab administered rectally.
(1) Vedolizumab; (2) cyclosporin.
(1) Vedolizumab; (2) cyclosporin administered topically, for example, via an ingestible device.
(1) Vedolizumab; (2) cyclosporin administered systemically. In some embodiments, the systemic administration is intravenous administration. In some embodiments, the systemic administration is subcutaneous administration.
(1) Vedolizumab; (2) cyclosporin administered orally.
(1) Vedolizumab; (2) cyclosporin administered rectally.
(1) TNF inhibitor; (2) MADCAM inhibitor.
(1) TNF inhibitor; (2) MADCAM inhibitor administered topically, for example, via an ingestible device.
(1) TNF inhibitor; (2) MADCAM inhibitor administered systemically. In some embodiments, the systemic administration is intravenous administration. In some embodiments, the systemic administration is subcutaneous administration.
(1) TNF inhibitor; (2) MADCAM inhibitor administered orally.
(1) TNF inhibitor; (2) MADCAM inhibitor administered rectally.
(1) MADCAM inhibitor; (2) TNF inhibitor.
(1) MADCAM inhibitor; (2) TNF inhibitor administered topically, for example, via an ingestible device.
(1) MADCAM inhibitor; (2) TNF inhibitor administered systemically. In some embodiments, the systemic administration is intravenous administration. In some embodiments, the systemic administration is subcutaneous administration.
(1) MADCAM inhibitor; (2) TNF inhibitor administered orally.
(1) MADCAM inhibitor; (2) TNF inhibitor administered rectally.
(1) TNF inhibitor; (2) B7 inhibitor.
(1) TNF inhibitor; (2) B7 inhibitor administered topically, for example, via an ingestible device.
(1) TNF inhibitor; (2) B7 inhibitor administered systemically. In some embodiments, the systemic administration is intravenous administration. In some embodiments, the systemic administration is subcutaneous administration.
(1) TNF inhibitor; (2) B7 inhibitor administered orally.
(1) TNF inhibitor; (2) B7 inhibitor administered rectally.
(1) B7 inhibitor; TNF inhibitor.
(1) B7 inhibitor; TNF inhibitor administered topically, for example, via an ingestible device.
(1) B7 inhibitor; TNF inhibitor administered systemically. In some embodiments, the systemic administration is intravenous administration. In some embodiments, the systemic administration is subcutaneous administration.
(1) B7 inhibitor; TNF inhibitor administered orally.
(1) B7 inhibitor; TNF inhibitor administered rectally.
(1) JAK inhibitor; (2) TNF inhibitor.
(1) JAK inhibitor; (2) TNF inhibitor administered topically, for example, via an ingestible device.
(1) JAK inhibitor; (2) TNF inhibitor administered systemically. In some embodiments, the systemic administration is intravenous administration. In some embodiments, the systemic administration is subcutaneous administration.
(1) JAK inhibitor; (2) TNF inhibitor administered orally.
(1) JAK inhibitor; (2) TNF inhibitor administered rectally.
(1) TNF inhibitor; (2) JAK inhibitor.
(1) TNF inhibitor; (2) JAK inhibitor administered topically, for example, via an ingestible device.
(1) TNF inhibitor; (2) JAK inhibitor administered systemically. In some embodiments, the systemic administration is intravenous administration. In some embodiments, the systemic administration is subcutaneous administration.
(1) TNF inhibitor; (2) JAK inhibitor administered orally.
(1) TNF inhibitor; (2) JAK inhibitor administered rectally.
(1) Neoregulin-4; (2) TNF inhibitor.
(1) Neoregulin-4; (2) TNF inhibitor administered topically, for example, via an ingestible device.
(1) Neoregulin-4; (2) TNF inhibitor administered systemically. In some embodiments, the systemic administration is intravenous administration. In some embodiments, the systemic administration is subcutaneous administration.
(1) Neoregulin-4; (2) TNF inhibitor administered orally.
(1) Neoregulin-4; (2) TNF inhibitor administered rectally.
(1) TNF inhibitor; (2) neoregulin-4.
(1) TNF inhibitor; (2) neoregulin-4 administered topically, for example, via an ingestible device.
(1) TNF inhibitor; (2) neoregulin-4 administered systemically. In some embodiments, the systemic administration is intravenous administration. In some embodiments, the systemic administration is subcutaneous administration.
(1) TNF inhibitor; (2) neoregulin-4 administered orally.
(1) TNF inhibitor; (2) neoregulin-4 administered rectally.
(1) Neoregulin-4; (2) vedolizumab.
(1) Neoregulin-4; (2) vedolizumab administered topically, for example, via an ingestible device.
(1) Neoregulin-4; (2) vedolizumab administered systemically. In some embodiments, the systemic administration is intravenous administration. In some embodiments, the systemic administration is subcutaneous administration.
(1) Neoregulin-4; (2) vedolizumab administered orally.
(1) Neoregulin-4; (2) vedolizumab administered rectally.
(1) Vedolizumab; (2) neoregulin-4.
(1) Vedolizumab; (2) neoregulin-4 administered topically, for example, via an ingestible device.
(1) Vedolizumab; (2) neoregulin-4 administered systemically. In some embodiments, the systemic administration is intravenous administration. In some embodiments, the systemic administration is subcutaneous administration.
(1) Vedolizumab; (2) neoregulin-4 administered orally.
(1) Vedolizumab; (2) neoregulin-4 administered rectally.
(1) Neoregulin-4; (2) Stelara® (ustekinumab).
(1) Neoregulin-4; (2) Stelara® (ustekinumab) administered topically, for example, via an ingestible device.
(1) Neoregulin-4; (2) Stelara® (ustekinumab) administered systemically. In some embodiments, the systemic administration is is intravenous administration. In some embodiments, the systemic administration is subcutaneous administration.
(1) Neoregulin-4; (2) Stelara® (ustekinumab) administered orally.
(1) Neoregulin-4; (2) Stelara® (ustekinumab) administered rectally.
(1) Stelara® (ustekinumab); (2) neoregulin-4.

(1) Stelara® (ustekinumab); (2) neoregulin-4 administered topically, for example, via an ingestible device.
(1) Stelara® (ustekinumab); (2) neoregulin-4 administered systemically. In some embodiments, the systemic administration is intravenous administration. In some embodiments, the systemic administration is subcutaneous administration.
(1) Stelara® (ustekinumab); (2) neoregulin-4 administered orally.
(1) Stelara® (ustekinumab); (2) neoregulin-4 administered rectally.
(1) Neoregulin-4; (2) JAK inhibitor.
(1) Neoregulin-4; (2) JAK inhibitor administered topically, for example, via an ingestible device.
(1) Neoregulin-4; (2) JAK inhibitor administered systemically. In some embodiments, the systemic administration is intravenous administration. In some embodiments, the systemic administration is subcutaneous administration.
(1) Neoregulin-4; (2) JAK inhibitor administered orally.
(1) Neoregulin-4; (2) JAK inhibitor administered rectally.
(1) JAK inhibitor; (2) neoregulin-4.
(1) JAK inhibitor; (2) neoregulin-4 administered topically, for example, via an ingestible device.
(1) JAK inhibitor; (2) neoregulin-4 administered systemically. In some embodiments, the systemic administration is intravenous administration. In some embodiments, the systemic administration is subcutaneous administration.
(1) JAK inhibitor; (2) neoregulin-4 administered orally.
(1) JAK inhibitor; (2) neoregulin-4 administered rectally.
(1) TNF inhibitor; (2) SIP modulator. In some embodiments, the SIP modulator is ozanimod or etrasimod.
(1) TNF inhibitor; (2) SIP modulator administered topically, for example, via an ingestible device. In some embodiments, the SIP modulator is ozanimod or etrasimod.
(1) TNF inhibitor; (2) SIP modulator administered systemically. In some embodiments, the S1P modulator is ozanimod or etrasimod. In some embodiments, the systemic administration is intravenous administration. In some embodiments, the systemic administration is subcutaneous administration.
(1) TNF inhibitor; (2) SIP modulator administered orally. In some embodiments, the SIP modulator is ozanimod or etrasimod.
(1) TNF inhibitor; (2) SIP modulator administered rectally. In some embodiments, the S1P modulator is ozanimod or etrasimod.
(1) SIP modulator; (2) TNF inhibitor. In some embodiments, the SIP modulator is ozanimod or etrasimod.
(1) SIP modulator; (2) TNF inhibitor administered topically, for example, via an ingestible device. In some embodiments, the SIP modulator is ozanimod or etrasimod.
(1) SIP modulator; (2) TNF inhibitor administered systemically. In some embodiments, the S1P modulator is ozanimod or etrasimod. In some embodiments, the systemic administration is intravenous administration. In some embodiments, the systemic administration is subcutaneous administration.
(1) SIP modulator; (2) TNF inhibitor administered orally. In some embodiments, the S1P modulator is ozanimod or etrasimod.
(1) SIP modulator; (2) TNF inhibitor administered rectally. In some embodiments, the SIP modulator is ozanimod or etrasimod.
(1) Stelara® (ustekinumab); (2) S1P modulator. In some embodiments, the SIP modulator is ozanimod or etrasimod.
(1) Stelara® (ustekinumab); (2) SIP modulator administered topically, for example, via an ingestible device. In some embodiments, the SIP modulator is ozanimod or etrasimod.
(1) Stelara® (ustekinumab); (2) SIP modulator administered systemically. In some embodiments, the SIP modulator is ozanimod or etrasimod. In some embodiments, the systemic administration is intravenous administration. In some embodiments, the systemic administration is subcutaneous administration.
(1) Stelara® (ustekinumab); (2) SIP modulator administered orally. In some embodiments, the S1P modulator is ozanimod or etrasimod.
(1) Stelara® (ustekinumab); (2) SIP modulator administered rectally. In some embodiments, the SIP modulator is ozanimod or etrasimod.
(1) SIP modulator; (2) Stelara® (ustekinumab). In some embodiments, the SIP modulator is ozanimod or etrasimod.
(1) SIP modulator; (2) Stelara® (ustekinumab) administered topically, for example, via an ingestible device. In some embodiments, the SIP modulator is ozanimod or etrasimod.
(1) SIP modulator; (2) Stelara® (ustekinumab) administered systemically. In some embodiments, the SIP modulator is ozanimod or etrasimod. In some embodiments, the systemic administration is intravenous administration. In some embodiments, the systemic administration is subcutaneous administration.
(1) SIP modulator; (2) Stelara® (ustekinumab) administered orally. In some embodiments, the S1P modulator is ozanimod or etrasimod.
(1) SIP modulator; (2) Stelara® (ustekinumab) administered rectally. In some embodiments, the SIP modulator is ozanimod or etrasimod.
(1) Vedolizumab; (2) SIP modulator. In some embodiments, the SIP modulator is ozanimod or etrasimod.
(1) Vedolizumab; (2) SIP modulator administered topically, for example, via an ingestible device. In some embodiments, the SIP modulator is ozanimod or etrasimod.
(1) Vedolizumab; (2) SIP modulator administered systemically. In some embodiments, the SIP modulator is ozanimod or etrasimod. In some embodiments, the systemic administration is intravenous administration. In some embodiments, the systemic administration is subcutaneous administration.
(1) Vedolizumab; (2) SIP modulator administered orally. In some embodiments, the SIP modulator is ozanimod or etrasimod.
(1) Vedolizumab; (2) SIP modulator administered rectally. In some embodiments, the SIP modulator is ozanimod or etrasimod.
(1) SIP modulator; (2) vedolizumab. In some embodiments, the SIP modulator is ozanimod or etrasimod.
(1) SIP modulator; (2) vedolizumab administered topically, for example, via an ingestible device. In some embodiments, the SIP modulator is ozanimod or etrasimod.
(1) SIP modulator; (2) vedolizumab administered systemically. In some embodiments, the SIP modulator is ozanimod or etrasimod. In some embodiments, the systemic administration is intravenous administration.

In some embodiments, the systemic administration is subcutaneous administration.
(1) SIP modulator; (2) vedolizumab administered orally. In some embodiments, the SIP modulator is ozanimod or etrasimod.
(1) SIP modulator; (2) vedolizumab administered rectally. In some embodiments, the SIP modulator is ozanimod or etrasimod.

In some embodiments, the methods disclosed herein comprise administering (i) the immune modulator as disclosed herein, and (ii) a second agent orally, intravenously or subcutaneously, wherein the second agent in (ii) is the same immune modulator in (i); a different immune modulator; or an agent having a different biological target from the immune modulator.

In some embodiments, the methods disclosed herein comprise administering (i) the immune modulator in the manner disclosed herein, and (ii) a second agent orally, intravenously or subcutaneously, wherein the second agent in (ii) is an agent suitable for treating an inflammatory bowel disease.

In some embodiments of the methods that include administering a second or additional agent or component, the additional agent is administered together with the immune modulator in the same ingestible device as the immune modulator. In some embodiments of the methods that include administering a second or additional agent or component, the additional agent is administered separately from the immune modulator in a separate ingestible device from the immune modulator.

In some embodiments, the immune modulator is administered prior to the second agent. In some embodiments, the immune modulator is administered after the second agent. In some embodiments, the immune modulator and the second agent are administered substantially at the same time. In some embodiments, the immune modulator is delivered prior to the second agent. In some embodiments, the immune modulator is delivered after the second agent. In some embodiments, the immune modulator and the second agent are delivered substantially at the same time.

In some embodiments, the second agent is an agent suitable for the treatment of an inflammatory disease or condition that arises in a tissue originating from the endoderm. In some embodiments, the second agent is administered intravenously. In some embodiments, the second agent is administered subcutaneously.

In some embodiments, delivery of the immune modulator to the location, such as delivery to the location by mucosal contact, results in systemic immunogenicity levels at or below systemic immunogenicity levels resulting from administration of the immune modulator systemically. In some embodiments comprising administering the immune modulator in the manner disclosed herein and a second agent systemically, delivery of the immune modulator to the location, such as delivery to the location by mucosal contact, results in systemic immunogenicity levels at or below systemic immunogenicity levels resulting from administration of the immune modulator systemically and the second agent systemically. In some embodiments, the method comprises administering the immune modulator in the manner disclosed herein and a second agent, wherein the amount of the second agent is less than the amount of the second agent when the immune modulator and the second agent are both administered systemically.

Combination Therapy Methods

In some more particular embodiments, provided herein is a method of treating an inflammatory disease or condition that arises in a tissue originating from the endoderm of a subject comprising:
topically administering to the gastrointestinal (GI) tract of the subject (i) an immune modulator or (ii) a pharmaceutical formulation that comprises the immune modulator; and
administering an additional agent useful for treating the disease or condition that arises in a tissue originating from the endoderm of the subject;
wherein the topical administration comprises releasing the immune modulator or the pharmaceutical formulation that comprises the immune modulator to, or proximal to, a section or subsection of the GI tract containing one or more inflammatory disease sites.

In some further embodiments, the topical administration further comprises orally administering to the subject an ingestible device as disclosed herein, said device containing the immune modulator or the pharmaceutical formulation that comprises the immune modulator;
and releasing the immune modulator or the pharmaceutical formulation that comprises the immune modulator from the ingestible device to, or proximal to, the section or subsection of the GI tract containing the one or more disease sites.

In some embodiments, the inflammatory disease or condition is an inflammatory bowel disease. In some embodiments, the inflammatory bowel disease is ulcerative colitis. In some embodiments, the inflammatory bowel disease is Crohn's disease.

In some embodiments, the section or subsection of the GI tract of the subject containing the one or more disease sites is the jejunum, and the immune modulator or the pharmaceutical formulation that comprises the immune modulator is released to the duodenum or the jejunum.

In some embodiments, the section or subsection of the GI tract of the subject containing the one or more disease sites is the ileum, and the immune modulator or the pharmaceutical formulation that comprises the immune modulator is released to the jejunum or the ileum.

In some embodiments, the section or subsection of the GI tract of the subject containing the one or more disease sites is the cecum, and the immune modulator or the pharmaceutical formulation that comprises the immune modulator is released to the ileum or the cecum.

In some embodiments, the section or subsection of the GI tract of the subject containing the one or more disease sites is the colon, and the immune modulator or the pharmaceutical formulation that comprises the immune modulator is released to the cecum or the colon. In some more particular embodiments, the immune modulator or the pharmaceutical formulation that comprises the immune modulator is released to the ascending colon.

In some embodiments, the immune modulator is selected from the group consisting of IL-12/IL-23 inhibitors, TNFα inhibitors, IL-6 receptor inhibitors, JAK inhibitors, CD3 inhibitors, CD40/CD40L inhibitors, IL-1 inhibitors, IL-13 inhibitors, IL-10 receptor agonists, integrin inhibitors, and SIP antagonists.

In some embodiments, the additional agent is orally administered in an ingestible device. In some embodiments, the additional agent is administered by another form of administration. In some embodiments, the immune modulator is administered prior to administration of the additional agent. In some embodiments, the additional agent is administered prior to administration of the immune modulator. In some embodiments, the immune modulator and the additional agent are administered simultaneously.

In some embodiments, the additional agent is a corticosteroid, an aminosalicylate, a PDE4 inhibitor, an SIP modulator, a JAK inhibitor, an integrin inhibitor, or an anti-TNF agent.

In some embodiments, an immune modulator is administered topically (optionally, via an ingestible device as disclosed herein), and a PDE4 inhibitor is administered. In some embodiments, the PDE4 inhibitor is selected from the group consisting of apremilast, crisaborole, ibudilast, roflumilast and tetomilast; and pharmaceutically acceptable salts thereof.

In some embodiments, an immune modulator is administered topically (optionally, via an ingestible device as disclosed herein), and an SIP modulator is administered. In some embodiments, the SIP modulator is selected from the group consisting of fingolimod, KRP203, siponimod, ponesimod, cenerimod, ozanimod, ceralifimod, amiselimod, and etrasimod; and pharmaceutically acceptable salts thereof. In some embodiments, the SIP modulator is ozanimod or pharmaceutically acceptable salt thereof. In other embodiments, the SIP modulator is etrasimod or pharmaceutically acceptable salt thereof. In yet other embodiments, the SIP modulator is amiselimod or pharmaceutically acceptable salt thereof.

In some embodiments, an immune modulator is administered topically (optionally, via an ingestible device as disclosed herein), and a JAK inhibitor is administered. In some embodiments, the JAK inhibitor is selected from the group consisting of abrocitinib, baricitinib, BMS-986165, decernotinib (VX509), filgotinib, itacitinib, oclacitinib, perficitinib, PF-06651600, PF-06700841, R333 (R932333), R348 (R932348), ruxolitinib, solcitinib, TD-1473, TD-3504, tofacitinib and upadacitinib; and pharmaceutically acceptable salts thereof. Preferably, the JAK inhibitor is tofacitinib or a pharmaceutically acceptable salt thereof, or more particularly, tofacitinib citrate.

In some embodiments, an immune modulator is administered topically (optionally, via an ingestible device as disclosed herein), and an integrin inhibitor is administered. In some embodiments, the integrin inhibitor is an antibody. In a further embodiment, the integrin inhibitor is selected from the group consisting of vedolizumab, natalizumab, etrolizumab, vatelizumab and PF-00547659; and biosimilars thereof. In a preferred embodiment, the integrin inhibitor is vedolizumab or a biosimilar thereof. In other embodiments, the integrin inhibitor is a small molecule integrin inhibitor. In some embodiments, the small molecule integrin inhibitor is firategrast, valategrast, RO0270608, CDP-323, CT7758, GW-559090, or ELND-004; or pharmaceutically acceptable salt thereof. In further embodiments, the small molecule integrin inhibitor is a compound as disclosed in US 2005/0209232; U.S. Pat. No. 9,518,091; WO 2005/077914; WO 2005/077915; WO 09/706822; WO 2017/135471; WO 2017/135472; Co et al., Immunotechnol., 4:253-266 (1999); Dubree et al., J. Med. Chem., 45:3451-3457 (2002); Gong et al., J. Med. Chem., 49:3402-3411 (2006); Gong et al., Bioorg. Med. Chem. Lett., 18:1331-1335 (2008); Muz et al., American Society of Hematology Annual Meeting and Exposition, (2014) 56th (December 8) Abs 4758; Sidduri et al., Bioorg. Med. Chem. Lett., 23:1026-1031 (2013); or Xu et al., Bioorg. Med. Chem. Lett., 23:4370-4373 (2013), each of which are incorporated by reference in their entireties; or pharmaceutically acceptable salt thereof. In a preferred embodiment, the small molecule integrin inhibitor is AJM-300, or a pharmaceutically acceptable salt thereof. In another preferred embodiment, the small molecule integrin inhibitor is HCA2969 (carotegrast), or a prodrug thereof; or a pharmaceutically acceptable salt thereof; provided that the prodrug of carotegrast is not AJM300. In another preferred embodiment, the small molecule integrin inhibitor is HCA2969 (carotegrast); or a pharmaceutically acceptable salt thereof. In other embodiments, the integrin inhibitor is a peptide integrin inhibitor. In some embodiments, the peptide integrin inhibitor is PTG-100 or PN-10943 (also known as PN-943).

In some embodiments, an immune modulator is administered topically (optionally, via an ingestible device as disclosed herein), and an anti-TNF agent is administered. In some embodiments, the anti-TNF agent is infliximab, golimumab, certolizumab, certolizumab pegol or etanercept; or a biosimilar thereof. In a preferred embodiment, the anti-TNF agent is adalimumab or a biosimilar thereof.

In some more particular embodiments, provided herein is a method of treating an inflammatory disease or condition that arises in a tissue originating from the endoderm of a subject, comprising:

topically administering to the GI tract of the subject an immune modulator, or a pharmaceutical formulation that comprises the immune modulator; and administering an additional agent useful for treating the disease or condition that arises in a tissue originating from the endoderm of the subject;

wherein the topical administration comprises orally administering to the subject an ingestible device as disclosed herein, said device containing the immune modulator or the pharmaceutical formulation that comprises the immune modulator; and releasing the immune modulator or the pharmaceutical formulation that comprises the immune modulator from the ingestible device to, or proximal to, a section or subsection of the GI tract containing the one or more inflammatory disease sites.

In some embodiments, the inflammatory disease or condition is an inflammatory bowel disease. In some embodiments, the inflammatory bowel disease is ulcerative colitis. In some embodiments, the inflammatory bowel disease is Crohn's disease.

In some embodiments, the section or subsection of the GI tract of the subject containing the one or more disease sites is the jejunum, and the immune modulator or the pharmaceutical formulation that comprises the immune modulator is released to the duodenum or the jejunum.

In some embodiments, the section or subsection of the GI tract of the subject containing the one or more disease sites is the ileum, and the immune modulator or the pharmaceutical formulation that comprises the immune modulator is released to the jejunum or the ileum.

In some embodiments, the section or subsection of the GI tract of the subject containing the one or more disease sites is the cecum, and the immune modulator or the pharmaceutical formulation that comprises the immune modulator is released to the ileum or the cecum.

In some embodiments, the section or subsection of the GI tract of the subject containing the one or more disease sites is the colon, and the immune modulator or the pharmaceutical formulation that comprises the immune modulator is released to the cecum or the colon. In some more particular embodiments, the immune modulator or the pharmaceutical formulation that comprises the immune modulator is released to the ascending colon.

In some embodiments, the immune modulator is selected from the group consisting of IL-12/IL-23 inhibitors, TNFα inhibitors, IL-6 receptor inhibitors, JAK inhibitors, CD3 inhibitors, CD40/CD40L inhibitors, IL-1 inhibitors, IL-13 inhibitors, IL-10 receptor agonists, integrin inhibitors, and SIP antagonists.

In some embodiments, the additional agent is administered in an ingestible device. In some embodiments, the additional agent is administered by another form of administration. In some embodiments, the immune modulator is administered prior to administration of the additional agent. In some embodiments, the additional agent is administered prior to administration of the immune modulator. In some embodiments, the immune modulator and the additional agent are administered simultaneously.

In some embodiments, the additional agent is a corticosteroid, an aminosalicylate, a PDE4 inhibitor, an SIP modulator, a JAK inhibitor, an integrin inhibitor, or an anti-TNF agent.

In some embodiments, an immune modulator is administered topically via an ingestible device as disclosed herein, and a PDE4 inhibitor is administered. In some embodiments, the PDE4 inhibitor is selected from the group consisting of apremilast, crisaborole, ibudilast, roflumilast and tetomilast; and pharmaceutically acceptable salts thereof.

In some embodiments, an immune modulator is administered topically via an ingestible device as disclosed herein, and an SIP modulator is administered. In some embodiments, the SIP modulator is selected from the group consisting of fingolimod, KRP203, siponimod, ponesimod, cenerimod, ozanimod, ceralifimod, amiselimod, and etrasimod; and pharmaceutically acceptable salts thereof. In some embodiments, the SIP modulator is ozanimod or pharmaceutically acceptable salt thereof. In other embodiments, the SIP modulator is etrasimod or pharmaceutically acceptable salt thereof. In yet other embodiments, the SIP modulator is amiselimod or pharmaceutically acceptable salt thereof.

In some embodiments, an immune modulator is administered topically via an ingestible device as disclosed herein, and a JAK inhibitor is administered. In some embodiments, the JAK inhibitor is selected from the group consisting of abrocitinib, baricitinib, BMS-986165, decernotinib (VX509), filgotinib, itacitinib, oclacitinib, perficitinib, PF-06651600, PF-06700841, R333 (R932333), R348 (R932348), ruxolitinib, solcitinib, TD-1473, TD-3504, tofacitinib and upadacitinib; and pharmaceutically acceptable salts thereof. Preferably, the JAK inhibitor is tofacitinib or a pharmaceutically acceptable salt thereof, or more particularly, tofacitinib citrate.

In some embodiments, an immune modulator is administered topically via an ingestible device as disclosed herein, and an integrin inhibitor is administered. In some embodiments, the integrin inhibitor is an antibody. In a further embodiment, the integrin inhibitor is selected from the group consisting of vedolizumab, natalizumab, etrolizumab, vatelizumab and PF-00547659; and biosimilars thereof. In a preferred embodiment, the integrin inhibitor is vedolizumab or a biosimilar thereof. In other embodiments, the integrin inhibitor is a small molecule integrin inhibitor. In some embodiments, the small molecule integrin inhibitor is firategrast, valategrast, RO0270608, CDP-323, CT7758, GW-559090, or ELND-004; or a pharmaceutically acceptable salt thereof. In further embodiments, the small molecule integrin inhibitor is a compound as disclosed in US 2005/0209232; U.S. Pat. No. 9,518,091; WO 2005/077914; WO 2005/077915; WO 09/706822; WO 2017/135471; WO 2017/135472; Co et al., Immunotechnol., 4:253-266 (1999); Dubrec et al., J. Med. Chem., 45:3451-3457 (2002); Gong et al., J. Med. Chem., 49:3402-3411 (2006); Gong et al., Bioorg. Med. Chem. Lett., 18:1331-1335 (2008); Muz et al., American Society of Hematology Annual Meeting and Exposition, (2014) 56th (December 8) Abs 4758; Sidduri et al., Bioorg. Med. Chem. Lett., 23:1026-1031 (2013); or Xu et al., Bioorg. Med. Chem. Lett., 23:4370-4373 (2013), each of which are incorporated by reference in their entireties; or pharmaceutically acceptable salt thereof. In a preferred embodiment, the small molecule integrin inhibitor is AJM-300, or a pharmaceutically acceptable salt thereof. In another preferred embodiment, the small molecule integrin inhibitor is HCA2969 (carotegrast), or a prodrug thereof; or a pharmaceutically acceptable salt thereof; provided that the prodrug of carotegrast is not AJM300. In another preferred embodiment, the small molecule integrin inhibitor is HCA2969 (carotegrast); or a pharmaceutically acceptable salt thereof. In other embodiments, the integrin inhibitor is a peptide integrin inhibitor. In some embodiments, the peptide integrin inhibitor is PTG-100 or PN-10943 (also known as PN-943).

In some embodiments, an immune modulator is administered topically via an ingestible device as disclosed herein, and an anti-TNF agent is administered. In some embodiments, the anti-TNF agent is infliximab, golimumab, certolizumab, certolizumab pegol or etanercept; or a biosimilar thereof. In a preferred embodiment, the anti-TNF agent is adalimumab or a biosimilar thereof.

In some other embodiments, the method of treating an inflammatory disease or condition that arises in a tissue originating from the endoderm of a subject comprises:
    administering to the subject an immune modulator;
    orally administering to the subject an ingestible device comprising (i) an additional agent or (ii) a pharmaceutical formulation that comprises the additional agent, wherein the additional agent is useful for treating a disease or condition of the GI tract of a subject; and
    releasing the additional agent or the pharmaceutical formulation that comprises the additional agent from the ingestible device to, or proximal to, a section or subsection of the GI tract containing one or more inflammatory disease sites.

In some embodiments, the inflammatory disease or condition is an inflammatory bowel disease. In some embodiments, the inflammatory bowel disease is ulcerative colitis. In some embodiments, the inflammatory bowel disease is Crohn's disease.

In some embodiments, the section or subsection of the GI tract of the subject containing the one or more disease sites is the jejunum, and the immune modulator or the pharmaceutical formulation that comprises the immune modulator is released to the duodenum or the jejunum.

In some embodiments, the section or subsection of the GI tract of the subject containing the one or more disease sites is the ileum, and the immune modulator or the pharmaceutical formulation that comprises the immune modulator is released to the jejunum or the ileum.

In some embodiments, the section or subsection of the GI tract of the subject containing the one or more disease sites is the cecum, and the immune modulator or the pharmaceutical formulation that comprises the immune modulator is released to the ileum or the cecum.

In some embodiments, the section or subsection of the GI tract of the subject containing the one or more disease sites is the colon, and the immune modulator or the pharmaceutical formulation that comprises the immune modulator is released to the cecum or the colon. In some more particular embodiments, the immune modulator or the pharmaceutical formulation that comprises the immune modulator is released to the ascending colon.

In some embodiments, the immune modulator is selected from the group consisting of IL-12/IL-23 inhibitors, TNFα inhibitors, IL-6 receptor inhibitors, JAK inhibitors, CD3 inhibitors, CD40/CD40L inhibitors, IL-1 inhibitors, IL-13 inhibitors, IL-10 receptor agonists, integrin inhibitors, and SIP antagonists.

In some embodiments, the immune modulator is administered in an ingestible device. In some embodiments, the immune modulator is administered by another form of administration, for example, intravenously or subcutaneously. In some embodiments, the immune modulator is administered prior to administration of the additional agent. In some embodiments, the additional agent is administered prior to administration of the immune modulator. In some embodiments, the immune modulator and the additional agent are administered simultaneously.

In some embodiments, the additional agent is a corticosteroid, an aminosalicylate, a PDE4 inhibitor, an SIP modulator, a JAK inhibitor, an integrin inhibitor, or an anti-TNF agent.

In some embodiments, the additional agent is a PDE4 inhibitor selected from the group consisting of apremilast, crisaborole, ibudilast, roflumilast and tetomilast; and pharmaceutically acceptable salts thereof.

In some embodiments, the additional agent is an SIP modulator selected from the group consisting of fingolimod, KRP203, siponimod, ponesimod, cenerimod, ozanimod, ceralifimod, amiselimod, and etrasimod; and pharmaceutically acceptable salts thereof. In some embodiments, the SIP modulator is ozanimod or a pharmaceutically acceptable salt thereof. In other embodiments, the SIP modulator is etrasimod or a pharmaceutically acceptable salt thereof. In yet other embodiments, the SIP modulator is amiselimod or a pharmaceutically acceptable salt thereof.

In some embodiments, the additional agent is a JAK inhibitor selected from the group consisting of abrocitinib, baricitinib, BMS-986165, decernotinib (VX509), filgotinib, itacitinib, oclacitinib, perficitinib, PF-06651600, PF-06700841, R333 (R932333), R348 (R932348), ruxolitinib, solcitinib, TD-1473, TD-3504, tofacitinib and upadacitinib; and pharmaceutically acceptable salts thereof. Preferably, the JAK inhibitor is tofacitinib or a pharmaceutically acceptable salt thereof, or more particularly, tofacitinib citrate.

In some embodiments, the additional agent is an integrin inhibitor that is an antibody. In a further embodiment, the integrin inhibitor is an antibody selected from the group consisting of vedolizumab, natalizumab, etrolizumab, vatelizumab and PF-00547659; and biosimilars thereof. In a preferred embodiment, the integrin inhibitor is vedolizumab or a biosimilar thereof. In other embodiments, the integrin inhibitor is a small molecule integrin inhibitor. In some embodiments, the small molecule integrin inhibitor is firategrast, valategrast, RO0270608, CDP-323, CT7758, GW-559090, or ELND-004; or a pharmaceutically acceptable salt thereof. In further embodiments, the small molecule integrin inhibitor is a compound as disclosed in US 2005/0209232; U.S. Pat. No. 9,518,091; WO 2005/077914; WO 2005/077915; WO 09/706822; WO 2017/135471; WO 2017/135472; Co et al., Immunotechnol., 4:253-266 (1999); Dubrec et al., J. Med. Chem., 45:3451-3457 (2002); Gong et al., J. Med. Chem., 49:3402-3411 (2006); Gong et al., Bioorg. Med. Chem. Lett., 18:1331-1335 (2008); Muz et al., American Society of Hematology Annual Meeting and Exposition, (2014) 56th (December 8) Abs 4758; Sidduri et al., Bioorg. Med. Chem. Lett., 23:1026-1031 (2013); or Xu et al., Bioorg. Med. Chem. Lett., 23:4370-4373 (2013), each of which are incorporated by reference in their entireties; or a pharmaceutically acceptable salt thereof. In a preferred embodiment, the small molecule integrin inhibitor is AJM-300, or a pharmaceutically acceptable salt thereof. In another preferred embodiment, the small molecule integrin inhibitor is HCA2969 (carotegrast), or a prodrug thereof; or a pharmaceutically acceptable salt thereof; provided that the prodrug of carotegrast is not AJM300. In another preferred embodiment, the small molecule integrin inhibitor is HCA2969 (carotegrast); or a pharmaceutically acceptable salt thereof. In other embodiments, the integrin inhibitor is a peptide integrin inhibitor. In some embodiments, the peptide integrin inhibitor is PTG-100 or PN-10943 (also known as PN-943).

In some embodiments, the additional agent is an anti-TNF agent selected from the group consisting of infliximab, golimumab, certolizumab, certolizumab pegol and etanercept; and biosimilars thereof. In a preferred embodiment, the anti-TNF agent is adalimumab or a biosimilar thereof.

Methods of Preparing a Pharmaceutical Composition

Also provided herein method of preparing a pharmaceutical composition including an immune modulator (e.g., any of the immune modulators described herein or known in the art) that include: (a) topically administering a dose of an immune modulator to a small intestine and/or colon of a mammal (e.g., any of the animal models of disease described herein or a human having any of the diseases described herein); (b) following step (a), selecting an immune modulator determined to result in (i) a decrease (e.g., a 1% decrease to a 99% decrease, or any of the subranges of this range described herein, e.g., a 50% decrease to a 99% decrease, or a 90% decrease to a 99% decrease) in one or both of the level of T cells in a mesenteric lymph node and the level of T cells in a Peyer's patch in the mammal, and (ii) an increase (e.g., a 1% increase to a 500% increase, or any of the subranges of this range described herein, or at least a 5% increase, at least a 10% increase, at least a 15% increase, at least a 20% increase, at least a 25% increase, a 10% increase to a 500% increase, a 15% increase to a 500% increase, a 20% increase to a 500% increase, or a 25% increase to a 500% increase) in the level of T cells in blood in the mammal, each as compared to the corresponding level in a control mammal systemically (e.g., orally, intravenously, intramuscularly, or subcutaneously) administered the same dose of the immune modulator; and (c) preparing a pharmaceutical composition comprising the selected immune modulator.

Also provided herein are methods of preparing a pharmaceutical composition including an immune modulator (e.g., any of the immune modulators described herein or known in the art) that includes preparing a pharmaceutical composition including an immune modulator identified as resulting in a mammal (e.g., any of the animal models of disease described herein or a human having any of the diseases described herein) topically administered a dose of an immune modulator to the small intestine and/or colon of the mammal: (i) a decrease (e.g., a 1% decrease to a 99% decrease, or any of the subranges of this range described herein) in one or both of the level of T cells in a mesenteric lymph node and the level of T cells in a Peyer's patch in a mammal, and (ii) an increase (e.g., a 1% increase to a 500% increase, or any of the subranges of this range described herein) in the level of T cells in blood in the mammal, each as compared to the corresponding level in a control mammal systemically (e.g., orally, intravenously, intramuscularly, or subcutaneously) administered the same dose of the immune modulator.

Methods for determining the level of T cells (e.g., Th memory cells) in the blood, mesenteric lymph nodes, and Peyer's patches are known in the art. Exemplary methods for determining the level of T cells (e.g., Th memory cells) in the blood, mesenteric lymph nodes, and Peyer's patches are described in the Examples.

In some embodiments of any of these methods, the level of T cells in the mesenteric lymph node is the level of Th memory cells in the mesenteric lymph node. In some embodiments of any of these methods, the level of T cells in the Peyer's patch is the level of Th memory cells in the Peyer's patch. In some embodiments of these methods, the level of T cells in the blood is the level of Th memory cells in the blood.

In some embodiments of any of these methods, the control mammal is a mammal of a similar age and having a similar disease state as compared to the mammal topically administered the dose of the immune modulator. In some embodiments of any of these methods, the immune modulator is selected from the group of: IL-12/IL-23 inhibitors, TNFα inhibitors, IL-6 receptor inhibitors, JAK inhibitors, CD3 inhibitors, CD40/CD40L inhibitors, IL-1 inhibitors, IL-13 inhibitors, IL-10 receptor agonists, integrin inhibitors, and S1P antagonists.

In some embodiments, the pharmaceutical composition includes an additional agent, such as an agent useful for treating an inflammatory disease or condition that arises in a tissue originating from the endoderm of a subject. In some embodiments, the additional agent is a corticosteroid, an aminosalicylate, a PDE4 inhibitor, an SIP modulator, a JAK inhibitor, an integrin inhibitor, an IL-12/IL-23 inhibitor, a CD3 inhibitor, recombinant GM-CSF, or an anti-TNF agent.

In some embodiments of any of these methods, the pharmaceutical composition is an ingestible device that contains a therapeutically effective amount of the immune modulator disposed therein (e.g., any of the examples of ingestible devices described herein). Also provided herein are pharmaceutical compositions prepared by any of the methods described herein. Also provided herein are kits that include any of the pharmaceutical compositions described herein.

Endoscopes, Ingestible Devices, and Reservoirs

The GI tract can be imaged using endoscopes, or more recently ingestible devices that are swallowed.

The technology behind standard colonoscopy consists of a long, semi-rigid insertion tube with a steerable tip (stiff if compared to the colon), which is pushed by the physician from the outside. However, invasiveness, patient discomfort, fear of pain, and—more often than not—the need for conscious sedation limit the take-up of screening colonoscopy. Diagnosis and treatment in the GI tract are dominated by the use of flexible endoscopes. A few large companies, namely Olympus Medical Systems Co. (Tokyo, Japan), Pentax Medical Co. (Montvale, NJ, USA), Fujinon, Inc. (Wayne, NJ, USA) and Karl Storz GmbH & Co. KG (Tuttlingen, Germany), cover the majority of the market in flexible GI endoscopy.

Endoscopes may comprise a catheter. As an example, the catheter may be a spray catheter. As an example, a spray catheter may be used to deliver dyes for diagnostic purposes. As an example, a spray catheter may be used to deliver a therapeutic agent at an intended site in the GI tract. For example, the Olympus PW-205V is a ready-to-use spray catheter that enables efficient spraying for maximal differentiation of tissue structures during endoscopy, but may also be used to deliver drugs.

In a review of robotic endoscopic capsules, Journal of Micro-Bio Robotics 11.1-4 (2016): 1-18, Ciuti et al. state that progress in micro-electromechanical systems (MEMS) technologies have led to the development of new endoscopic capsules with enhanced diagnostic capabilities, in addition to traditional visualization of mucosa (embedding, e.g. pressure, pH, blood detection and temperature sensors).

Endoscopic capsules, however, do not have the capability of accurately locating a site autonomously. They require doctor oversight over a period of hours in order to manually determine the location. Autonomous ingestible devices are advantageous in that regard.

Methods and Mechanisms for Localization

In addition to, or as an alternative, to directly visualizing the GI tract, one or more different mechanisms can be used to determine the location of an ingestible device within the GI tract. Various implementations may be used for localization of ingestible devices within the GI tract. For example, certain implementations can include one or more electromagnetic sensor coils, magnetic fields, electromagnetic waves, electric potential values, ultrasound positioning systems, gamma scintigraphy techniques or other radio-tracker technology have been described by others. Alternatively, imaging can be used to localize, for example, using anatomical landmarks or more complex algorithms for 3D reconstruction based on multiple images. Other technologies rely on radio frequency, which relies on sensors placed externally on the body to receive the strength of signals emitted by the capsule. Ingestible devices may also be localized based on reflected light in the medium surrounding the device; pH; temperature; time following ingestion; and/or acoustic signals.

The disclosure provides an ingestible device, as well as related systems and methods that provide for determining the position of the ingestible device within the GI tract of a subject with very high accuracy. In some embodiments, the ingestible device can autonomously determine its position within the GI tract of the subject.

Typically, the ingestible device includes one or more processing devices, and one more machine readable hardware storage devices. In some embodiments, the one or more machine readable hardware storage devices store instructions that are executable by the one or more processing devices to determine the location of the ingestible device in a portion of a GI tract of the subject. In certain embodiments, the one or more machine readable hardware storage devices store instructions that are executable by the one or more processing devices to transmit data to an external device (e.g., a base station external to the subject, such as a base station carried on an article worn by the subject) capable of implementing the data to determine the location of the device within the GI tract of the subject.

In some embodiments, the location of the ingestible device within the GI tract of the subject can be determined to an accuracy of at least 85%, e.g., at least 90%, at least 95%, at least 97%, at least 98%, at least 99%, 100%. In some embodiments, the location of the ingestible device within the GI tract of the subject can be determined to an accuracy of at least 85%, e.g., at least 90%, at least 95%, at least 97%, at least 98%, at least 99%, 100%. In such embodiments, the portion of the GI tract of the subject can include, for example, the esophagus, the stomach, duodenum, the jejunum, and/or the terminal ileum, cecum and colon. An exemplary and non-limiting embodiment is provided below in Example 14.

In certain embodiments, the location of the ingestible device within the esophagus of the subject can be determined to an accuracy of at least 85%, e.g., at least 90%, at least 95%, at least 97%, at least 98%, at least 99%, 100%. An exemplary and non-limiting embodiment is provided below in Example 14.

In some embodiments, the location of the ingestible device within the stomach of the subject can be determined to an accuracy of at least 85%, e.g., at least 90%, at least 95%, at least 97%, at least 98%, at least 99%, 100%. An exemplary and non-limiting embodiment is provided below in Example 14.

In certain embodiments, the location of the ingestible device within the duodenum of the subject can be determined to an accuracy of at least 85%, e.g., at least 90%, at least 95%, at least 97%, at least 98%, at least 99%, 100%. An exemplary and non-limiting embodiment is provided below in Example 14.

In some embodiments, the location of the ingestible device within the jejunum of the subject can be determined to an accuracy of at least 85%, e.g., at least 90%, at least 95%, at least 97%, at least 98%, at least 99%, 100%. An exemplary and non-limiting embodiment is provided below in Example 14.

In certain embodiments, the location of the ingestible device within the terminal ileum, cecum and colon of the subject can be determined to an accuracy of at least 85%, e.g., at least 90%, at least 95%, at least 97%, at least 98%, at least 99%, 100%.

In some embodiments, the location of the ingestible device within the cecum of the subject can be determined to an accuracy of at least 85%, e.g., at least 90%, at least 95%, at least 97%, at least 98%, at least 99%, 100%. An exemplary and non-limiting embodiment is provided below in Example 14. In such embodiments, the portion of the portion of the GI tract of the subject can include, for example, the esophagus, the stomach, duodenum, the jejunum, and/or the terminal ileum, cecum and colon.

In certain embodiments, the location of the ingestible device within the esophagus of the subject can be determined to an accuracy of at least 85%, e.g., at least 90%, at least 95%, at least 97%, at least 98%, at least 99%, 100%.

In some embodiments, the location of the ingestible device within the stomach of the subject can be determined to an accuracy of at least 85%, e.g., at least 90%, at least 95%, at least 97%, at least 98%, at least 99%, 100%.

In certain embodiments, the location of the ingestible device within the duodenum of the subject can be determined to an accuracy of at least 85%, e.g., at least 90%, at least 95%, at least 97%, at least 98%, at least 99%, 100%.

In some embodiments, the location of the ingestible device within the jejunum of the subject can be determined to an accuracy of at least 85%, e.g., at least 90%, at least 95%, at least 97%, at least 98%, at least 99%, 100%.

In certain embodiments, the location of the ingestible device within the terminal ileum, cecum and colon of the subject can be determined to an accuracy of at least 85%, e.g., at least 90%, at least 95%, at least 97%, at least 98%, at least 99%, 100%.

In some embodiments, the location of the ingestible device within the cecum of the subject can be determined to an accuracy of at least 85%, e.g., at least 90%, at least 95%, at least 97%, at least 98%, at least 99%, 100%.

As used herein, the term "reflectance" refers to a value derived from light emitted by the device, reflected back to the device, and received by a detector in or on the device. For example, in some embodiments this refers to light emitted by the device, wherein a portion of the light is reflected by a surface external to the device, and the light is received by a detector located in or on the device.

As used herein, the term "illumination" refers to any electromagnetic emission. In some embodiments, an illumination may be within the range of Infrared Light (IR), the visible spectrum and ultraviolet light (UV), and an illumination may have a majority of its power centered at a particular wavelength in the range of 100 nm to 1000 nm. In some embodiments, it may be advantageous to use an illumination with a majority of its power limited to one of the infrared (750 nm-1000 nm), red (600 nm-750 nm), green (495 nm-600 nm), blue (400 nm-495 nm), or ultraviolet (100 nm-400 nm) spectrums. In some embodiments a plurality of illuminations with different wavelengths may be used. For illustrative purposes, the embodiments described herein may refer to the use of green or blue spectrums of light. However, it is understood that these embodiments may use any suitable light having a wavelength that is substantially or approximately within the green or blue spectra defined above, and the localization systems and methods described herein may use any suitable spectra of light.

Figure 1:
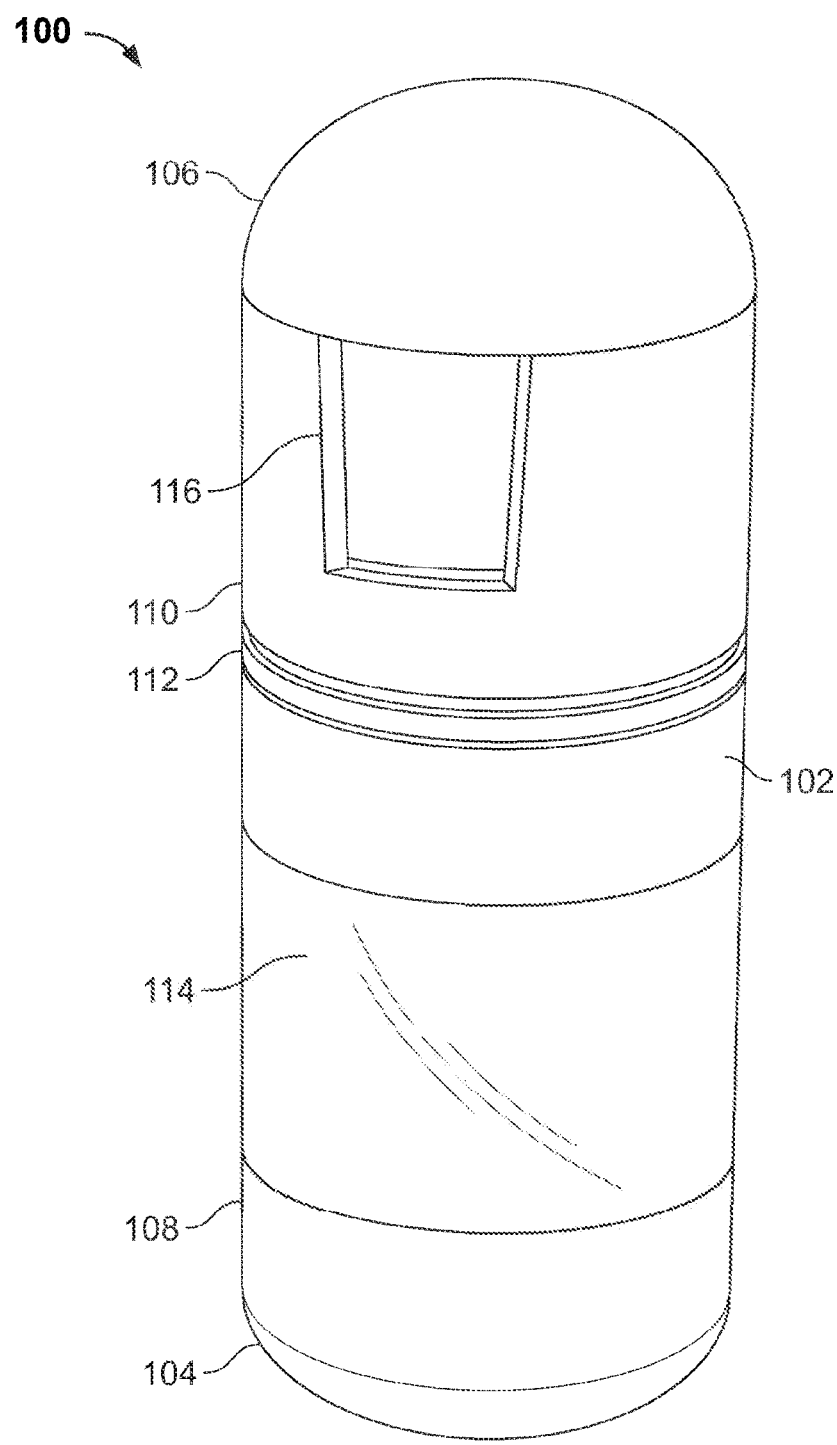
FIG. 1 is a view of an example embodiment of an ingestible device, in accordance with some embodiments of the disclosure.

Referring now to FIG. 1, shown therein is a view of an example embodiment of an ingestible device 100, which may be used to identify a location within a gastrointestinal (GI) tract. In some embodiments, ingestible device 100 may be configured to autonomously determine whether it is located in the stomach, a particular portion of the small intestine such as a duodenum, jejunum, or ileum, or the large intestine by utilizing sensors operating with different wavelengths of light. Additionally, ingestible device 100 may be configured to autonomously determine whether it is located within certain portions of the small intestine or large intestine, such as the duodenum, the jejunum, the cecum, or the colon.

Ingestible device 100 may have a housing 102 shaped similar to a pill or capsule. The housing 102 of ingestible device 100 may have a first end portion 104, and a second end portion 106. The first end portion 104 may include a first wall portion 108, and second end portion 106 may include a second wall portion 110. In some embodiments, first end portion 104 and second end portion 106 of ingestible device 100 may be manufactured separately, and may be affixed together by a connecting portion 112.

In some embodiments, ingestible device 100 may include an optically transparent window 114. Optically transparent window 114 may be transparent to various types of illumination in the visible spectrum, infrared spectrum, or ultraviolet light spectrum, and ingestible device 100 may have various sensors and illuminators located within the housing 102, and behind the transparent window 114. This may allow ingestible device 100 to be configured to transmit illumination at different wavelengths through transparent window 114 to an environment external to housing 102 of ingestible device 100, and to detect a reflectance from a portion of the illumination that is reflected back through transparent window 114 from the environment external to housing 102. Ingestible device 100 may then use the detected level of reflectance in order to determine a location of ingestible device 100 within a GI tract. In some embodiments, optically transparent window 114 may be of any shape and size, and may wrap around the circumference of ingestible device 100. In this case, ingestible device 100 may have multiple sets of sensors and illuminators positioned at different locations azimuthally behind window 114.

In some embodiments, ingestible device 100 may optionally include an opening 116 in the second wall portion 110. In some embodiments, the second wall portion 110 may be configured to rotate around the longitudinal axis of ingestible device 100 (e.g., by means of a suitable motor or other actuator housed within ingestible device 100). This may allow ingestible device 100 to obtain a fluid sample from the GI tract, or release a substance into the GI tract, through opening 116.

Figure 2:
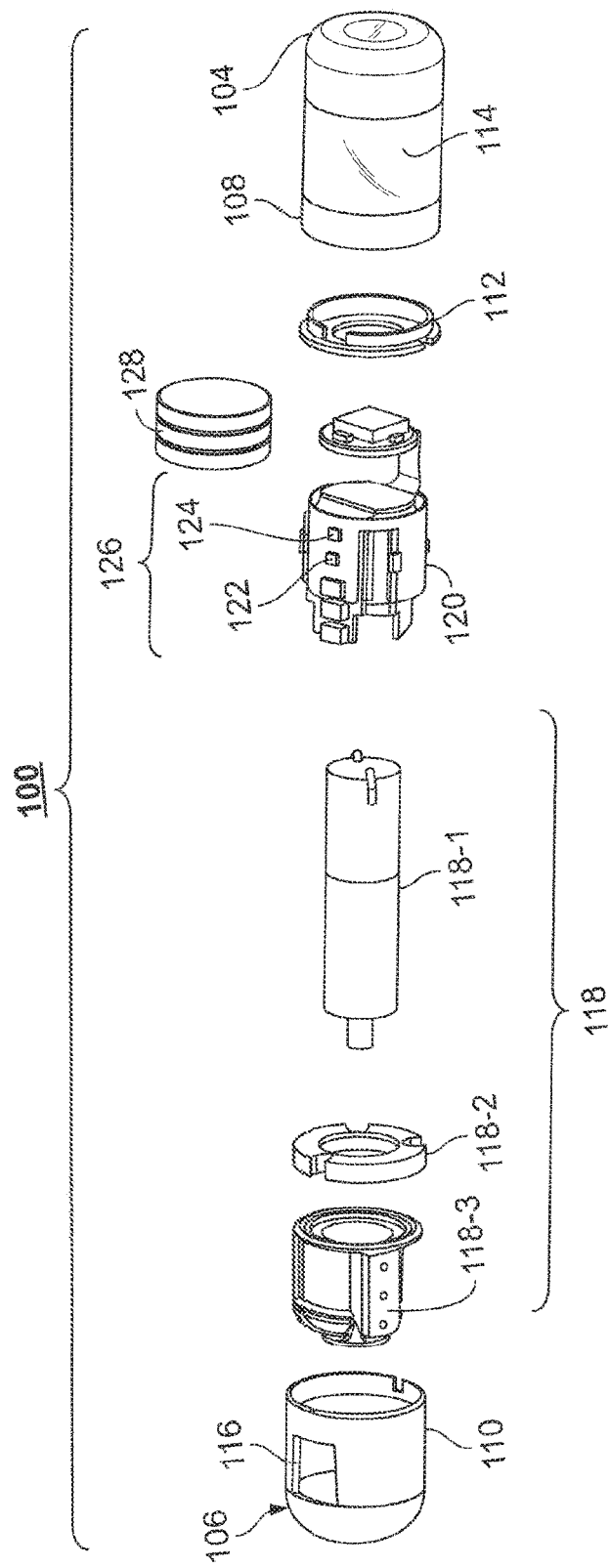
FIG. 2 is an exploded view of the ingestible device of FIG. 1, in accordance with some embodiments of the disclosure.

FIG. 2 shows an exploded view of ingestible device 100. In some embodiments, ingestible device 100 may optionally include a rotation assembly 118. Optional rotation assembly 118 may include a motor 118-1 driven by a microcontroller (e.g., a microcontroller coupled to printed circuit board 120), a rotation position sensing ring 118-2, and a storage sub-unit 118-3 configured to fit snugly within the second end portion 104. In some embodiments, rotation assembly 118 may cause second end portion 104, and opening 116, to rotate relative to the storage sub-unit 118-3. In some embodiments, there may be cavities on the side of storage sub-unit 118-3 that function as storage chambers. When the opening 116 is aligned with a cavity on the side of the storage sub-unit 118-3, the cavity on the side of the storage sub-unit 118-3 may be exposed to the environment external to the housing 102 of ingestible device 100. In some embodiments, the storage sub-unit 118-3 may be loaded with a medicament or other substance prior to the ingestible device 100 being administered to a subject. In this case, the medicament or other substance may be released from the ingestible device 100 by aligning opening 116 with the cavity within storage sub-unit 118-3. In some embodiments, the storage sub-unit 118-3 may be configured to hold a fluid sample obtained from the GI tract. For example, ingestible device 100 may be configured to align opening 116 with the cavity within storage sub-unit 118-3, thus allowing a fluid sample from the GI tract to enter the cavity within storage sub-unit 118-3. Afterwards, ingestible device 100 may be configured to seal the fluid sample within storage sub-unit 118-3 by further rotating the second end portion 106 relative to storage sub-unit 118-3. In some embodiments, storage sub-unit 118-3 may also contain a hydrophilic sponge, which may enable ingestible device 100 to better draw certain types of fluid samples into ingestible device 100. In some embodiments, ingestible device 100 may be configured to either obtain a sample from within the GI tract, or to release a substance into the GI tract, in response to determining that ingestible device 100 has reached a predetermined location within the GI tract. For example, ingestible device 100 may be configured to obtain a fluid sample from the GI tract in response to determining that the ingestible device has entered the jejunum portion of the small intestine (e.g., as determined by process 900 discussed in relation to FIG. 9). Other ingestible devices capable of obtaining samples or releasing substances are discussed in commonly-assigned PCT Application No. PCT/CA2013/000133 filed Feb. 15, 2013, commonly-assigned U.S. Provisional Application No. 62/385,553, and commonly-assigned U.S. Provisional Application No. 62/376,688, which each are hereby incorporated by reference herein in their entirety. It is understood that any suitable method of obtaining samples or releasing substances may be incorporated into some of the embodiments of the ingestible devices disclosed herein, and that the systems and methods for determining a location of an ingestible device may be incorporated into any suitable type of ingestible device.

Ingestible device 100 may include a printed circuit board (PCB) 120, and a battery 128 configured to power PCB 120. PCB 120 may include a programmable microcontroller, and control and memory circuitry for holding and executing firmware or software for coordinating the operation of ingestible device 100, and the various components of ingestible device 100. For example, PCB 120 may include memory circuitry for storing data, such as data sets of measurements collected by sensing sub-unit 126, or instructions to be executed by control circuitry to implement a localization process, such as, for example, one or more of the processes, discussed herein, including those discussed below in connection with one or more of the associated flow charts. PCB 120 may include a detector 122 and an illuminator 124, which together form sensing sub-unit 126. In some embodiments, control circuitry within PCB 120 may include processing units, communication circuitry, or any other suitable type of circuitry for operating ingestible device 100. For illustrative purposes, only a single detector 122 and a single illuminator 124 forming a single sensing sub-unit 126 are shown. However, it is understood that in some embodiments there may be multiple sensing sub-units, each with a separate illuminator and detector, within ingestible device 100. For example, there may be several sensing sub-units spaced azimuthally around the circumference of the PCB 120, which may enable ingestible device 100 to transmit illumination and detect reflectances or ambient light in all directions around the circumference of the device. In some embodiments, sensing sub-unit 126 may be configured to generate an illumination using illuminator 124, which is directed through the window 114 in a radial direction away from ingestible device 100. This illumination may reflect off of the environment external to ingestible device 100, and the reflected light coming back into ingestible device 100 through window 114 may be detected as a reflectance by detector 122.

In some embodiments, window 114 may be of any suitable shape and size. For example, window 114 may extend around a full circumference of ingestible device 100. In some embodiments there may be a plurality of sensing sub-units (e.g., similar to sensing sub-unit 126) located at different positions behind the window. For example, three sensing sub-units may be positioned behind the window at the same longitudinal location, but spaced 120 degrees apart azimuthally. This may enable ingestible device 100 to transmit illuminations in all directions radially around ingestible device 100, and to measure each of the corresponding reflectances.

In some embodiments, illuminator 124 may be capable of producing illumination at a variety of different wavelengths in the ultraviolet, infrared, or visible spectrum. For example, illuminator 124 may be implemented by using Red-Green-Blue Light-Emitting diode packages (RGB-LED). These types of RGB-LED packages are able to transmit red, blue, or green illumination, or combinations of red, blue, or green illumination. Similarly, detector 122 may be configured to sense reflected light of the same wavelengths as the illumination produced by illuminator 124. For example, if illuminator 124 is configured to produce red, blue, or green illumination, detector 122 may be configured to detect different reflectances produced by red, blue, or green illumination (e.g., through the use of an appropriately configured photodiode). These detected reflectances may be stored by ingestible device 100 (e.g., within memory circuitry of PCB 120), and may then be used by ingestible device 100 in determining a location of ingestible device 100 within the GI tract (e.g., through the use of process 500 (FIG. 5), process 600 (FIG. 6), or process 900 (FIG. 9)).

It is understood that ingestible device 100 is intended to be illustrative, and not limiting. It will be understood that modifications to the general shape and structure of the various devices and mechanisms described in relation to FIG. 1 and FIG. 2 may be made without significantly changing the functions and operations of the devices and mechanisms. For example, ingestible device 100 may have a housing formed from a single piece of molded plastic, rather than being divided into a first end portion 104 and a second end portion 106. As an alternate example, the location of window 114 within ingestible device 100 may be moved to some other location, such as the center of ingestible device 100, or to one of the ends of ingestible device 100. Moreover, the systems and methods discussed in relation to FIGS. 1-10 may be implemented on any suitable type of ingestible device, provided that the ingestible device is capable of detecting reflectances or levels of illumination in some capacity. For example, in some embodiments ingestible device 100 may be modified to replace detector 122 with an image sensor, and the ingestible device may be configured to measure relative levels of red, blue, or green light by decomposing a recorded image into its individual spectral components. Other examples of ingestible devices with localization capabilities, which may be utilized in order to implement the systems and methods discussed in relation to FIG. 1-11, are discussed in co-owned PCT Application No. PCT/US2015/052500 filed on Sep. 25, 2015, which is hereby incorporated by reference herein in its entirety. Furthermore, it should be noted that the features and limitations described in any one embodiment may be applied to any other embodiment herein, and the descriptions and examples relating to one embodiment may be combined with any other embodiment in a suitable manner.

Figure 3:
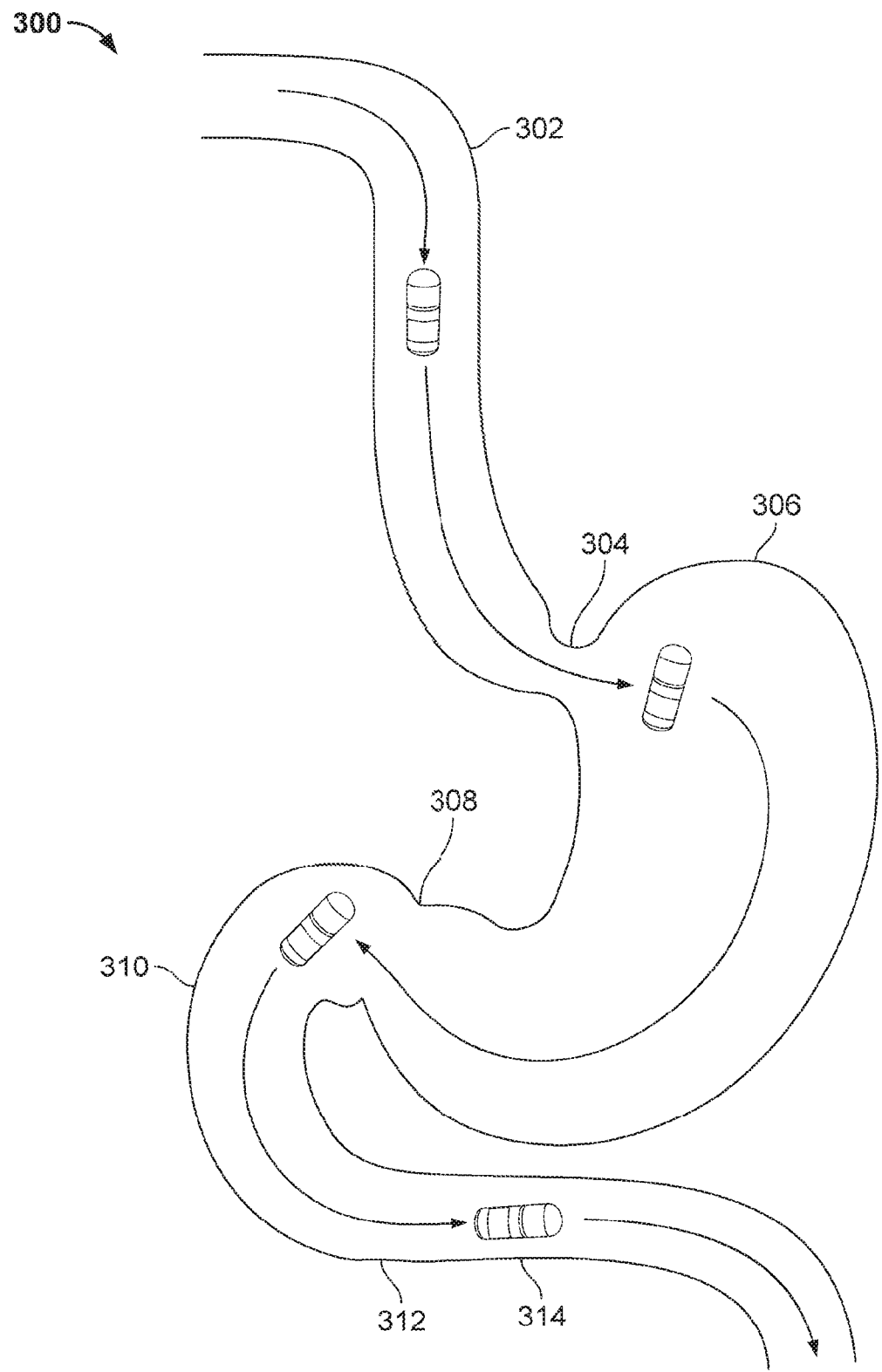
FIG. 3 is a diagram of an ingestible device during an example transit through a GI tract, in accordance with some embodiments of the disclosure.

FIG. 3 is a diagram of an ingestible device during an example transit through a gastrointestinal (GI) tract, in accordance with some embodiments of the disclosure. Ingestible device 300 may include any portion of any other ingestible device discussed in this disclosure (e.g., ingestible device 100 (FIG. 1)), and may be any suitable type of ingestible device with localization capabilities. For example, ingestible device 300 may be one embodiment of ingestible device 100 without the optional opening 116 (FIG. 1) or optional rotation assembly 118 (FIG. 2)). In some embodiments, ingestible device 300 may be ingested by a subject, and as ingestible device 300 traverses the GI tract, ingestible device 300 may be configured to determine its location within the GI tract. For example, the movement of ingestible device 300 and the amount of light detected by ingestible device 300 (e.g., via detector 122 (FIG. 2)) may vary substantially depending on the location of ingestible device 300 within the GI tract, and ingestible device 300 may be configured to use this information to determine a location of ingestible device 300 within the GI tract. For instance, ingestible device 300 may detect ambient light from the surrounding environment, or reflectances based on illumination generated by ingestible device 300 (e.g., generated by illuminator 124 (FIG. 1)), and use this information to determine a location of ingestible device 300 through processes, such as described herein. The current location of ingestible device 300, and the time that ingestible device 300 detected each transition between the various portions of the GI tract, may then be stored by ingestible device 300 (e.g., in memory circuitry of PCB 120 (FIG. 2)), and may be used for any suitable purpose.

Shortly after ingestible device 300 is ingested, ingestible device will traverse the esophagus 302, which may connect the subject's mouth to a stomach 306. In some embodiments, ingestible device 300 may be configured to determine that it has entered the esophagus portion GI tract by measuring the amount and type of light (e.g., via detector 122 (FIG. 2)) in the environment surrounding the ingestible device 300. For instance, ingestible device 300 may detect higher levels of light in the visible spectrum (e.g., via detector 122 (FIG. 2)) while outside the subject's body, as compared to the levels of light detected while within the GI tract. In some embodiments, ingestible device 300 may have previously stored data (e.g., on memory circuitry of PCB 120 (FIG. 2)) indicating a typical level of light detected when outside of the body, and the ingestible device 300 may be configured to determine that entry to the body has occurred when a detected level of light (e.g., detected via detector 122 (FIG. 2)) has been reduced beyond a threshold level (e.g., at least a 20-30% reduction) for a sufficient period of time (e.g., 5.0 seconds).

In some embodiments, ingestible device 300 may be configured to detect a transition from esophagus 302 to stomach 306 by passing through sphincter 304. In some embodiments, ingestible device 300 may be configured to determine whether it has entered stomach 306 based at least in part on a plurality of parameters, such as but not limited to the use of light or temperature measurements (e.g., via detector 122 (FIG. 2) or via a thermometer within ingestible device 300), pH measurements (e.g., via a pH meter within ingestible device 300), time measurements (e.g., as detected through the use of clock circuitry included within PCB 120 (FIG. 2)), or any other suitable information. For instance, ingestible device 300 may be configured to determine that ingestible device 300 has entered stomach 306 after detecting that a measured temperature of ingestible device 300 exceeds 31 degrees Celsius. Additionally or alternately, ingestible device 300 may be configured to automatically determine it has entered stomach 306 after one minute (or another pre-set time duration parameter, 80 seconds, 90 seconds, etc.) has elapsed from the time that ingestible device 300 was ingested, or one minute (or another pre-set time duration parameter, 80 seconds, 90 seconds, etc.) from the time that ingestible device 300 detected that it has entered the GI tract.

Stomach 306 is a relatively large, open, and cavernous organ, and therefore ingestible device 300 may have a relatively large range of motion. By comparison, the motion of ingestible device 300 is relatively restricted within the tube-like structure of the duodenum 310, the jejunum 314, and the ileum (not shown), all of which collectively form the small intestine.

Additionally, the interior of stomach 306 has distinct optical properties from duodenum 310 and jejunum 314, which may enable ingestible device 300 to detect a transition from stomach 306 to duodenum 310 through the appropriate use of measured reflectances (e.g., through the use of reflectances measured by detector 122 (FIG. 2)), as used in conjunction with process 600 (FIG. 6)).

In some embodiments, ingestible device 300 may be configured to detect a pyloric transition from stomach 306 to duodenum 310 through the pylorus 308. For instance, in some embodiments, ingestible device 300 may be configured to periodically generate illumination in the green and blue wavelengths (e.g., via illuminator 124 (FIG. 2)), and measure the resulting reflectances (e.g., via detector 122 (FIG. 2)). Ingestible device 300 may be configured to then use a ratio of the detected green reflectance to the detected blue reflectance to determine whether ingestible device 300 is located within the stomach 306, or duodenum 310 (e.g., via process 600 (FIG. 6)). In turn, this may enable ingestible device 300 to detect a pyloric transition from stomach 306 to duodenum 310, an example of which is discussed in relation to FIG. 6.

Similarly, in some embodiments, ingestible device 300 may be configured to detect a reverse pyloric transition from duodenum 310 to stomach 306. Ingestible device 300 will typically transition naturally from stomach 306 to duodenum 310, and onward to jejunum 314 and the remainder of the GI tract. However, similar to other ingested substances, ingestible device 300 may occasionally transition from duodenum 310 back to stomach 306 as a result of motion of the subject, or due to the natural behavior of the organs with the GI tract. To accommodate this possibility, ingestible device 300 may be configured to continue to periodically generate illumination in the green and blue wavelengths (e.g., via illuminator 124 (FIG. 2)), and measure the resulting reflectances (e.g., via detector 122 (FIG. 2)) to detect whether or not ingestible device 300 has returned to stomach 306. An exemplary detection process is described in additional detail in relation to FIG. 6.

After entering duodenum 310, ingestible device 300 may be configured to detect a transition to the jejunum 314 through the duodenojejunal flexure 312. For example, ingestible device 300 may be configured to use reflectances to detect peristaltic waves within the jejunum 314, caused by the contraction of the smooth muscle tissue lining the walls of the jejunum 314. In particular, ingestible device 300 may be configured to begin periodically transmitting illumination (and measuring the resulting reflectances (e.g., via detector 122 and illuminator 124 of sensing sub-unit 126 (FIG. 2)) at a sufficiently high frequency in order to detect muscle contractions within the jejunum 314. Ingestible device 300 may then determine that it has entered the jejunum 314 in response to having detected either a first muscle contraction, or a predetermined number of muscle contractions (e.g., after having detected three muscle contractions in sequence). The interaction of ingestible device 300 with the walls of jejunum 314 is also discussed in relation to FIG. 4, and an example of this detection process is described in additional detail in relation to FIG. 9.

Figure 4:
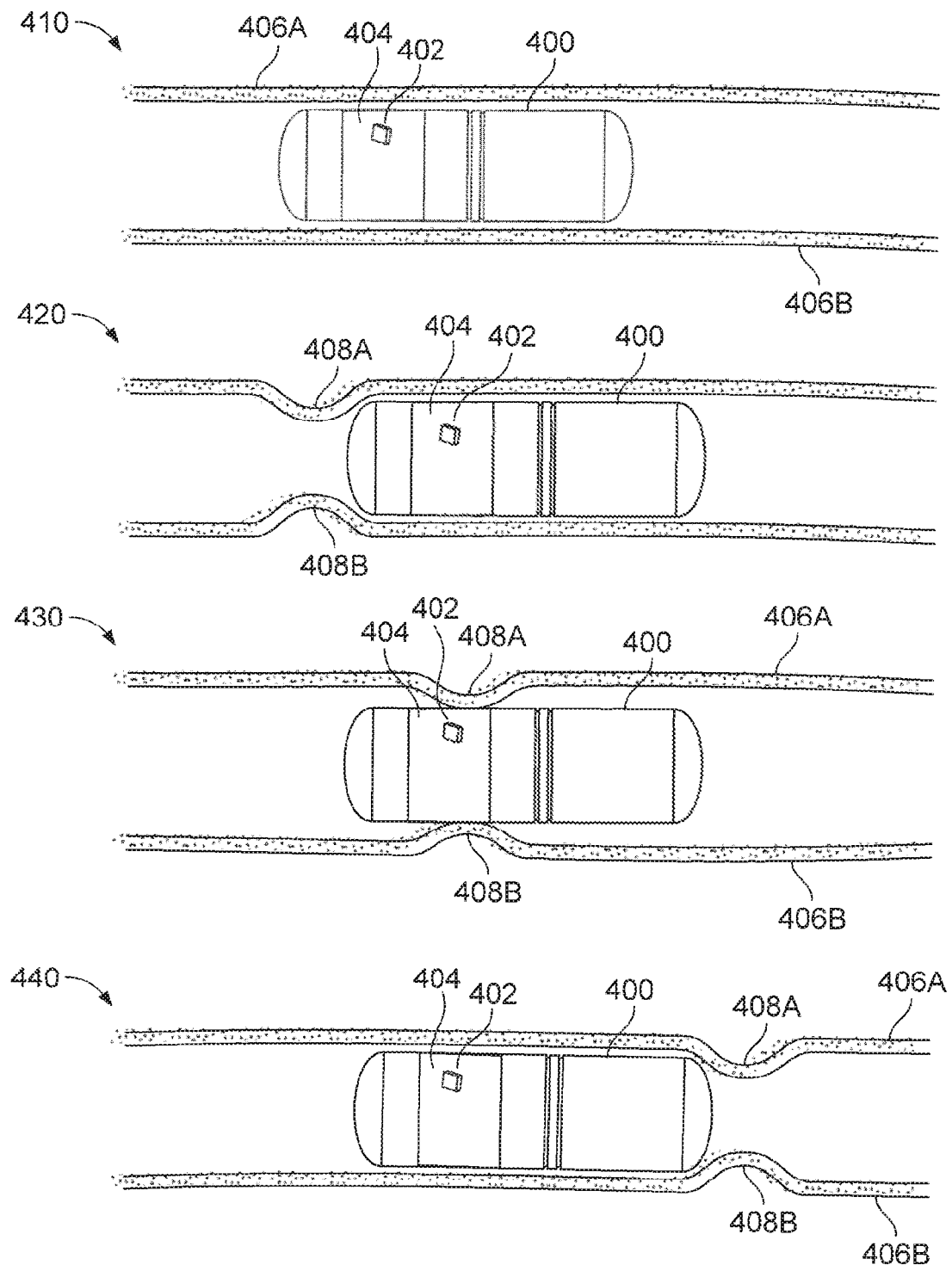
FIG. 4 is a diagram of an ingestible device during an example transit through a jejunum, in accordance with some embodiments of the disclosure.

FIG. 4 is a diagram of an ingestible device during an example transit through a jejunum, in accordance with some embodiments of the disclosure. Diagrams 410, 420, 430, and 440 depict ingestible device 400 as it traverses through a jejunum (e.g., jejunum 314), and how ingestible device 400 interacts with peristaltic waves formed by walls 406A and 406B (collectively, walls 406) of the jejunum. In some implementations, ingestible device 400 may include any portion of any other ingestible device discussed in this disclosure (e.g., ingestible device 100 (FIG. 1) or ingestible device 300 (FIG. 3)), and may be any suitable type of ingestible device with localization capabilities. For example, ingestible device 400 may be substantially similar to the ingestible device 300 (FIG. 3) or ingestible device 100 (FIG. 1), with window 404 being the same as window 114 (FIG. 1), and sensing sub-unit 402 being the same as sensing sub-unit 126 (FIG. 2).

Diagram 410 depicts ingestible device 400 within the jejunum, when the walls 406 of the jejunum are relaxed. In some embodiments, the confined tube-like structure of the jejunum naturally causes ingestible device 400 to be oriented longitudinally along the length of the jejunum, with window 404 facing walls 406. In this orientation, ingestible device 400 may use sensing sub-unit 402 to generate illumination (e.g., via illuminator 124 (FIG. 2)) oriented towards walls 406, and to detect the resulting reflectances (e.g., via detector 122 (FIG. 2)) from the portion of the illumination reflected off of walls 406 and back through window 404. In some embodiments, ingestible device 400 may be configured to use sensing sub-unit 402 to generate illumination and measure the resulting reflectance with sufficient frequency to detect peristaltic waves within the jejunum. For instance, in a healthy human subject, peristaltic waves may occur at a rate of approximately 0.1 Hz to 0.2 Hz. Therefore, the ingestible device 400 may be configured to generate illumination and measure the resulting reflectance at least once every 2.5 seconds (i.e., the minimum rate necessary to detect a 0.2 Hz signal), and preferably at a higher rate, such as once every 0.5 seconds, which may improve the overall reliability of the detection process due to more data points being available. It is understood that the ingestible device 400 need not gather measurements at precise intervals, and in some embodiments the ingestible device 400 may be adapted to analyze data gathered at more irregular intervals, provided that there are still a sufficient number of appropriately spaced data points to detect 0.1 Hz to 0.2 Hz signals.

Diagram 420 depicts ingestible device 400 within the jejunum, when the walls 406 of the jejunum begin to contract and form a peristaltic wave. Diagram 420 depicts contracting portion 408A of wall 406A and contracting portion 408B of wall 406B (collectively, contracting portion 408 of wall 406) that form a peristaltic wave within the jejunum. The peristaltic wave proceeds along the length of the jejunum as different portions of wall 406 contract and relax, causing it to appear as if contracting portions 408 of wall 406 proceed along the length of the jejunum (i.e., as depicted by contracting portions 408 proceeding from left to right in diagrams 410-430). While in this position, ingestible device 400 may detect a similar level of reflectance (e.g., through the use of illuminator 124 and detector 122 of sensing sub-unit 126 (FIG. 2)) as detected when there is no peristaltic wave occurring (e.g., as detected when ingestible device 400 is in the position indicated in diagram 410).

Diagram 430 depicts ingestible device 400 within the jejunum, when the walls 406 of the jejunum continue to contract, squeezing around ingestible device 400. As the peristaltic wave proceeds along the length of the jejunum, contracting portions 408 of wall 406 may squeeze tightly around ingestible device 400, bringing the inner surface of wall 406 into contact with window 404. While in this position, ingestible device 400 may detect a change in a reflectance detected as a result of illumination produced by sensing sub-unit 402. The absolute value of the change in the measured reflectance may depend on several factors, such as the optical properties of the window 404, the spectral components of the illumination, and the optical properties of the walls 406. However, ingestible device 400 may be configured to store a data set with the reflectance values over time, and search for periodic changes in the data set consistent with the frequency of the peristaltic waves (e.g., by analyzing the data set in the frequency domain, and searching for peaks between 0.1 Hz to 0.2 Hz). This may enable ingestible device 400 to detect muscle contractions due to peristaltic waves without foreknowledge of the exact changes in reflectance signal amplitude that may occur as a result of detecting the muscle contractions of the peristaltic wave. An example procedure for detecting muscle contractions is discussed further in relation to FIG. 9, and an example of a reflectance data set gathered while ingestible device 400 is located within the jejunum is discussed in relation to FIG. 10.

Diagram 440 depicts ingestible device 400 within the jejunum, when the peristaltic wave has moved past ingestible device 400. Diagram 440 depicts contracting portions 408 that form the peristaltic wave within the jejunum having moved past the end of ingestible device 400. The peristaltic wave proceeds along the length of the jejunum as different portions of wall 406 contract and relax, causing it to appear as if contracting portions 408 of wall 406 proceed along the length of the jejunum (i.e., as depicted by contracting portions 408 proceeding from left to right in diagrams 410-430). While in this position, ingestible device 400 may detect a similar level of reflectance (e.g., through the use of illuminator 124 and detector 122 of sensing sub-unit 126 (FIG. 2)) as detected when there is no peristaltic wave occurring (e.g., as detected when ingestible device 400 is in the position indicated in diagram 410, or diagram 420).

Depending on the species of the subject, peristaltic waves may occur relatively with relatively predictable regularity. After the peristaltic wave has passed over ingestible device 400 (e.g., as depicted in diagram 440), the walls 406 of the jejunum may relax again (e.g., as depicted in diagram 410), until the next peristaltic wave begins to form. In some embodiments, ingestible device 400 may be configured to continue to gather reflectance value data while it is within the GI tract, and may store a data set with the reflectance values over time. This may allow ingestible device 400 to detect each of the muscle contractions as the peristaltic wave passes over ingestible device 400 (e.g., as depicted in diagram 430), and may enable ingestible device 400 to both count the number of muscle contractions that occur, and to determine that a current location of the ingestible device 400 is within the jejunum. For example, ingestible device 400 may be configured to monitor for possible muscle contractions while is inside either the stomach or the duodenum, and may determine that ingestible device 400 has moved to the jejunum in response to detecting a muscle contraction consistent with a peristaltic wave.

Figure 5:
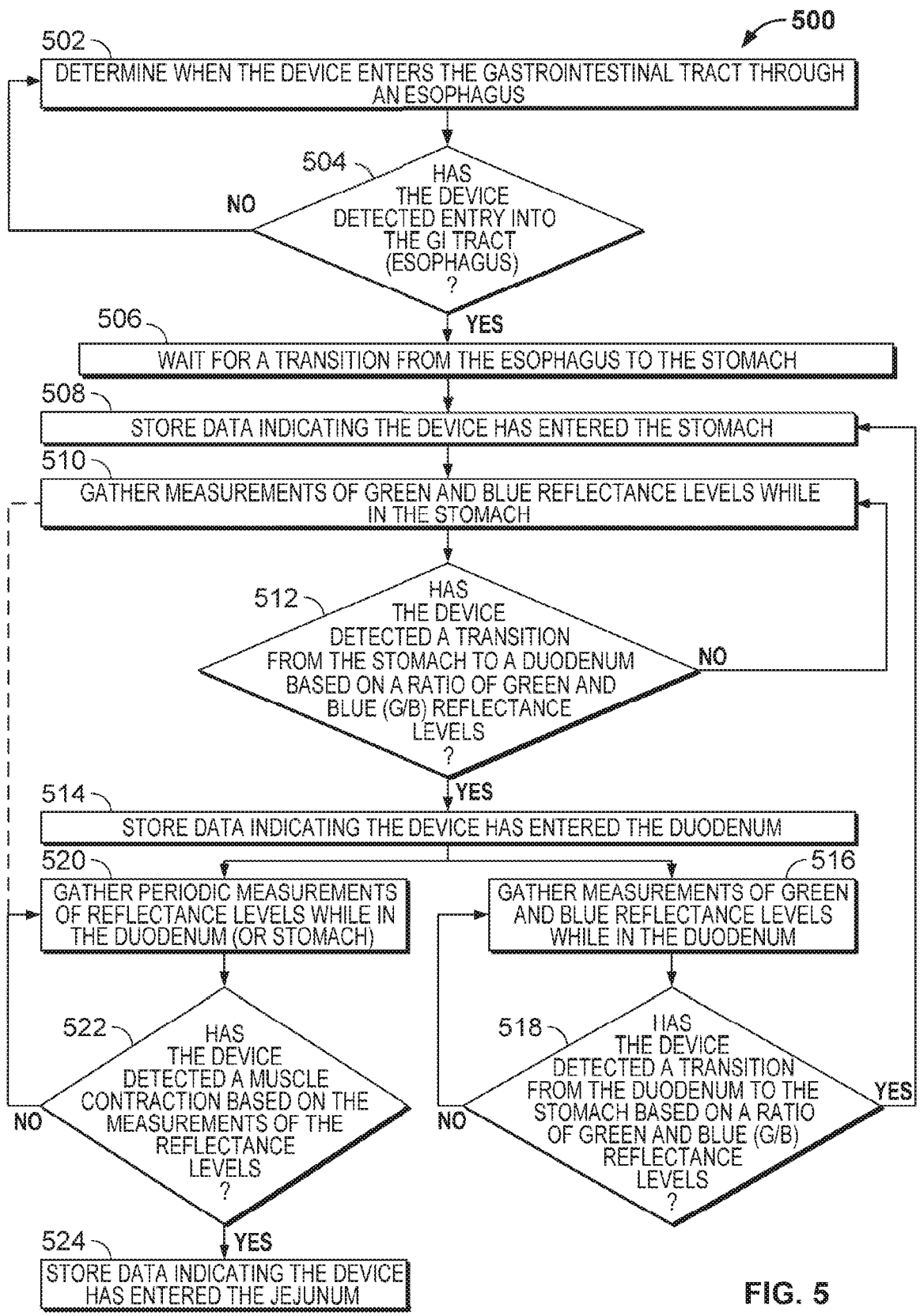
FIG. 5 is a flowchart of illustrative steps for determining a location of an ingestible device as it transits through a GI tract, in accordance with some embodiments of the disclosure.

FIG. 5 is a flowchart illustrating some aspects of a localization process used by the ingestible device. Although FIG. 5 may be described in connection with the ingestible device 100 for illustrative purposes, this is not intended to be limiting, and either portions or the entirety of the localization procedure 500 described in FIG. 5 may be applied to any device discussed in this application (e.g., the ingestible devices 100, 300, and 400), and any of the ingestible devices may be used to perform one or more parts of the process described in FIG. 5. Furthermore, the features of FIG. 5 may be combined with any other systems, methods or processes described in this application. For example, portions of the process in FIG. 5 may be integrated into or combined with the pyloric transition detection procedure described by FIG. 6, or the jejunum detection process described by FIG. 9.

At 502, the ingestible device (e.g., ingestible device 100, 300, or 400) gathers measurements (e.g., through detector 122 (FIG. 2)) of ambient light. For example, ingestible device 100 may be configured to periodically measure (e.g., through detector 122 (FIG. 2)) the level of ambient light in the environment surrounding ingestible device 100. In some embodiments, the type of ambient light being measured may depend on the configuration of detector 122 within ingestible device 100. For example, if detector 122 is configured to measure red, green, and blue wavelengths of light, ingestible device 100 may be configured to measure the ambient amount of red, green, and blue light from the surrounding environment. In some embodiments, the amount of ambient light measured by ingestible device 100 will be larger in the area external to the body (e.g., a well-lit room where ingestible device 100 is being administered to a subject) and in the oral cavity of the subject, as compared to the ambient level of light measured by ingestible device 100 when inside of an esophagus, stomach, or other portion of the GI tract (e.g., esophagus 302, stomach 306, duodenum 310, or jejunum 314 (FIG. 3)).

At 504, the ingestible device (e.g., ingestible device 100, 300, or 400) determines (e.g., via control circuitry within PCB 120 (FIG. 2)) whether the ingestible device has detected entry into the GI tract. For example, ingestible device 100 may be configured to determine when the most recent measurement of ambient light (e.g., the measurement gathered at 502) indicates that the ingestible device has entered the GI tract. For instance, the first time that ingestible device 100 gatherers a measurement of ambient light at 502, ingestible device 100 may store that measurement (e.g., via storage circuitry within PCB 120 (FIG. 2)) as a typical level of ambient light external to the body. Ingestible device 100 may be configured to then compare the most recent measurement of ambient light to the typical level of ambient light external to the body (e.g., via control circuitry within PCB 120 (FIG. 2)), and determine that ingestible device 100 has entered the GI tract when the most recent measurement of ambient light is substantially smaller than the typical level of ambient light external to the body. For example, ingestible device 100 may be configured to detect that it has entered the GI tract in response to determining that the most recent measurement of ambient light is less than or equal to 20% of the typical level of ambient light external to the body. If ingestible device 100 determines that it has detected entry into the GI tract (e.g., that ingestible device 100 has entered at least the esophagus 302 (FIG. 3)), process 500 proceeds to 506. Alternately, if ingestible device 100 determines that it has not detected entry into the GI tract (e.g., as a result of the most recent measurement being similar to the typical level of ambient light external to the body), process 500 proceeds back to 502 where the ingestible device 100 gathers further measurements. For instance, ingestible device 100 may be configured to wait a predetermined amount of time (e.g., five seconds, ten seconds, etc.), and then gather another measurement of the level of ambient light from the environment surrounding ingestible device 100.

At 506, the ingestible device (e.g., ingestible device 100, 300, or 400) waits for a transition from the esophagus to the stomach (e.g., from esophagus 302 to stomach 306 (FIG. 3)). For example, ingestible device 100 may be configured to determine that it has entered the stomach (e.g., stomach 306 (FIG. 3)) after waiting a predetermined period of time after having entered the GI tract. For instance, a typical esophageal transit time in a human patient may be on the order of 15-30 seconds. In this case, after having detected that ingestible device 100 has entered the GI tract at 504 (i.e., after detecting that ingestible device 100 has reached at least esophagus 302 (FIG. 3)), ingestible device 100 may be configured to wait one minute, or a similar amount of time longer than the typical esophageal transmit time (e.g., ninety-seconds), before automatically determining that ingestible device 100 has entered at least the stomach (e.g., stomach 306 (FIG. 3)).

In some embodiments, the ingestible device (e.g., ingestible device 100, 300, or 400) may also determine it has entered the stomach based on measurements of pH or temperature. For example, ingestible device 100 may be configured to determine that it has entered the stomach if a temperature of ingestible device has increased to at least 31 degrees Celsius (i.e., consistent with the temperature inside the stomach), or if a measured pH of the environment surrounding ingestible device 100 is sufficiently acidic (i.e., consistent with the acidic nature of gastric juices that may be found inside the stomach).

At 508, the ingestible device (e.g., ingestible device 100, 300, or 400) stores data indicating the ingestible device has entered the stomach (e.g., stomach 306 (FIG. 3)). For example, after having waited a sufficient amount of time at 506, ingestible device 100 may store data (e.g., within storage circuitry of PCB 120 (FIG. 2)) indicative of ingestible device 100 having entered at least the stomach. Once ingestible device 100 reaches at least the stomach, process 500 proceeds to 510 where ingestible device 100 may be configured to gather data to detect entry into the duodenum (e.g., duodenum 310 (FIG. 3)).

In some embodiments, process 500 may also simultaneously proceed from 508 to 520, where ingestible device 100 may be configured to gather data in order to detect muscle contractions and detect entry into the jejunum (e.g., jejunum 314 (FIG. 3)). In some embodiments, ingestible device 100 may be configured to simultaneously monitor for entry into the duodenum at 516-518, as well as detect for entry into the jejunum at 520-524. This may allow ingestible device 100 to determine when it has entered the jejunum (e.g., as a result of detecting muscle contractions), even when it fails to first detect entry into the duodenum (e.g., as a result of very quick transit times of the ingestible device through the duodenum).

At 510, the ingestible device (e.g., ingestible device 100, 300, or 400) gathers measurements of green and blue reflectance levels (e.g., through the use of illuminator 124 and detector 122 of sensing sub-unit 126 (FIG. 2)) while in the stomach (e.g., stomach 306 (FIG. 3)). For example, ingestible device 100 may be configured to periodically gather measurements of green and blue reflectance levels while in the stomach. For instance, ingestible device 100 may be configured to transmit a green illumination and a blue illumination (e.g., via illuminator 124 (FIG. 2)) every five to fifteen seconds, and measure the resulting reflectance (e.g., via detector 122 (FIG. 2)). Every time that ingestible device 100 gathers a new set of measurements, the measurements may be added to a stored data set (e.g., stored within memory circuitry of PCB 120 (FIG. 2)). The ingestible device 100 may then use this data set to determine whether or not ingestible device 100 is still within a stomach (e.g., stomach 306 (FIG. 3)), or a duodenum (e.g., duodenum 310 (FIG. 3)).

In some embodiments, the ingestible device (e.g., ingestible device 100, 300, or 400) may be configured to detect a first reflectance based on generating an illumination of a first wavelength in approximately the green spectrum of light (between 495-600 nm), and detecting a second reflectance based on generating an illumination of the second wavelength in approximately the blue spectrum of light (between 400-495 nm). In some embodiments, the ingestible device may ensure that the illumination in the green spectrum and the illumination in the blue spectrum have wavelengths separated by at least 50 nm. This may enable ingestible device 100 to sufficiently distinguish between the two wavelengths when detecting the reflectances (e.g., via detector 122 (FIG. 2)). It is understood that the separation of 50 nm is intended to be illustrative, and not limiting, and depending on the accuracy of the detectors within ingestible device 100, smaller separations may be possible to be used.

At 512, the ingestible device (e.g., ingestible device 100, 300, or 400) determines (e.g., using control circuitry within PCB 120 (FIG. 2)) whether the ingestible device has detected a transition from the stomach (e.g., stomach 306 (FIG. 3)) to a duodenum (e.g., duodenum 310 (FIG. 3)) based on a ratio of green and blue (G/B) reflectance levels. For example, ingestible device 100 may obtain (e.g., from memory circuitry of PCB 120 (FIG. 2)) a data set containing historical data for the respective ratio of the green reflectance to the blue reflectance as measured at a respective time. Generally speaking, a duodenum (e.g., duodenum 310 (FIG. 3)) of a human subject reflects a higher ratio of green light to blue light, as compared to the ratio of green light to blue light that is reflected by a stomach (e.g., stomach 306 (FIG. 3)). Based on this, ingestible device 100 may be configured to take a first set of ratios from the data set, representing the result of recent measurements, and compare them to a second set of ratios from the data set, representing the results of past measurements. When the ingestible device 100 determines that the mean value of the first set of ratios is substantially larger than the mean value of the second set of ratios (i.e., that the ratio of reflected green light to reflected blue light has increased), the ingestible device 100 may determine that it has entered the duodenum (e.g., duodenum 310 (FIG. 3)) from the stomach (e.g., stomach 306 (FIG. 3)). If the ingestible device 100 detects a transition from the stomach (e.g., stomach 306 (FIG. 3)) to a duodenum (e.g., duodenum 310 (FIG. 3)), process 500 proceeds to 514, where ingestible device 100 stores data indicating that the ingestible device 100 has entered the duodenum (e.g., duodenum 310 (FIG. 3)). Alternatively, if the ingestible device determines that the ingestible device has not transitioned from the stomach (e.g., stomach 306 (FIG. 3)) to the duodenum (e.g., duodenum 310 (FIG. 3)), process 500 proceeds back to 510 to gather more measurements of green and blue reflectance levels while still in the stomach (e.g., stomach 306 (FIG. 3)). An example procedure for using measurements of green and blue reflectances to monitor for transitions between the stomach and the duodenum is discussed in greater detail in relation to FIG. 6.

In some embodiments, the first time that ingestible device 100 detects a transition from the stomach (e.g., stomach 306 (FIG. 3)) to the duodenum (e.g., duodenum 310 (FIG. 3)), ingestible device 100 may be configured to take a mean of the second set of data, (e.g., the set of data previously recorded while in stomach 306 (FIG. 3)) and store this as a typical ratio of green light to blue light detected within the stomach (e.g., stomach 306 (FIG. 3)) (e.g., within memory circuitry of PCB 120 (FIG. 2)). This stored information may later be used by ingestible device 100 to determine when ingestible device 100 re-enters the stomach (e.g., stomach 306 (FIG. 3)) from the duodenum (e.g., duodenum 310 (FIG. 3)) as a result of a reverse pyloric transition.

At 514, the ingestible device (e.g., ingestible device 100, 300, or 400) stores data indicating that the ingestible device has entered the duodenum (e.g., duodenum 310 (FIG. 3)). For example, ingestible device 100 may store a flag within local memory (e.g., memory circuitry of PCB 120) indicating that the ingestible device 100 is currently in the duodenum. In some embodiments, the ingestible device 100 may also store a timestamp indicating the time when ingestible device 100 entered the duodenum. Once ingestible device 100 reaches the duodenum, process 500 proceeds to 520 where ingestible device 100 may be configured to gather data in order to detect muscle contractions and detect entry into the jejunum (e.g., jejunum 314 (FIG. 3)). Process 500 also proceeds from 514 to 516, where ingestible device 100 may be configured to gather data additional data in order to detect re-entry into the stomach (e.g., stomach 306 (FIG. 3)) from the duodenum (e.g., duodenum 310 (FIG. 3)).

At 516, the ingestible device (e.g., ingestible device 100, 300, or 400) gathers measurements (e.g., via sensing sub-unit 126 (FIG. 2)) of green and blue reflectance levels while in the duodenum (e.g., duodenum 310 (FIG. 3)). For example, ingestible device 100 may be configured to periodically gather measurements (e.g., via sensing sub-unit 126 (FIG. 2)) of green and blue reflectance levels while in the duodenum, similar to the measurements made at 510 while in the stomach. For instance, ingestible device 100 may be configured to transmit a green illumination and a blue illumination (e.g., via illuminator 124 (FIG. 2)) every five to fifteen seconds, and measure the resulting reflectance (e.g., via detector 122 (FIG. 2)). Every time that ingestible device 100 gathers a new set of measurements, the measurements may be added to a stored data set (e.g., stored within memory circuitry of PCB 120 (FIG. 2)). The ingestible device 100 may then use this data set to determine whether or not ingestible device 100 is still within the duodenum (e.g., duodenum 310 (FIG. 3)), or if the ingestible device 100 has transitioned back into the stomach (e.g., stomach 306 (FIG. 3)).

At 518, the ingestible device (e.g., ingestible device 100, 300, or 400) determines a transition from the duodenum (e.g., duodenum 310 (FIG. 3)) to the stomach (e.g., stomach 306 (FIG. 3)) based on a ratio of the measured green reflectance levels to the measured blue reflectance levels. In some embodiments, ingestible device 100 may compare the ratio of the measured green reflectance levels to the measured blue reflectance levels recently gathered by ingestible device 100 (e.g., measurements gathered at 516), and determine whether or not the ratio of the measured green reflectance levels to the measured blue reflectance levels is similar to the average ratio of the measured green reflectance levels to the measured blue reflectance levels seen in the stomach (e.g., stomach 306 (FIG. 3)). For instance, ingestible device 100 may retrieve data (e.g., from memory circuitry of PCB 120 (FIG. 2)) indicative of the average ratio of the measured green reflectance levels to the measured blue reflectance levels seen in the stomach, and determine that ingestible device 100 has transitioned back to the stomach if the recently measured ratio of the measured green reflectance levels to the measured blue reflectance levels is sufficiently similar to the average level in the stomach (e.g., within 20% of the average ratio of the measured green reflectance levels to the measured blue reflectance levels seen in the stomach, or within any other suitable threshold level). If the ingestible device detects a transition from the duodenum (e.g., duodenum 310 (FIG. 3)) to the stomach (e.g., stomach 306 (FIG. 3)), process 500 proceeds to 508 to store data indicating the ingestible device has entered the stomach (e.g., stomach 306 (FIG. 3)), and continues to monitor for further transitions. Alternatively, if the ingestible device does not detect a transition from the duodenum (e.g., duodenum 310 (FIG. 3)) to the stomach (e.g., stomach 306 (FIG. 3)), process 500 proceeds to 516 to gather additional measurements of green and blue reflectance levels while in the duodenum (e.g., duodenum 310 (FIG. 3)), which may be used to continuously monitor for possible transitions back into the stomach. An example procedure for using measurements of green and blue reflectances to monitor for transitions between the stomach and the duodenum is discussed in greater detail in relation to FIG. 6.

At 520, the ingestible device (e.g., ingestible device 100, 300, or 400) gathers periodic measurements of the reflectance levels (e.g., via sensing sub-unit 126 (FIG. 2)) while in the duodenum (e.g., duodenum 310 (FIG. 3)). In some embodiments, the ingestible device (e.g., ingestible device 100, 300, or 400) may gather similar periodic measurements while in the stomach as well. In some embodiments, these periodic measurements may enable ingestible device 100 to detect muscle contractions (e.g., muscle contractions due to a peristaltic wave as discussed in relation to FIG. 4), which may be indicative of entry into a jejunum (e.g., jejunum 314 (FIG. 3)). Ingestible device 100 may be configured to gather periodic measurements using any suitable wavelength of illumination (e.g., by generating illumination using illuminator 124, and detecting the resulting reflectance using detector 122 (FIG. 2)), or combinations of wavelengths of illumination. For example, in some embodiments, ingestible device 100 may be configured to generate red, green, and blue illumination, store separate data sets indicative of red, green, and blue illumination, and analyze each of the data sets separately to search for frequency components in the recorded data indicative of detected muscle contractions. In some embodiments, the measurements gathered by ingestible device 100 at 520 may be sufficiently fast as to detect peristaltic waves in a subject. For instance, in a healthy human subject, peristaltic waves may occur at a rate of approximately 0.1 Hz to 0.2 Hz. Therefore, the ingestible device 400 may be configured to generate illumination and measure the resulting reflectance at least once every 2.5 seconds (i.e., the minimum rate necessary to detect a 0.2 Hz signal), and preferably at a higher rate, such as once every 0.5 seconds or faster, and store values indicative of the resulting reflectances in a data set (e.g., within memory circuitry of PCB 120 (FIG. 2)). After gathering additional data (e.g., after gathering one new data point, or a predetermined number of new data points), process 500 proceeds to 522, where ingestible device 100 determines whether or not a muscle contraction has been detected.

At 522, the ingestible device (e.g., ingestible device 100, 300, or 400) determines (e.g., via control circuitry within PCB 120 (FIG. 2)) whether the ingestible device detects a muscle contraction based on the measurements of reflectance levels (e.g., as gathered by sensing sub-unit 126 (FIG. 2)). For example, ingestible device 100 may obtain a fixed amount of data stored as a result of measurements made at 520 (e.g., retrieve the past minute of data from memory circuitry within PCB 120 (FIG. 2)). Ingestible device 100 may then convert the obtained data into the frequency domain, and search for peaks in a frequency range that would be consistent with peristaltic waves. For example, in a healthy human subject, peristaltic waves may occur at a rate of approximately 0.1 Hz to 0.2 Hz, and an ingestible device 100 may be configured to search for peaks in the frequency domain representation of the data between 0.1 Hz and 0.2 Hz above a threshold value. If the ingestible device 100 detects a contraction based on the reflectance levels (e.g., based on detecting peaks in the frequency domain representation of the data between 0.1 Hz and 0.2 Hz), process 500 proceeds to 524 to store data indicating that the device has entered the jejunum. Alternatively, if the ingestible device 100 does not detect a muscle contraction, process 500 proceeds to 520 to gather periodic measurements of the reflectance levels while in the duodenum (e.g., duodenum 310 (FIG. 3)). In some embodiments, the ingestible device (e.g., ingestible device 100, 300, or 400) may store data (e.g., within memory circuitry of PCB 120 (FIG. 2)) indicating that a muscle contraction was detected, and process 500 will not proceed from 522 to 524 until a sufficient number of muscle contractions have been detected.

At 524, the ingestible device (e.g., ingestible device 100, 300, or 400) stores data (e.g., within memory circuitry of PCB 120 (FIG. 2)) indicating that the device has entered the jejunum (e.g., jejunum 314 (FIG. 3)). For example, in response to detecting that muscle contraction has occurred at 522, ingestible device 100 may determine that it has entered the jejunum 314, and is no longer inside of the duodenum (e.g., duodenum 310 (FIG. 3)) or the stomach (e.g., stomach 306 (FIG. 3)). In some embodiments, the ingestible device 100 may continue to measure muscle contractions while in the jejunum, and may store data indicative of the frequency, number, or strength of the muscle contractions over time (e.g., within memory circuitry of PCB 120 (FIG. 2)). In some embodiments, the ingestible device 100 may also be configured to monitor for one or more transitions. Such transitions can include a transition from the jejunum to the ileum, an ileoceacal transition from the ileum to the cecum, a transition from the cecum to the colon, or detect exit from the body (e.g., by measuring reflectances, temperature, or levels of ambient light).

In some embodiments, the ingestible device (e.g., ingestible device 100, 300, or 400) may also determine that it has entered the jejunum (e.g., jejunum 314 (FIG. 3)) after a pre-determined amount of time has passed after having detected entry into the duodenum (e.g., duodenum 310 (FIG. 3)). For example, barring a reverse pyloric transition from the duodenum (e.g., duodenum 310 (FIG. 3)) back to the stomach (e.g., stomach 306 (FIG. 3)), the typical transit time for an ingestible device to reach the jejunum from the duodenum in a healthy human subject is less than three minutes. In some embodiments, the ingestible device (e.g., ingestible device 100, 300, or 400) may therefore be configured to automatically determine that it has entered the jejunum after spending at least three minutes within the duodenum. This determination may be made separately from the determination made based on measured muscle contractions (e.g., the determination made at 522), and in some embodiments, ingestible device 100 may determine that it has entered the jejunum in response to either detecting muscle contractions, or after three minutes has elapsed from having entered the duodenum (e.g., as determined by storing data at 514 indicative of the time that ingestible device entered the duodenum).

For illustrative purposes, 512-518 of process 500 describe the ingestible device (e.g., ingestible device 100, 300, or 400) measuring green reflectances and blue reflectances, calculating a ratio of the two reflectances, and using this information to determine when the ingestible device has transitioned between the duodenum and stomach. However, in some embodiments, other wavelengths of light may be used other than green and blue, provided that the wavelengths of light chosen have different reflective properties within the stomach and the duodenum (e.g., as a result of different reflection coefficients of the stomach tissue and the tissue of the duodenum).

It will be understood that the steps and descriptions of the flowcharts of this disclosure, including FIG. 5, are merely illustrative. Any of the steps and descriptions of the flowcharts, including FIG. 5, may be modified, omitted, rearranged, and performed in alternate orders or in parallel, two or more of the steps may be combined, or any additional steps may be added, without departing from the scope of the present disclosure. For example, the ingestible device 100 may calculate the mean and the standard deviation of multiple data sets in parallel in order to speed up the overall computation time. As another example, ingestible device 100 may gather data periodic measurements and detect possible muscle contractions (e.g., at 520-522) while simultaneously gathering green and blue reflectance levels to determine transitions to and from the stomach and duodenum (e.g., at 510-518). Furthermore, it should be noted that the steps and descriptions of FIG. 5 may be combined with any other system, device, or method described in this application, including processes 600 (FIG. 6) and 900 (FIG. 9), and any of the ingestible devices or systems discussed in this application (e.g., ingestible devices 100, 300, or 400) could be used to perform one or more of the steps in FIG. 5.

Figure 6:
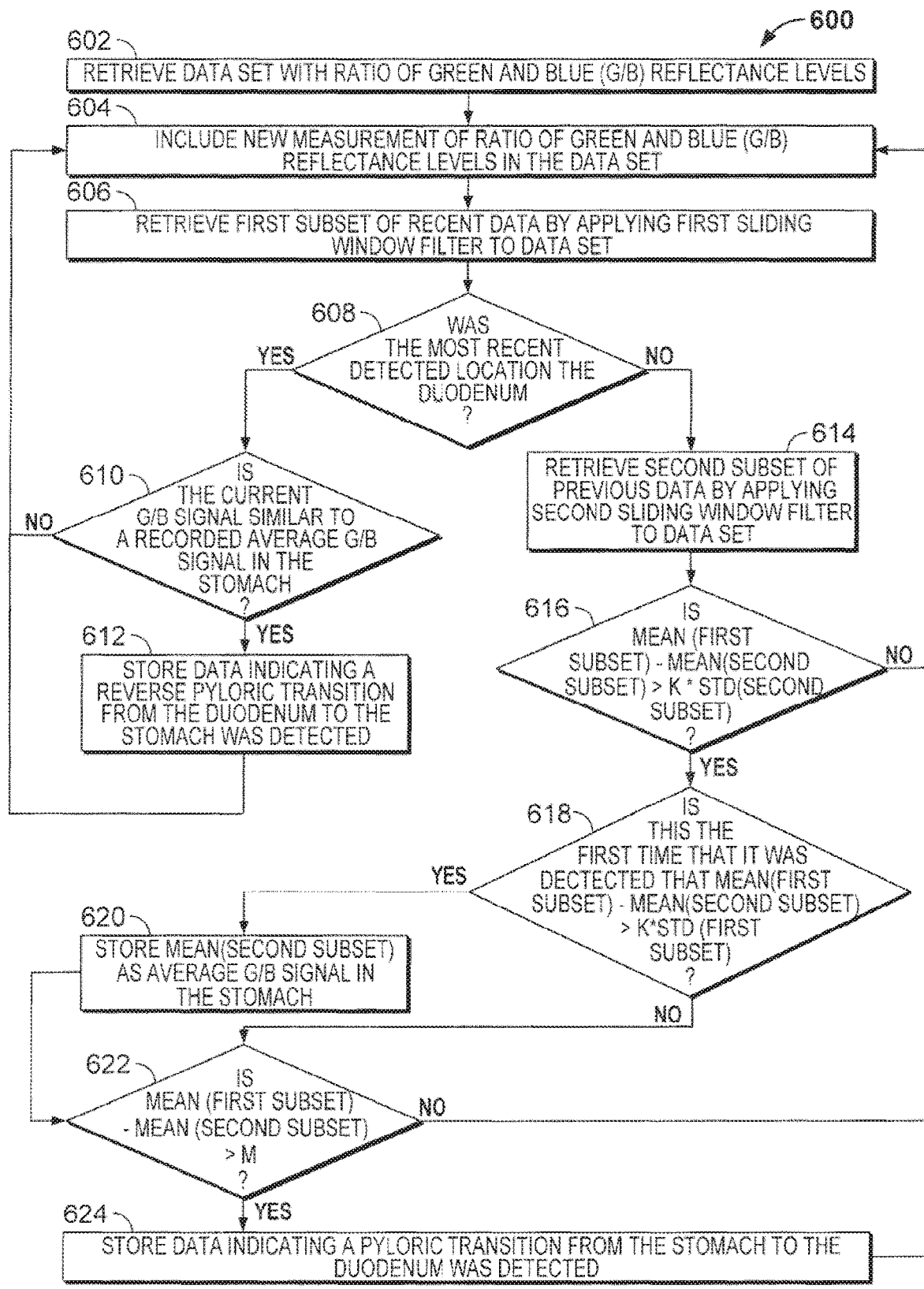
FIG. 6 is a flowchart of illustrative steps for detecting transitions from a stomach to a duodenum and from a duodenum back to a stomach, which may be used when determining a location of an ingestible device as it transits through a GI tract, in accordance with some embodiments of the disclosure.

FIG. 6 is a flowchart illustrating some aspects of a process for detecting transitions from a stomach to a duodenum and from a duodenum back to a stomach, which may be used when determining a location of an ingestible device as it transits through a gastrointestinal (GI) tract, in accordance with some embodiments of the disclosure. In some embodiments, process 600 may begin when an ingestible device first detects that it has entered the stomach, and will continue as long as the ingestible device determines that it is within the stomach or the duodenum. In some embodiments, process 600 may only be terminated when an ingestible device determines that it has entered the jejunum, or otherwise progressed past the duodenum and the stomach. Although FIG. 6 may be described in connection with the ingestible device 100 for illustrative purposes, this is not intended to be limiting, and either portions or the entirety of the duodenum detection process 600 described in FIG. 6 may be applied to any device discussed in this application (e.g., the ingestible devices 100, 300, or 400), and any of the ingestible devices may be used to perform one or more parts of the process described in FIG. 6. Furthermore, the features of FIG. 6 may be combined with any other systems, methods or processes described in this application. For example, portions of the process described by the process in FIG. 6 may be integrated into process 500 discussed in relation to FIG. 5.

At 602, the ingestible device (e.g., ingestible device 100, 300, or 400) retrieves a data set (e.g., from memory circuitry within PCB 120 (FIG. 2)) with ratios of the measured green reflectance levels to the measured blue reflectance levels over time. For example, ingestible device 100 may retrieve a data set from PCB 120 containing recently recorded ratios of the measured green reflectance levels to the measured blue reflectance levels (e.g., as recorded at 510 or 516 of process 500 (FIG. 5)). In some embodiments, the retrieved data set may include the ratios of the measured green reflectance levels to the measured blue reflectance levels over time. Example plots of data sets of ratios of the measured green reflectance levels to the measured blue reflectance levels are discussed further in relation to FIG. 7 and FIG. 8.

At 604, the ingestible device (e.g., ingestible device 100, 300, or 400) includes a new measurement (e.g., as made with sensing sub-unit 126 (FIG. 2)) of a ratio of the measured green reflectance level to the measured blue reflectance level in the data set. For example, ingestible device 100 may be configured to occasionally record new data by transmitting green and blue illumination (e.g., via illuminator 124 (FIG. 2)), detecting the amount of reflectance received due to the green and blue illumination (e.g., via detector 122 (FIG. 2)), and storing data indicative of the amount of the received reflectance (e.g., in memory circuitry of PCB 120 (FIG. 2)). The ingestible device 100 may be configured to record new data every five to fifteen seconds, or at any other convenient interval of time. For illustrative purposes, ingestible device 100 is described as storing and retrieving the ratio of the measured green reflectance levels to the measured blue reflectance levels (e.g., if the amount of detected green reflectance was identical to the amount of detected blue reflectance at a given time, the ratio of the green and blue reflectances would be "1.0" at that given time); however, it is understood that the green reflectance data and the blue reflectance data may be stored separately within the memory of ingestible device 100 (e.g., stored as two separate data sets within memory circuitry of PCB 120 (FIG. 2)).

At 606, the ingestible device (e.g., ingestible device 100, 300, or 400) retrieves a first subset of recent data by applying a first sliding window filter to the data set. For example, ingestible device 100 may use a sliding window filter to obtain a predetermined amount of the most recent data within the data set, which may include any new values of the ratio of the measured green reflectance level to the measured blue reflectance level obtained at 604. For instance, the ingestible device may be configured to select between ten and forty data points from the data set, or ingestible device 100 may be configured to select a predetermined range of data values between fifteen seconds of data and five minutes of data. In some embodiments, other ranges of data may be selected, depending on how frequently measurements are recorded, and the particular application at hand. For instance, any suitable amount of data may be selected in the sliding window, provided that it is sufficient to detect statistically significant differences between the data selected in a second sliding window (e.g., the second subset of data selected at 614).

In some embodiments, the ingestible device (e.g., ingestible device 100, 300, or 400) may also be configured to remove outliers from the data set, or to smooth out unwanted noise in the data set. For example, ingestible device 100 may select the first subset of data, or any other subset of data, by first obtaining a raw set of values by applying a window filter to the data set (e.g., selecting a particular range of data to be included). Ingestible device 100 may then be configured to identify outliers in the raw set of values; for instance, by identifying data points that are over three standard deviations away from the mean value of the raw set of values, or any other suitable threshold. Ingestible device 100 may then determine the subset of data by removing outliers from the raw set of values. This may enable ingestible device 100 to avoid spurious information when determining whether or not it is located within the stomach or the duodenum.

At 608, the ingestible device (e.g., ingestible device 100, 300, or 400) determines whether the most recently detected location was the duodenum (e.g., duodenum 310 (FIG. 3)). In some embodiments, ingestible device 100 may store a data flag (e.g., within memory circuitry of PCB 120 (FIG. 2)) indicating the most recent portion of the GI tract that the ingestible device 100 detected itself to be within. For instance, every time ingestible device 100 detects entry to the stomach (e.g., detects entry into stomach 306 (FIG. 3) as a result of the decision made at 610), a flag is stored in memory indicating the ingestible device 100 is in the stomach (e.g., as part of storing data at 612). If ingestible device 100 subsequently detects entry into the duodenum (e.g., detects entry into duodenum 310 (FIG. 3) as a result of a decision made at 624), another different flag is stored in memory indicating that the ingestible device 100 is in the duodenum (e.g., as part of storing data at 624). In this case, ingestible device 100 may retrieve the most recently stored flag at 608, and determine whether or not the flag indicates that the ingestible device 100 was most recently within the duodenum. If ingestible device 100 detects that it was most recently in the duodenum, process 600 proceeds to 610 where the ingestible device compares the recent measurements of the ratios of the measured green reflectance levels to the measured blue reflectance levels (e.g., measurements that include the recent measurement made at 606) to the typical ratios measured within the stomach, and uses this information to determine whether a reverse pyloric transition from the duodenum back to the stomach has occurred. Alternately, if ingestible device 100 detects that it was not most recently in the duodenum (e.g., because it was in the stomach instead), process 600 proceeds to 614 where the ingestible device compares the recent measurements of the ratios of the measured green reflectance levels to the measured blue reflectance levels (e.g., measurements that include the recent measurement made at 606) to past measurements, and uses this information to determine whether a pyloric transition from the stomach to the duodenum has occurred.

Process 600 proceeds from 608 to 610 when the ingestible device determined that it was most recently in the duodenum. At 610, the ingestible device (e.g., ingestible device 100, 300, or 400) determines (e.g., via control circuitry within PCB 120 (FIG. 2)) whether the current G/B signal is similar to a recorded average G/B signal in the stomach. For example, ingestible device 100 may be configured to have previously stored data (e.g., within memory circuitry of PCB 120 (FIG. 2)) indicative of the average ratio of the measured green reflectance levels to the measured blue reflectance levels measured in the stomach. Ingestible device 100 may then retrieve this stored data indicative of the average ratio of the measured green reflectance levels to the measured blue reflectance levels in the stomach, and compare this against the recent measurements in order to determine whether or not ingestible device 100 has returned back to the stomach from the duodenum. For instance, ingestible device 100 may determine if the mean value of the first subset of recent data (i.e., the average value of the recently measured ratios of the measured green reflectance levels to the measured blue reflectance levels) is less than the average ratio of the measured green reflectance levels to the measured blue reflectance levels within the stomach, or less that the average ratio measured within the stomach plus a predetermined number times the standard deviation of the ratios measured within the stomach. For instance, if the average ratio of the measured green reflectance levels to the measured blue reflectance levels in the stomach was "1," with a standard deviation of "0.2," ingestible device 100 may determine whether or not the mean value of the first subset of data is less than "1.0+k*0.2," where "k" is a number between zero and five. It is understood that, in some embodiments, the ingestible device 100 may be configured to use a different threshold level to determine whether or not the mean value of the first subset of recent data is sufficiently similar to the average ratio of the measured green reflectance levels to the measured blue reflectance levels within the stomach. In response to determining that the recent ratio of the measured green reflectance levels to the measured blue reflectance levels is similar to the average ratio of measured green and blue reflectance levels seen in the stomach, process 600 proceeds to 612 where ingestible device 100 stores data indicating that it has re-entered the stomach from the duodenum. Alternately, in response to determining that the recent ratio of measured green and blue reflectance levels is sufficiently different from the average ratio of measured green and blue reflectance levels seen in the stomach, ingestible device 100 proceeds directly to 604, and continues to obtain new data on an ongoing basis.

At 612, the ingestible device (e.g., ingestible device 100, 300, or 400) stores data indicating a reverse pyloric transition from the duodenum to the stomach was detected. For example ingestible device 100 may store a data flag (e.g., within memory circuitry of PCB 120 (FIG. 2)) indicating that the ingestible device 100 most recently detected itself to be within the stomach portion of the GI tract (e.g., stomach 306 (FIG. 3)). In some embodiments, ingestible device 100 may also store data (e.g., within memory circuitry of PCB 120 (FIG. 2)) indicating a time that ingestible device 100 detected the reverse pyloric transition from the duodenum to the stomach. This information may be used by ingestible device 100 at 608, and as a result process 600 may proceed from 608 to 614, rather than proceeding from 618 to 610. After ingestible device 100 stores the data indicating a reverse pyloric transition from the duodenum to the stomach was detected, process 600 proceeds to 604 where ingestible device 100 continues to gather additional measurements, and continues to monitor for further transitions between the stomach and the duodenum.

Process 600 proceeds from 608 to 614 when the ingestible device determined that it was not most recently in the duodenum (e.g., as a result of having most recently been in the stomach instead). At 614, the ingestible device (e.g., ingestible device 100, 300, or 400) retrieves a second subset of previous data by applying a second sliding window filter to the data set. For example, ingestible device 100 may use a sliding window filter to obtain a predetermined amount of older data from a past time range, which may be separated from recent time range used to select the first subset of data gathered at 606 by a predetermined period of time. In some embodiments, any suitable amount of data may be selected by the first and second window filters, and the first and second window filters may be separated by any appropriate predetermined amount of time. For example, in some embodiments, the first window filter and the second window filter may each be configured to select a predetermined range of data values from the data set, the predetermined range being between fifteen seconds of data and five minutes of data. In some embodiments, the recent measurements and the past measurements may then be separated by a predetermined period of time that is between one to five times the predetermined range of data values. For instance, ingestible device 100 may select the first subset of data and the second subset of data to each be one minute of data selected from the dataset (i.e., selected to have a predetermined range of one minute), and the first subset of data and the second subset of data are selected from recorded measurements that are at least two minutes apart (i.e., the predetermined period of time is two minutes, which is twice the range used to select the subsets of data using the window filters). As another example, ingestible device 100 may select the first subset of data and the second subset of data to each be five minutes of data selected from the dataset (i.e., selected to have a predetermined range of five minutes), and the first subset of data and the second subset of data are selected from recorded measurements that are at least 10 minutes apart (i.e., the predetermined period of time is two minutes, which is twice the range used to select the subsets of data using the window filters).

In some embodiments, if ingestible device 100 recently transitioned to the stomach from the duodenum (e.g., as determined by checking for recent data stored within ingestible device 100 at 612), ingestible device 100 may select the second subset of data at 614 from a time frame when ingestible device 100 is known to be within the stomach. In some embodiments, ingestible device 100 may alternately select a previously recorded average and standard deviation for ratios of green reflectances and blue reflectances within the stomach (e.g., an average and standard deviation typical of data recorded within the stomach, as previously recorded within memory circuitry of PCB 120 at 620) in place of the second subset of data. In this case, ingestible device 100 may simply use the previously recorded average and previously recorded standard deviation when making a determination at 616, rather than expending resources to calculate the mean and standard deviation of the second subset.

At 616, the ingestible device (e.g., ingestible device 100, 300, or 400) determines whether the difference between the mean of the second subset and the mean of the first subset is greater than a predetermined multiple of the standard deviation of the first subset. For example, ingestible device 100 may compute a difference between a mean of the first subset of recent data and a mean of a second subset of past data, and determine whether this difference is greater than three times the standard deviation of the second subset of past data. In some embodiments, it is understood that any convenient threshold level may be used other than three times the standard deviation, such as any value between one and five times the standard deviation. Also, in some embodiments, the ingestible device may instead set the threshold level based on the standard deviation of the second subset instead of the first subset. In response to determining that the difference between the mean of the first subset and the mean of the second subset is greater than a predetermined multiple of the standard deviation of the second subset, process 600 proceeds to 618. Otherwise, process 600 proceeds back to 604, where the ingestible device 604 continues to gather new data to be used in monitoring for transitions between the stomach (e.g., stomach 306 (FIG. 3)) and the duodenum (e.g., duodenum 310 (FIG. 3)).

At 618, the ingestible device (e.g., ingestible device 100, 300, or 400) determines (e.g., via control circuitry within PCB 120 (FIG. 2)) whether the determination made at 616 is the first time that the difference between the mean of the first subset of recent data and the mean of the second subset of past data is calculated to be greater than the standard deviation of the second subset. If the ingestible device determines that this is the first time that the difference between the mean of the first subset and the mean of the second subset is calculated to be greater than the standard deviation of the second subset, process 600 proceeds to 620 to store the mean of the second subset of past data as an average G/B signal in the stomach. Alternatively, if the ingestible device determines that the immediately preceding determination made at 616 is not the first time that the difference between the mean of the first subset of recent data and the mean of the second subset of past data is calculated to be greater than the standard deviation of the second subset, process 600 proceeds directly to 622.

At 620, the ingestible device (e.g., ingestible device 100, 300, or 400) stores the mean of the second subset as an average G/B signal in the stomach. For example, ingestible device 100 may be configured to store the mean of the second subset of past data (e.g., store within memory circuitry of PCB 120 (FIG. 2)) as the average ratio of the measured green reflectance levels to the measured blue reflectance levels measured in the stomach. In some embodiments, ingestible device 100 may also store the standard deviation of the second subset of past data as a typical standard deviation of the ratios of the measured green reflectance levels to the measured blue reflectance levels detected within the stomach. This stored information may be used by the ingestible device later on (e.g., at 610) to compare against future data, which may enable the ingestible device to detect reverse pyloric transitions from the duodenum (e.g., duodenum 310 (FIG. 3)) back to the stomach (e.g., stomach 306 (FIG. 3)), and may generally be used in place of other experimental data gathered from the stomach (e.g., in place of the second subset of data at 616). After storing the mean of the second subset as an average G/B signal in the stomach, process 600 proceeds to 622.

At 622, the ingestible device (e.g., ingestible device 100, 300, or 400) determines whether a difference of the mean of the first subset of recent data to the mean of the second subset of past data is greater than a predetermined threshold, "M". In some embodiments, the predetermined threshold, "M," will be sufficiently large to ensure that the mean of the first subset is substantially larger than the mean of the second subset, and may enable ingestible device 100 to ensure that it detected an actual transition to the duodenum. This may be particularly advantageous when the determination made at 616 is potentially unreliable due to the standard deviation of the second subset of past data being abnormally small. For example, a typical value of the predetermined threshold "M," may be on the order of 0.1 to 0.5. If ingestible device 100 determines that the difference of the mean of the first subset of recent data to the second subset of past data is greater than a predetermined threshold, process 600 proceeds to 624 to store data indicating that a pyloric transition from the stomach to the duodenum (e.g., from stomach 306 to duodenum 310 (FIG. 3)) was detected. Alternatively, if the ingestible device determines that the ratio of the mean of the first subset to the second subset is less than or equal to the predetermined threshold, "M" (i.e., determines that a transition to the duodenum has not occurred), process 600 proceeds directly to 604 where ingestible device 100 continues to make new measurements and monitor for possible transitions between the stomach and the duodenum.

In some embodiments, instead of using a difference of the mean of the first subset of recent data to the mean of the second subset of past data, the ingestible device (e.g., ingestible device 100, 300, or 400) determines whether the ratio of the mean of the first subset of recent data to the mean of the second subset of past data is greater than a predetermined threshold, "M". In some embodiments, the predetermined threshold, "M," will be sufficiently large to ensure that the mean of the first subset is substantially larger than the mean of the second subset, and may enable ingestible device 100 to ensure that it detected an actual transition to the duodenum. This may be particularly advantageous when the determination made at 616 is potentially unreliable due to the standard deviation of the second subset of past data being abnormally small. For example, a typical value of the predetermined threshold "M," may be on the order of 1.2 to 2.0. It is understood any convenient type of threshold or calculation may be used to determine whether or not the first subset of data and the second subset of data are both statistically distinct from one another, and also substantially different from one another in terms of overall average value.

At 624, the ingestible device (e.g., ingestible device 100, 300, or 400) stores data indicating a pyloric transition from the stomach to the duodenum was detected. For example ingestible device 100 may store a data flag (e.g., within memory circuitry of PCB 120 (FIG. 2)) indicating that the ingestible device 100 most recently detected itself to be within the duodenum portion of the GI tract (e.g., duodenum 310 (FIG. 3)). In some embodiments, ingestible device 100 may also store data (e.g., within memory circuitry of PCB 120 (FIG. 2)) indicating a time that ingestible device 100 detected the pyloric transition from the stomach to the duodenum. This information may be used by ingestible device 100 at 608, and as a result process 600 may proceed from 608 to 610, rather than proceeding from 618 to 614. After ingestible device 100 stores the data indicating a pyloric transition from the stomach to the duodenum was detected, process 600 proceeds to 604 where ingestible device 100 continues to gather additional measurements, and continues to monitor for further transitions between the stomach and the duodenum.

It will be understood that the steps and descriptions of the flowcharts of this disclosure, including FIG. 6, are merely illustrative. Any of the steps and descriptions of the flowcharts, including FIG. 6, may be modified, omitted, rearranged, and performed in alternate orders or in parallel, two or more of the steps may be combined, or any additional steps may be added, without departing from the scope of the present disclosure. For example, the ingestible device 100 may calculate the mean and the standard deviation of multiple data sets in parallel in order to speed up the overall computation time. Furthermore, it should be noted that the steps and descriptions of FIG. 6 may be combined with any other system, device, or method described in this application, and any of the ingestible devices or systems discussed in this application could be used to perform one or more of the steps in FIG. 6. For example, portions of process 600 may be incorporated into 508-516 of process 500 (FIG. 5), and may be part of a more general process for determining a location of the ingestible device. As another example, the ratio of detected blue and green light (e.g., as measured and added to the data set at 604) may continue even outside of the stomach or duodenum, and similar information may be recorded by the ingestible device throughout its transit in the GI tract. Example plots of data sets of ratios of measured green and blue reflectance levels, which may be gathered throughout the GI tract, are discussed further in relation to FIG. 7 and FIG. 8 below.

FIG. 7 is a plot illustrating data collected during an example operation of an ingestible device (e.g., ingestible device 100, 300, or 400), which may be used when determining a location of an ingestible device as it transits through a gastrointestinal (GI) tract, in accordance with some embodiments of the disclosure.

Although FIG. 7 may be described in connection with ingestible device 100 for illustrative purposes, this is not intended to be limiting, and plot 700 and data set 702 may be typical of data gathered by any device discussed in this application. Plot 700 depicts the ratios of the measured green reflectance levels to the measured blue reflectance levels over time. For example, ingestible device 100 may have computed the value for each point in the data set 702 by transmitting green and blue illumination at a given time (e.g., via illuminator 124 (FIG. 2)), measuring the resulting green and blue reflectances (e.g., via detector 122 (FIG. 2)), calculating the ratio of the resulting reflectances, and storing the ratio in the data set along with a timestamp indicating the time that the reflectances were gathered.

At 704, shortly after ingestible device 100 begins operation, ingestible device 100 determines that it has reached at least the stomach (e.g., as a result of making a determination similar to the determination discussed in relation to 506 in process 500 (FIG. 5)). Ingestible device 100 continues to gather additional measurements of green and blue reflectance levels, and at 706 ingestible device 100 determines that a pyloric transition has occurred from the stomach to the duodenum (e.g., as a result of making a determination similar to the determinations discussed in relation to 616-

624 of process 600 (FIG. 6)). Notably, the values in data set 702 around 706 jump up precipitously, which is indicative of the higher ratios of measured green reflectance levels to measured blue reflectance levels typical of the duodenum.

The remainder of the data set 702 depicts the ratios of the measured green reflectance levels to the measured blue reflectance levels throughout the remainder of the GI tract. At 708, ingestible device 100 has reached the jejunum (e.g., as determined through measurements of muscle contractions, as discussed in relation to FIG. 9), and by 710, ingestible device 100 has reached the cecum. It is understood that, in some embodiments, the overall character and appearance of data set 702 changes within the small intestine (i.e., the duodenum, jejunum, and ileum) versus the cecum. Within the jejunum and ileum, there may typically be a wide variation in the ratios of the measured green reflectance levels to the measured blue reflectance levels, resulting in relatively noisy data with a high standard deviation. By comparison, within the cecum ingestible device 100 may measure a relatively stable ratio of the measured green reflectance levels to the measured blue reflectance levels. In some embodiments, ingestible device 100 may be configured to determine transitions from the small intestine to the cecum based on these differences. For example, ingestible device 100 may compare recent windows of data to past windows of data, and detect a transition to the cecum in response to determining that the standard deviation of the ratios in the recent window of data is substantially less than the standard deviation of the ratios in the past window of data.

FIG. 8 is another plot illustrating data collected during an example operation of an ingestible device, which may be used when determining a location of an ingestible device as it transits through a gastrointestinal (GI) tract, in accordance with some embodiments of the disclosure. Similar to FIG. 7, FIG. 8 may be described in connection with the ingestible device 100 for illustrative purposes. However, this is not intended to be limiting, and plot 800 and data set 802 may be typical of data gathered by any device discussed in this application.

At 804, shortly after ingestible device 100 begins operation, ingestible device 100 determines that it has reached at least the stomach (e.g., as a result of making a determination similar to the determination discussed in relation to 506 in process 500 (FIG. 5)). Ingestible device 100 continues to gather additional measurements of green and blue reflectance levels (e.g., via sensing sub-unit 126 (FIG. 2)), and at 806 ingestible device 100 determines that a pyloric transition has occurred from the stomach to the duodenum (e.g., as a result of making a determination similar to the determinations discussed in relation to 616-624 of process 600 (FIG. 6)). Notably, the values in data set 802 around 806 jump up precipitously, which is indicative of the higher ratios of measured green reflectance levels to measured blue reflectance levels typical of the duodenum, before falling shortly thereafter. As a result of the reduced values in data set 802, ingestible device 100 determines that a reverse pyloric transition has occurred from the duodenum back to the stomach at 808 (e.g., as a result of making a determination similar to the determinations discussed in relation to 610-612 of process 600 (FIG. 6)). At 810, as a result of the values in data set 802 increasing again, ingestible device 100 determines that another pyloric transition has occurred from the stomach to the duodenum, and shortly thereafter ingestible device 100 proceeds onwards to the jejunum, ileum, and cecum.

The remainder of the data set 802 depicts the ratios of the measured green reflectance levels to the measured blue reflectance levels throughout the remainder of the GI tract. Notably, at 812, ingestible device reaches the transition point between the ileum and the cecum. As discussed above in relation to FIG. 7, the transition to the cecum is marked by a reduced standard deviation in the ratios of measured green reflectances and measured blue reflectances over time, and ingestible device 100 may be configured to detect a transition to the cecum based on determining that the standard deviation of a recent set of measurements is substantially smaller than the standard deviation of past measurements taken from the jejunum or ileum.

Figure 9:
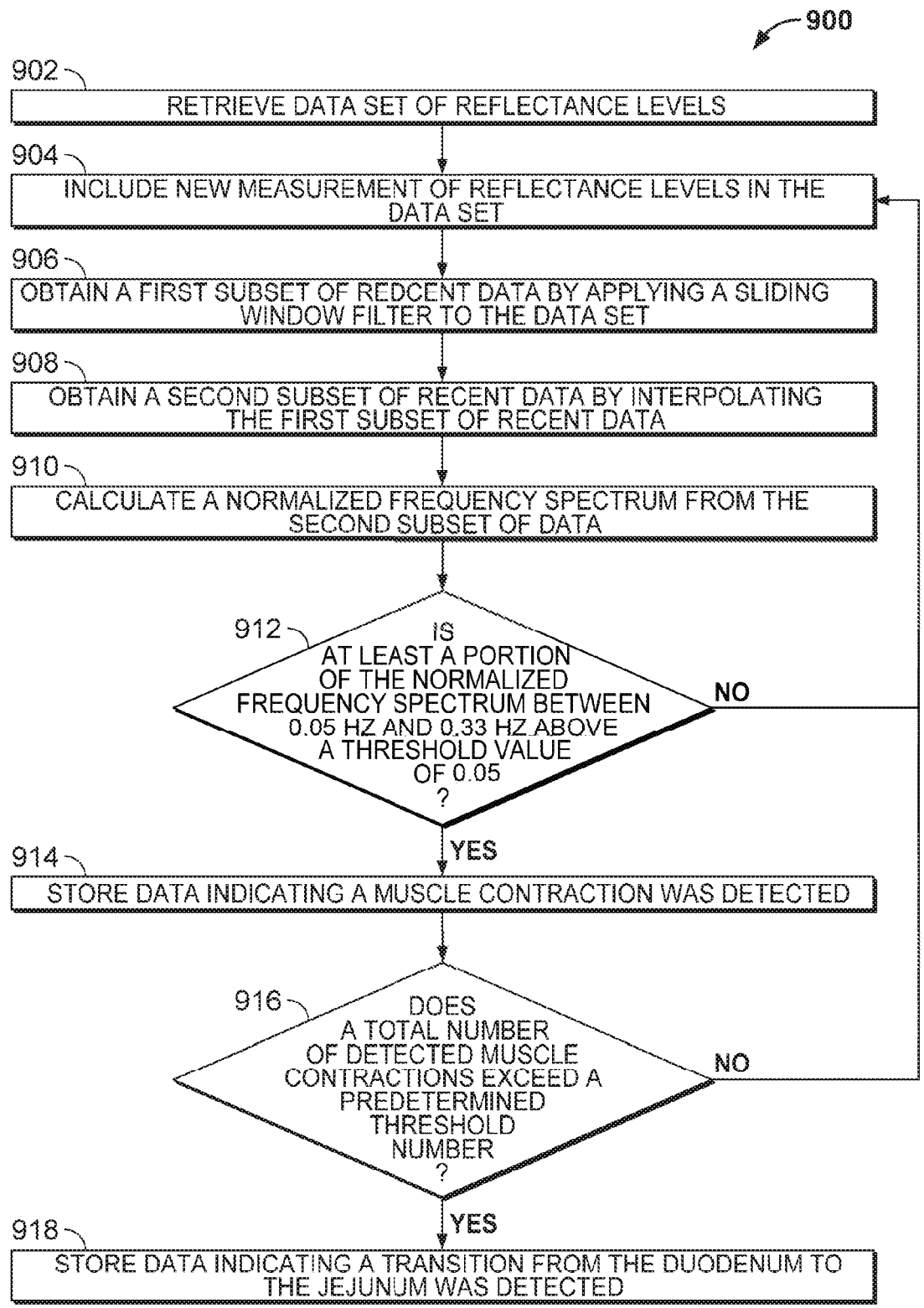
FIG. 9 is a flowchart of illustrative steps for detecting a transition from a duodenum to a jejunum, which may be used when determining a location of an ingestible device as it transits through a GI tract, in accordance with some embodiments of the disclosure.

FIG. 9 is a flowchart of illustrative steps for detecting a transition from a duodenum to a jejunum, which may be used when determining a location of an ingestible device as it transits through a gastrointestinal (GI) tract, in accordance with some embodiments of the disclosure. Although FIG. 9 may be described in connection with the ingestible device 100 for illustrative purposes, this is not intended to be limiting, and either portions or the entirety of process 900 described in FIG. 9 may be applied to any device discussed in this application (e.g., the ingestible devices 100, 300, and 400), and any of these ingestible devices may be used to perform one or more parts of the process described in FIG. 9. Furthermore, the features of FIG. 9 may be combined with any other systems, methods or processes described in this application. For example, portions of the process described by the process in FIG. 9 may be integrated into the localization process described by FIG. 5 (e.g., as part of 520-524 of process 500 (FIG. 5)). In some embodiments, an ingestible device 100 may perform process 900 while in the duodenum, or in response to detecting entry to the duodenum. In other embodiments, an ingestible device 100 may perform process 900 while in the stomach, or in response to detecting entry into the GI tract. It is also understood that process 900 may be performed in parallel with any other process described in this disclosure (e.g., process 600 (FIG. 6)), which may enable ingestible device 100 to detect entry into various portions of the GI tract, without necessarily detecting entry into a preceding portion of the GI tract.

For illustrative purposes, FIG. 9 may be discussed in terms of ingestible device 100 generating and making determinations based on a single set of reflectance levels generated at a single wavelength by a single sensing sub-unit (e.g., sensing sub-unit 126 (FIG. 2)). However, it is understood that ingestible device 100 may generate multiple wavelengths of illumination from multiple different sensing sub-units positioned around the circumference of ingestible device (e.g., multiple sensing sub-units positioned at different locations behind window 114 of ingestible device 100 (FIG. 1), and each of the resulting reflectances may be stored as a separate data set. Moreover, each of these sets of reflectance levels may be used to detect muscle contractions by running multiple versions of process 900, each one of which processes data for a different set of reflectances corresponding to data sets obtained from measurements of different wavelengths or measurements made by different sensing sub-units.

At 902, the ingestible device (e.g., ingestible device 100, 300, or 400) retrieves a set of reflectance levels. For example, ingestible device 100 may retrieve a data set of previously recorded reflectance levels from memory (e.g., from memory circuitry of PCB 120 (FIG. 2)). Each of the reflectance levels may correspond to reflectances previously detected by ingestible device 100 (e.g., via detector 122 (FIG. 2)) from illumination generated by ingestible device 100 (e.g., via illuminator 124 (FIG. 2)), and may represent a value indicative of an amount of light detected in a given reflectance. However, it is understood that any suitable frequency of light may be used, such as light in the infrared, visible, or ultraviolet spectrums. In some embodiments, the reflectance levels may correspond to reflectances previously detected by ingestible device 100 at periodic intervals.

At 904, the ingestible device (e.g., ingestible device 100, 300, or 400) includes new measurements of reflectance levels in the data set. For example, ingestible device 100 may be configured to detect a new reflectance (e.g., transmit illumination and detect the resulting reflectance using sensing sub-unit 126 (FIG. 2)) at regular intervals, or with sufficient speed as to detect peristaltic waves. For example, ingestible device 100 may be configured to generate illumination and measure the resulting reflectance once every three seconds (i.e., the minimum rate necessary to detect a 0.17 Hz signal), and preferably at a higher rate, as fast at 0.1 second or even faster. It is understood that the periodic interval between measurements may be adapted as needed based on the species of the subject, and the expected frequency of the peristaltic waves to be measured. Every time ingestible device 100 makes a new reflectance level measurement at 904, the new data is included to the data set (e.g., a data set stored within memory circuitry of PCB 120 (FIG. 2)).

At 906, the ingestible device (e.g., ingestible device 100, 300, or 400) obtains a first subset of recent data by applying a sliding window filter to the data set. For example, ingestible device 100 may retrieve a one-minute worth of data from the data set. If the data set includes values for reflectances measured every second, this would be approximately 60 data points worth of data. Any suitable type of window size may be used, provided that the size of the window is sufficiently large to detect peristaltic waves (e.g., fluctuations on the order of 0.1 Hz to 0.2 Hz for healthy human subjects). In some embodiments, ingestible device 100 may also clean the data, for example, by removing outliers from the first subset of data obtained through the use of the sliding window filter.

At 908, the ingestible device (e.g., ingestible device 100, 300, or 400) obtains a second subset of recent data by interpolating the first subset of recent data. For example, ingestible device 100 may interpolate the first subset of data in order to generate a second subset of data with a sufficient number of data points (e.g., data points spaced every 0.5 seconds or greater). In some embodiments, this may enable ingestible device 100 to also replace any outlier data points that may have been removed as part of applying the window filter at 906.

At 910, the ingestible device (e.g., ingestible device 100, 300, or 400) calculates a normalized frequency spectrum from the second subset of data. For example, ingestible device 100 may be configured to perform a fast Fourier transform to convert the second subset of data from a time domain representation into a frequency domain representation. It is understood that depending on the application being used, and the nature of the subset of data, any number of suitable procedures (e.g., Fourier transform procedures) may be used to determine a frequency spectrum for the second subset of data. For example, the sampling frequency and size of the second subset of data may be known in advance, and ingestible device 100 may be configured to have pre-stored values of a normalized discreet Fourier transform (DFT) matrix, or the rows of the DFT matrix corresponding to the 0.1 Hz to 0.2 Hz frequency components of interest, within memory (e.g., memory circuitry of PCB 120 (FIG. 2)). In this case, the ingestible device may use matrix multiplication between the DFT matrix and the data set to generate an appropriate frequency spectrum. An example data set and corresponding frequency spectrum that may be obtained by the ingestible device is discussed in greater detail in relation to FIG. 10.

At 912, the ingestible device (e.g., ingestible device 100, 300, or 400) determines whether at least a portion of the normalized frequency spectrum is between 0.1 Hz and 0.2 Hz above a threshold value of 0.5 Hz. Peristaltic waves in a healthy human subject occur at a rate between 0.1 Hz. and 0.2 Hz, and an ingestible device experiencing peristaltic waves (e.g., ingestible device 400 detecting contractions in walls 406 of the jejunum (FIG. 4)) may detect sinusoidal variations in the amplitude of detected reflectances levels that follow a similar 0.1 Hz to 0.2 Hz frequency. If the ingestible device determines that a portion of the normalized frequency spectrum between 0.1 Hz and 0.2 Hz is above a threshold value of 0.5, this measurement may be consistent with peristaltic waves in a healthy human subject, and process 900 proceeds to 914 where ingestible device 100 stores data indicating a muscle contraction was detected. Alternatively, if the ingestible device determines that no portion of the normalized frequency spectrum between 0.1 Hz and 0.2 Hz above a threshold value of 0.5, process 900 proceeds directly to 904 to make new measurements and to continue to monitor for new muscle contractions. It is understood that a threshold value other than 0.5 may be used, and that the exact threshold may depend on the sampling frequency and type of frequency spectrum used by ingestible device 100.

At 914, the ingestible device (e.g., ingestible device 100, 300, or 400) stores data indicating a muscle contraction was detected. For example, ingestible device 100 may store data in memory (e.g., memory circuitry of PCB 120 (FIG. 2)) indicating that a muscle contraction was detected, and indicating the time that the muscle contraction was detected. In some embodiments, ingestible device 100 may also monitor the total number of muscle contractions detected, or the number of muscle contractions detected in a given time frame. In some embodiments, detecting a particular number of muscle contractions may be consistent with ingestible device 100 being within the jejunum (e.g., jejunum 314 (FIG. 3)) of a healthy human subject. After detecting a muscle contraction, process 900 proceeds to 916.

At 916, the ingestible device (e.g., ingestible device 100, 300, or 400) determines whether a total number of muscle contractions exceeds a predetermined threshold number. For example, ingestible device 100 may retrieve the total number of muscle contractions detected from memory (e.g., from memory circuitry of PCB 120 (FIG. 2)), and compare the total number to a threshold value. In some embodiments, the threshold value may be one, or any number larger than one. The larger the threshold value, the more muscle contractions need to be detected before ingestible device 100 stores data indicating that it has entered the jejunum. In practice, setting the threshold value as three or higher may prevent the ingestible device from detecting false positives (e.g., due to natural movement of the GI tract organs, or due to movement of the subject). If the total number of contractions exceeds the predetermined threshold number, process 900 proceeds to 918 to store data indicating detection of a transition from the duodenum to the jejunum. Alternatively, if the total number of contractions does not exceed a predetermined threshold number, process 900 proceeds to 904 to include new measurements of reflectance levels in the data set. An example plot of the muscle contractions detected over time is discussed in greater detail in relation to FIG. 11.

At 918, the ingestible device (e.g., ingestible device 100, 300, or 400) stores data indicating detection of a transition from the duodenum to the jejunum. For example, ingestible device 100 may store data in memory (e.g., from memory circuitry of PCB 120 (FIG. 2)) indicating that the jejunum has been reached. In some embodiments, if ingestible device 100 is configured to perform all or part of process 900 while in the stomach, ingestible device 100 may store data at 918 indicating detection of a transition from the stomach directly to the jejunum (e.g., as a result of transitioning too quickly through the duodenum for the pyloric transition to be detected using process 600 (FIG. 6)).

In some embodiments, the ingestible device (e.g., ingestible device 100, 300, or 400) may be configured to obtain a fluid sample from the environment external to a housing of the ingestible device in response to identifying a change in the location of the ingestible device. For example, ingestible device 100 may be configured to obtain a fluid sample from the environment external to the housing of ingestible device 100 (e.g., through the use of optional opening 116 and optional rotating assembly 118 (FIG. 2)) in response to determining that the ingestible device is located within the jejunum (e.g., jejunum 314 (FIG. 3)). In some embodiments, ingestible device 100 may also be equipped with appropriate diagnostics to detect certain medical conditions based on the retrieved fluid sample, such as small intestinal bacterial overgrowth (SIBO).

In some embodiments, the ingestible device (e.g., ingestible device 100, 300, or 400) may be configured to deliver a dispensable substance that is pre-stored within the ingestible device from the ingestible device into the gastrointestinal tract in response to identifying the change in the location of the ingestible device. For example, ingestible device 100 may have a dispensable substance pre-stored within the ingestible device 100 (e.g., within a storage chamber or cavity on optional storage sub-unit 118-3 (FIG. 2)), and ingestible device 100 may be configured to dispense the substance into the gastrointestinal tract (e.g., through the use of optional opening 116 and optional rotating assembly 118 (FIG. 2)) when the ingestible device 100 detects that the ingestible device 100 is located within the jejunum (e.g., jejunum 314 (FIG. 3)). In some embodiments, this may enable ingestible device 100 to deliver substances (e.g., therapeutics and medicaments) at targeted locations within the GI tract.

In some embodiments, the ingestible device (e.g., ingestible device 100, 300, or 400) may be configured to perform an action based on the total number of detected muscle contractions. For example, ingestible device 100 may be configured to retrieve data indicative of the total number of muscle contractions (e.g., from memory circuitry of PCB 120 (FIG. 2)), and compare that to an expected number muscle contractions in a healthy individual. In response, the ingestible device may either dispense a substance into the gastrointestinal tract (e.g., through the use of optional opening 116 and optional rotating assembly 118 (FIG. 2)), or may obtain a fluid sample from the environment external to the housing of ingestible device 100 (e.g., through the use of optional opening 116 and optional rotating assembly 118 (FIG. 2)). For instance, ingestible device 100 may be configured to obtain a sample in response to determining that a number of detected muscle contractions is abnormal, and differs greatly from the expected number. As another example, ingestible device 100 may be configured to deliver a substance into the GI tract (such as a medicament), in response to determining that the detected muscle contractions are consistent with a functioning GI tract in a healthy individual.

It will be understood that the steps and descriptions of the flowcharts of this disclosure, including FIG. 9, are merely illustrative. Any of the steps and descriptions of the flowcharts, including FIG. 9, may be modified, omitted, rearranged, performed in alternate orders or in parallel, two or more of the steps may be combined, or any additional steps may be added, without departing from the scope of the present disclosure. For example, the ingestible device 100 may calculate the mean and the standard deviation of multiple data sets in parallel (e.g., multiple data sets, each one corresponding to a different wavelength of reflectance or different sensing sub-unit used to detect the reflectance) in order to speed up the overall computation time. Furthermore, it should be noted that the steps and descriptions of FIG. 9 may be combined with any other system, device, or method described in this application, and any of the ingestible devices or systems discussed in this application could be used to perform one or more of the steps in FIG. 9.

Figure 10:
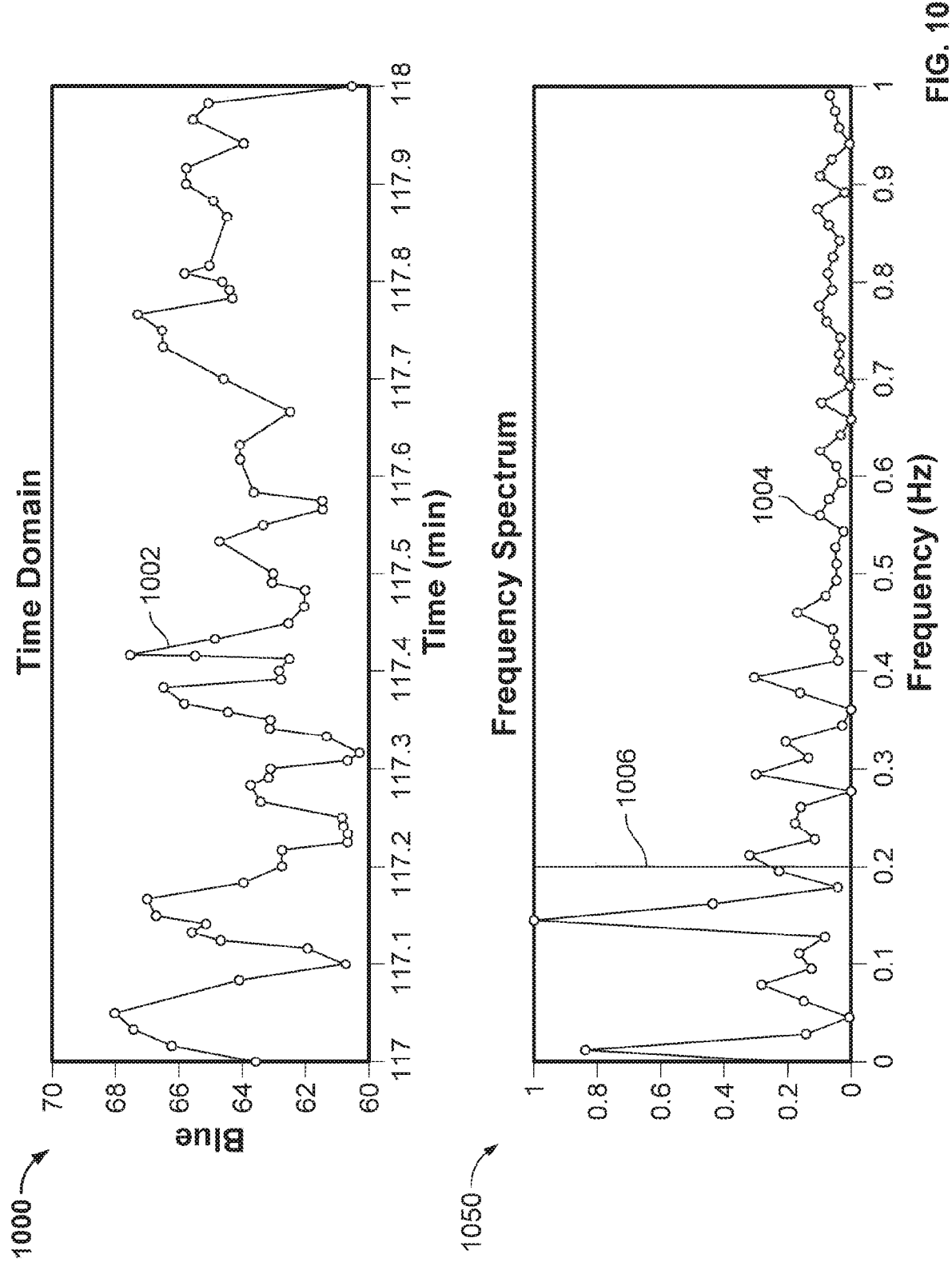
FIG. 10 is a plot illustrating data collected during an example operation of an ingestible device, which may be used when detecting a transition from a duodenum to a jejunum, in accordance with some embodiments of the disclosure.

FIG. 10 is a plot illustrating data collected during an example operation of an ingestible device, which may be used when detecting a transition from a duodenum to a jejunum, in accordance with some embodiments of the disclosure. Diagram 1000 depicts a time domain plot 1002 of a data set of reflectance levels measured by an ingestible device (e.g., the second subset of data discussed in relation to 908 of FIG. 9). In some embodiments, ingestible device 100 may be configured to gather data points at semi-regular intervals approximately 0.5 seconds apart. By comparison, diagram 1050 depicts a frequency domain plot 1004 of the same data set of reflectance levels measured by an ingestible device (e.g., as a result of ingestible device 100 calculating a frequency spectrum at 910 of FIG. 9). In some embodiments, ingestible device 100 may be configured to calculate the frequency spectrum through any convenient means.

In diagram 1050, the range of frequencies 1006 between 0.1 Hz and 0.2 Hz may be the range of frequencies that ingestible device 100 searches in order to detect muscle contractions. As shown in diagram 1050, there is a strong peak in the frequency domain plot 1004 around 0.14 Hz, which is consistent with the frequency of peristaltic motion in a healthy human individual. In this case, an ingestible device 100 analyzing frequency domain plot 1004 may be configured to determine that the data is consistent with a detected muscle contraction (e.g., using a process similar to 912 of process 900 (FIG. 9)), and may store data (e.g., in memory circuitry of PCB 120 (FIG. 2)) indicating that a muscle contraction has been detected. Because the muscle contraction was detected from the one-minute window of data ending at 118 minutes, ingestible device 100 may also store data indicating that the muscle contraction was detected at the 118-minute mark (i.e., which may indicate that the ingestible device 100 was turned on and ingested by the subject 118 minutes ago).

Figure 11:
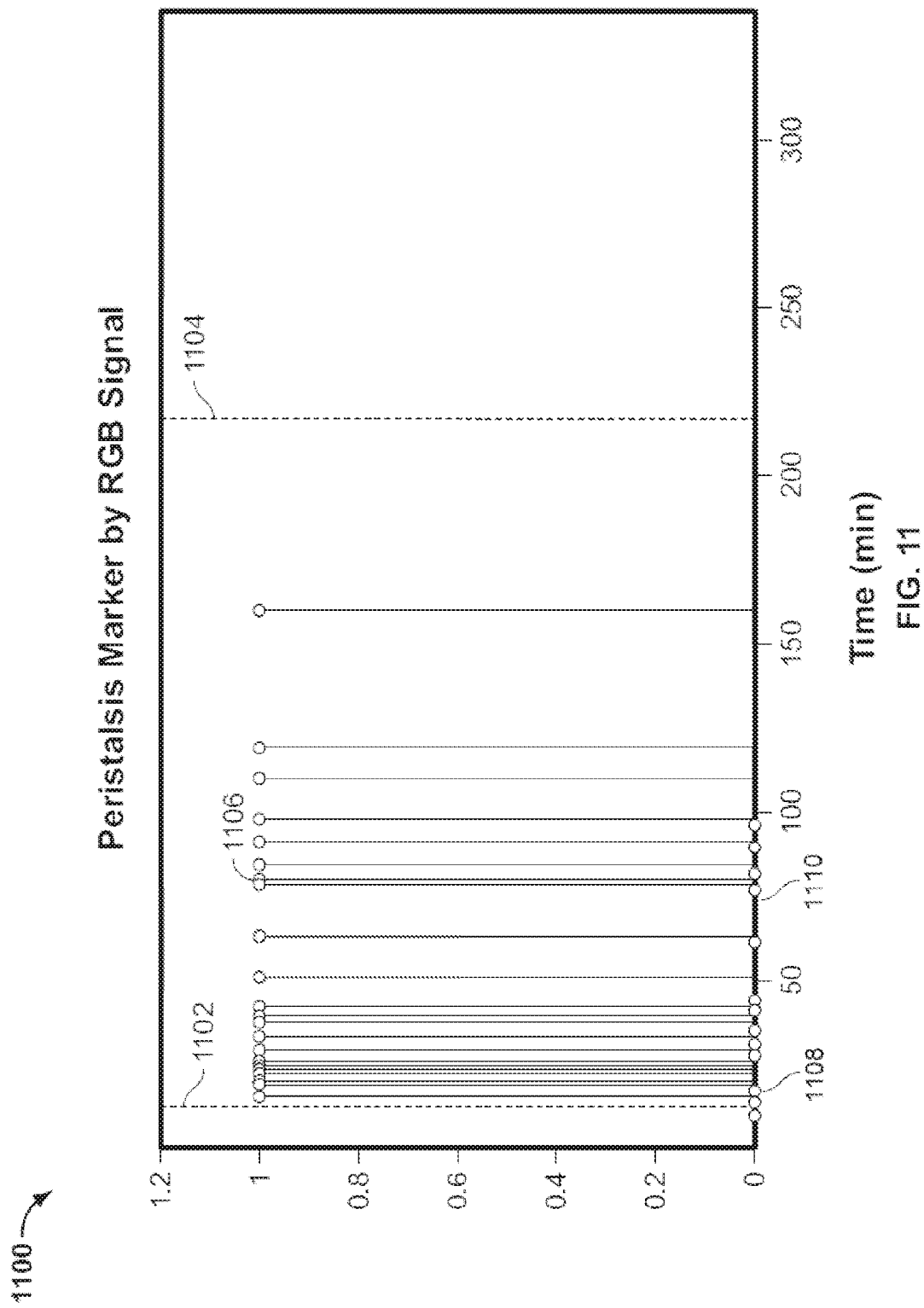
FIG. 11 is a plot illustrating muscle contractions detected by an ingestible device over time, which may be used when determining a location of an ingestible device as it transits through a GI tract, in accordance with some embodiments of the disclosure.

FIG. 11 is a plot illustrating muscle contractions detected by an ingestible device over time, which may be used when determining a location of an ingestible device as it transits through a gastrointestinal (GI) tract, in accordance with some embodiments of the disclosure. In some embodiments, ingestible device 100 may be configured to detect muscle contractions, and store data indicative of when each muscle contraction is detected (e.g., as part of 914 of process 900 (FIG. 9)). Plot 1100 depicts the detected muscle contractions 1106 over time, with each muscle contraction being represented by a vertical line reaching from "0" to "1" on the y-axis.

At 1102, around the 10-minute mark, ingestible device 100 first enters the duodenum (e.g., as determined by ingestible device 100 performing process 600 (FIG. 6)). Shortly thereafter, at 1108, ingestible device 100 begins to detect several muscle contractions 1106 in quick succession, which may be indicative of the strong peristaltic waves that form in the jejunum (e.g., jejunum 314 (FIG. 3)). Later, around 1110, ingestible device 100 continues to detect intermittent muscle contractions, which may be consistent with an ingestible device 100 within the ileum. Finally at 1104, ingestible device 100 transitions out of the small intestine, and into the cecum. Notably, ingestible device 100 detects more frequent muscle contractions in the jejunum portion of the small intestine as compared to the ileum portion of the small intestine, and ingestible device 100 does not measure any muscle contractions after having exited the small intestine. In some embodiments, ingestible device 100 may incorporate this information into a localization process. For example, ingestible device 100 may be configured to detect a transition from a jejunum to an ileum in response to determining that a frequency of detected muscle contractions (e.g., the number of muscle contractions measured in a given 10-minute window) has fallen below a threshold number. As another example, ingestible device 100 may be configured to detect a transition from an ileum to a cecum in response to determining that no muscle contractions have been detected for a threshold period of time. It is understood that these examples are intended to be illustrative, and not limiting, and that measurements of muscle contractions may be combined with any of the other processes, systems, or methods discussed in this disclosure.

Figure 12:
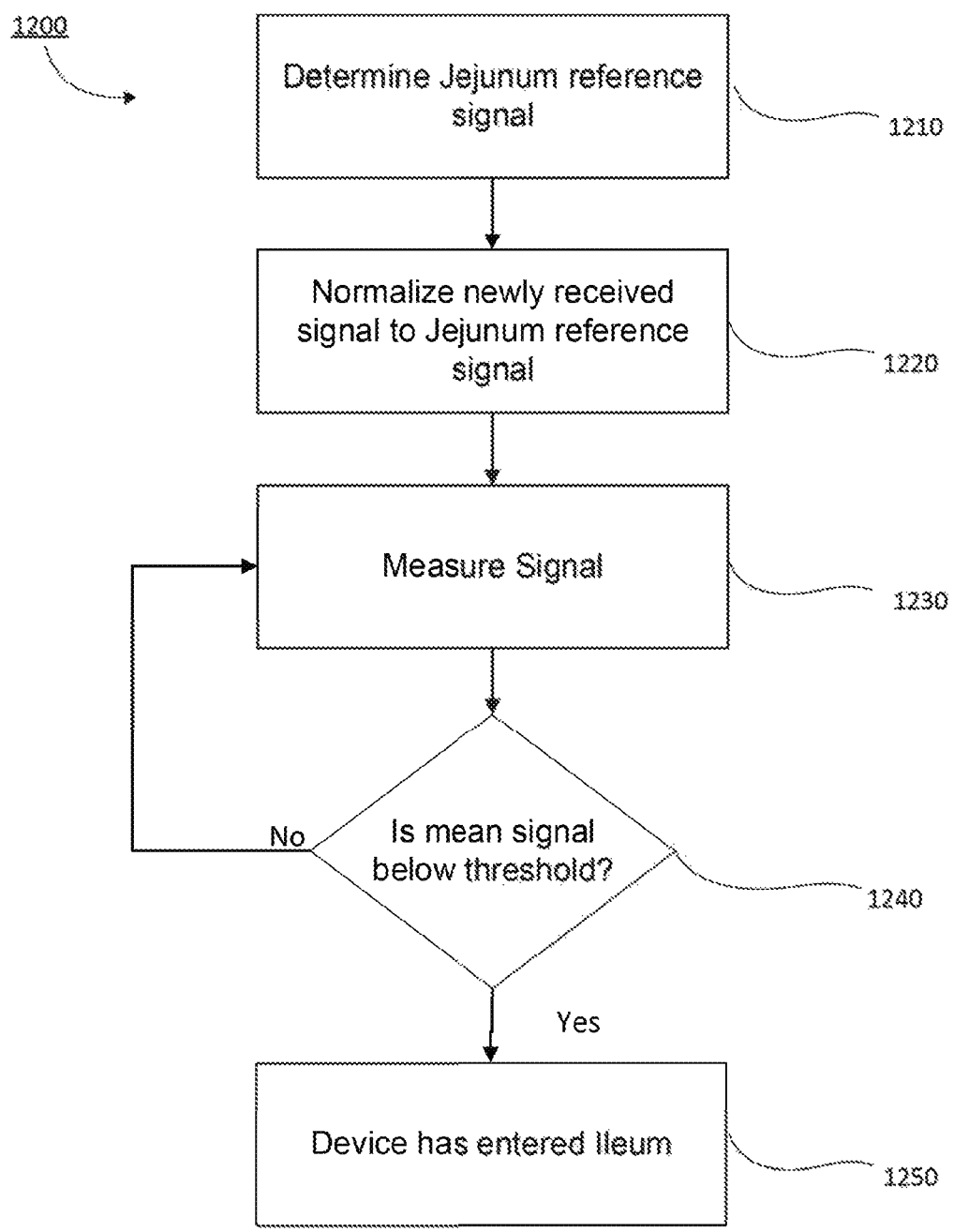
FIG. 12 is a flowchart of illustrative steps for detecting a transition from a jejunum to an ileum, which may be used when determining a location of an ingestible device as it transits through a GI tract, in accordance with some embodiments of the disclosure.

FIG. 12 is a flowchart 1200 for certain embodiments for determining a transition of the device from the jejunum to the ileum. It is to be noted that, in general, the jejunum is redder and more vascular than the ileum. Moreover, generally, in comparison to the ileum, the jejunum has a thicker intestine wall with more messentary fat. These differences between the jejunum and the ileum are expected to result in differences in optical responses in the jejunum relative to the ileum. Optionally, one or more optical signals may be used to investigate the differences in optical responses. For example, the process can include monitoring a change in optical response in reflected red light, blue light, green light, ratio of red light to green light, ratio of red light to blue light, and/or ratio of green light to blue light. In some embodiments, reflected red light is detected in the process.

Flowchart 1200 represents a single sliding window process. In step 1210, the jejunum reference signal is determined based on optical reflection. Typically, this signal is as the average signal (e.g., reflected red light) over a period of time since the device was determined to enter the jejunum. The period of time can be, for example, from five minutes to 40 minutes (e.g., from 10 minutes to 30 minutes, from 15 minutes to 25 minutes). In step 1220, the detected signal (e.g., reflected red light) just after the period of time used in step 1210 is normalized to the reference signal determined in step 1210. In step 1230, the signal (e.g., reflected red light) is detected. In step 1240, the mean signal detected based on the single sliding window is compared to a signal threshold. The signal threshold in step 1240 is generally a fraction of the reference signal of the jejenum reference signal determined in step 1210. For example, the signal threshold can be from 60% to 90% (e.g., from 70% to 80%) of the jejenum reference signal. If the mean signal exceeds the signal threshold, then the process determines that the device has entered the ileum at step 1250. If the mean signal does not exceed the signal threshold, then the process returns to step 1230.

Figure 13:
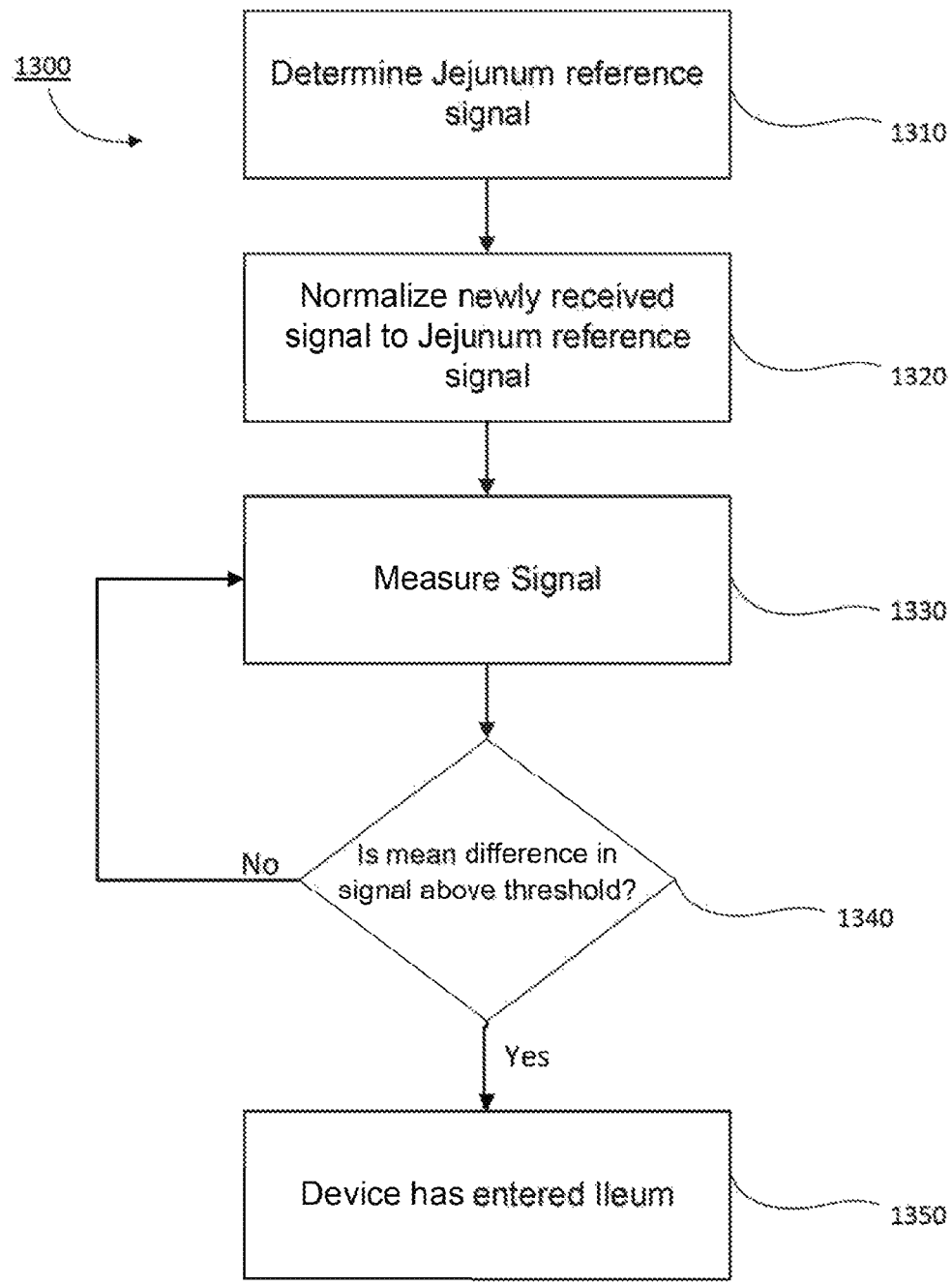
FIG. 13 is a flowchart of illustrative steps for detecting a transition from a jejunum to an ileum, which may be used when determining a location of an ingestible device as it transits through a GI tract, in accordance with some embodiments of the disclosure.

FIG. 13 is a flowchart 1200 for certain embodiments for determining a transition of the device from the jejunum to the ileum using a two sliding window process. In step 1310, the jejenum reference signal is determined based on optical reflection. Typically, this signal is as the average signal (e.g., reflected red light) over a period of time since the device was determined to enter the jejenum. The period of time can be, for example, from five minutes to 40 minutes (e.g., from 10 minutes to 30 minutes, from 15 minutes to 25 minutes). In step 1320, the detected signal (e.g., reflected red light) just after the period of time used in step 1310 is normalized to the reference signal determined in step 1310. In step 1330, the signal (e.g., reflected red light) is detected. In step 1340, the mean difference in the signal detected based on the two sliding windows is compared to a signal threshold. The signal threshold in step 1340 is based on whether the mean difference in the detected signal exceeds a multiple (e.g., from 1.5 times to five times, from two times to four times) of the detected signal of the first window. If signal threshold is exceeded, then the process determines that the device has entered the ileum at step 1350. If the signal threshold is not exceeded, then the process returns to step 1330.

Figure 14:
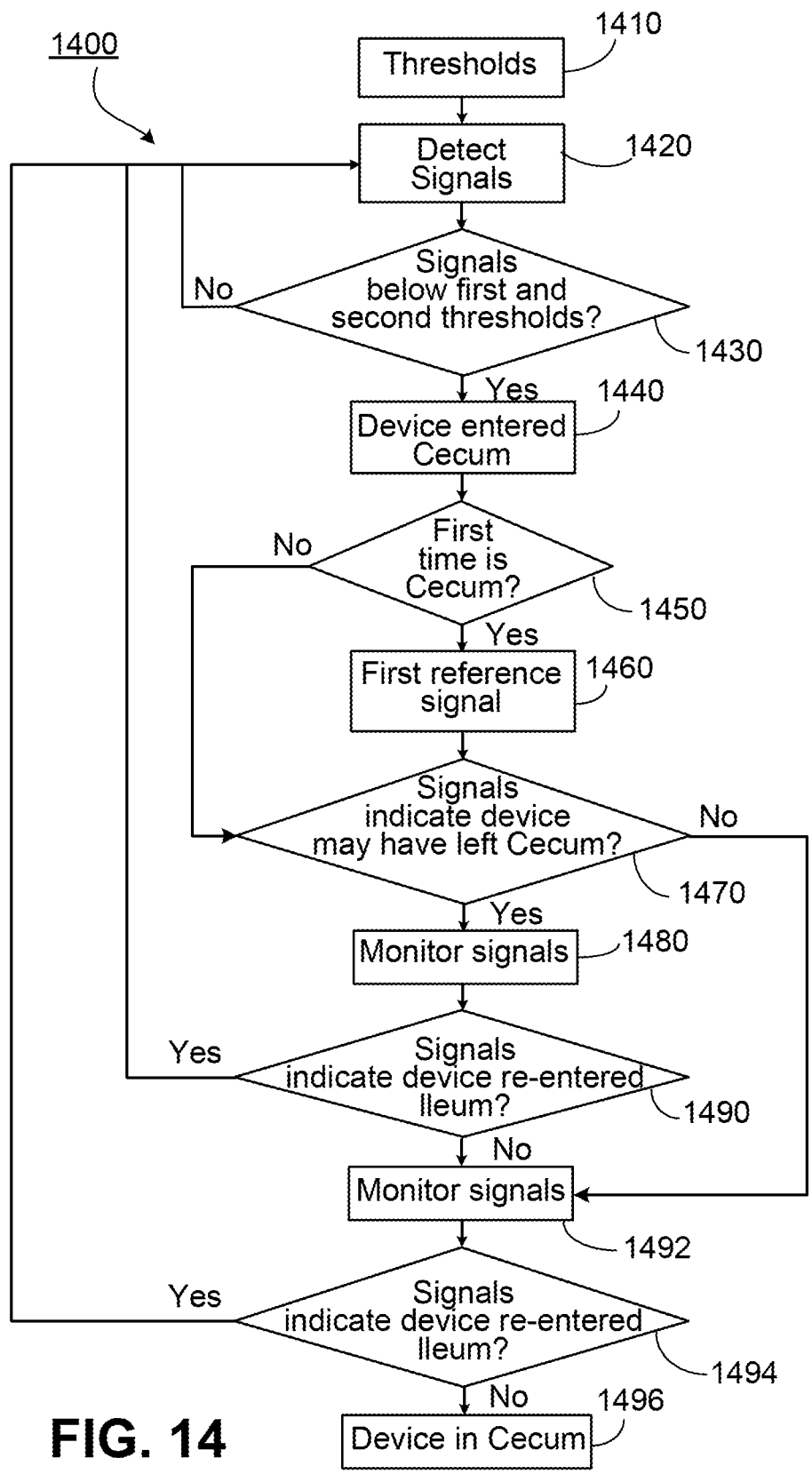
FIG. 14 is a flowchart of illustrative steps for detecting a transition from an ileum to a cecum, which may be used when determining a location of an ingestible device as it transits through a GI tract, in accordance with some embodiments of the disclosure.

FIG. 14 is a flowchart 1400 for a process for certain embodiments for determining a transition of the device from the ileum to the cecum. In general, the process involves detecting changes in the reflected optical signal (e.g., red light, blue light, green light, ratio of red light to green light, ratio of red light to blue light, and/or ratio of green light to blue light). In some embodiments, the process includes detecting changes in the ratio of reflected red light to reflected green light, and also detecting changes in the ratio of reflected green light to reflected blue light. Generally, in the process 1400, the sliding window analysis (first and second windows) discussed with respect to process 600 is continued.

Step 1410 includes setting a first threshold in a detected signal, e.g., ratio of detected red light to detected green light, and setting a second threshold for the coefficient of variation for a detected signal, e.g., the coefficient of variation for the ratio of detected green light to detected blue light. The first threshold can be set to a fraction (e.g., from 0.5 to 0.9, from 0.6 to 0.8) of the average signal (e.g., ratio of detected red light to detected green light) in the first window, or a fraction (e.g., from 0.4 to 0.8, from 0.5 to 0.7) of the mean difference between the detected signal (e.g., ratio of detected red light to detected green light) in the two windows. The second threshold can be set to 0.1 (e.g., 0.05, 0.02).

Step 1420 includes detecting the signals in the first and second windows that are to be used for comparing to the first and second thresholds.

Step 1430 includes comparing the detected signals to the first and second thresholds. If the corresponding value is not below the first threshold or the corresponding value is not below the second threshold, then it is determined that the device has not left the ileum and entered the cecum, and the process returns to step 1420. If the corresponding value is below the first threshold and the corresponding value is below the second threshold, then it is determined that the device has left the ileum and entered the cecum, and the proceeds to step 1440.

Step 1450 includes determining whether it is the first time that that the device was determined to leave the ileum and enter the cecum. If it is the first time that the device was determined to leave the ileum and enter the cecum, then the process proceeds to step 1460. If it is not the first time that the device has left the ileum and entered the cecum, then the process proceeds to step 1470.

Step 1460 includes setting a reference signal. In this step the optical signal (e.g., ratio of detected red light to detected green light) as a reference signal.

Step 1470 includes determining whether the device may have left the cecum and returned to the ileum. The device is determined to have left the cecum and returned to the ileum if the corresponding detected signal (e.g., ratio of detected red light to detected green light) is statistically comparable to the reference signal (determined in step 1460) and the coefficient of variation for the corresponding detected signal (e.g., ratio of detected green light to detected blue light) exceeds the second threshold. If it is determined that the device may have left the cecum and returned to the ileum, the process proceeds to step 1480.

Step 1480 includes continuing to detect the relevant optical signals for a period of time (e.g., at least one minute, from five minutes to 15 minutes).

Step 1490 includes determining whether the signals determined in step 1480 indicate (using the methodology discussed in step 1470) that the device re-entered the ileum. If the signals indicate that the device re-entered the ileum, the process proceeds to step 1420. If the signals indicate that the device is in the cecum, the process proceeds to step 1492.

Step 1492 includes continuing to monitor the relevant optical signals for a period of time (e.g., at least 30 minutes, at least one hour, at least two hours).

Step 1494 includes determining whether the signals determined in step 1492 indicate (using the methodology discussed in step 1470) that the device re-entered the ileum. If the signals indicate that the device re-entered the ileum, the process proceeds to step 1420. If the signals indicate that the device is in the cecum, the process proceeds to step 1496.

At step 1496, the process determines that the device is in the cecum.

Figure 15:
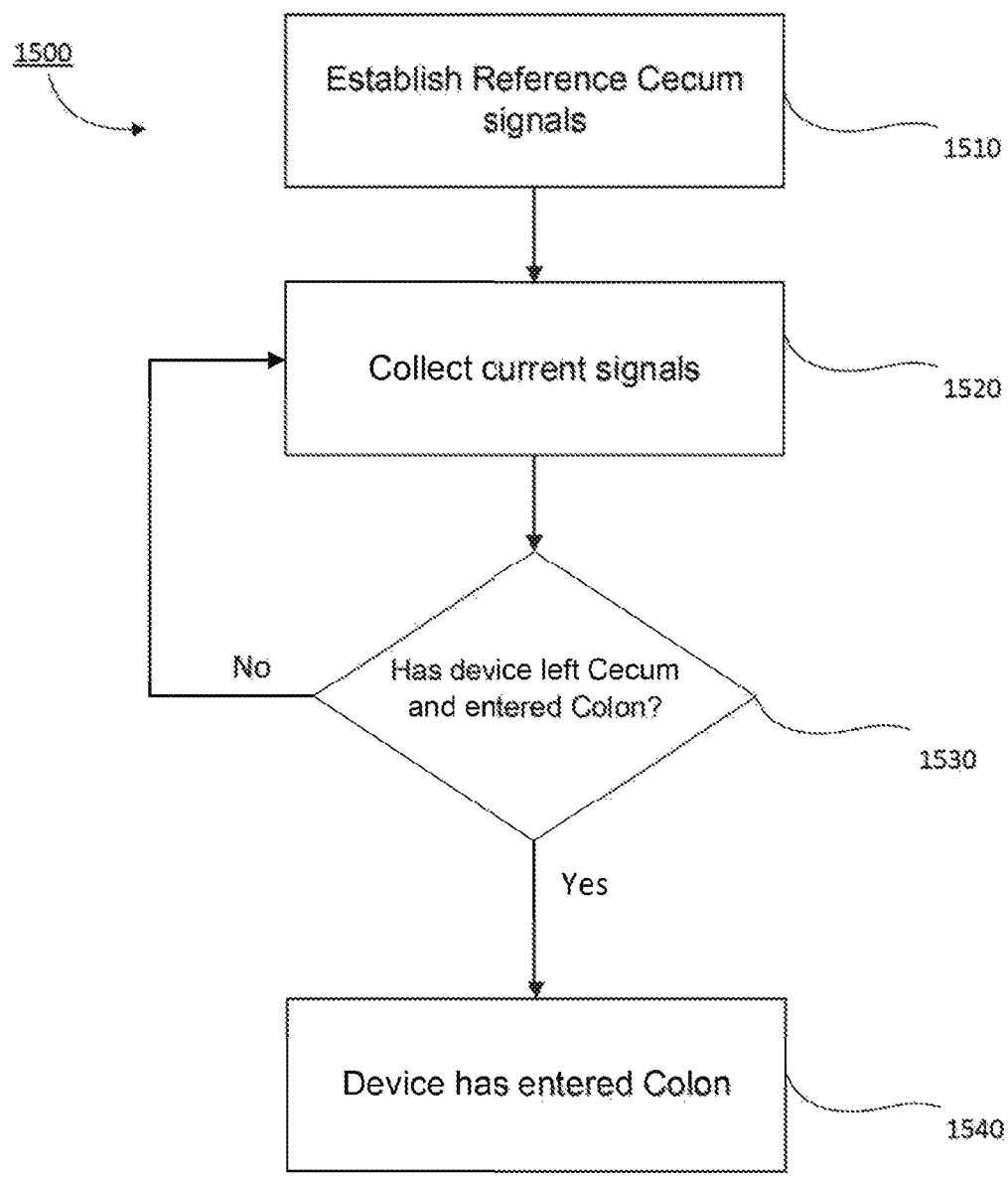
FIG. 15 is a flowchart of illustrative steps for detecting a transition from a cecum to a colon, which may be used when determining a location of an ingestible device as it transits through a GI tract, in accordance with some embodiments of the disclosure.

FIG. 15 is a flowchart 1500 for a process for certain embodiments for determining a transition of the device from the cecum to the colon. In general, the process involves detecting changes in the reflected optical signal (e.g., red light, blue light, green light, ratio of red light to green light, ratio of red light to blue light, and/or ratio of green light to blue light). In some embodiments, the process includes detecting changes in the ratio of reflected red light to reflected green light, and also detecting changes in the ratio of reflected blue light. Generally, in the process 1500, the sliding window analysis (first and second windows) discussed with respect to process 1400 is continued.

In step 1510, optical signals (e.g., the ratio of reflected red signal to reflected green signal, and reflected blue signal) are collected for a period of time (e.g., at least one minute, at least five minutes, at least 10 minutes) while the device is in the cecum (e.g., during step 1480). The average values for the recorded optical signals (e.g., the ratio of reflected red signal to reflected green signal, and reflected blue signal) establish the cecum reference signals.

In step 1520, the optical signals are detected after it has been determined that the device entered the cecum (e.g., at step 1440). The optical signals are normalized to the cecum reference signals.

Step 1530 involves determining whether the device has entered the colon. This includes determining whether any of three different criteria are satisfied. The first criterion is satisfied if the mean difference in the ratio of a detected optical signal (e.g., ratio of detected red signal to the detected green) is a multiple greater than one (e.g., 2×, 3×, 4×) the standard deviation of the corresponding signal (e.g., ratio of detected red signal to the detected green) in the second window. The second criterion is satisfied if the mean of a detected optical signal (e.g., a ratio of detected red light to detected green light) exceeds a given value (e.g., exceeds one). The third criterion is satisfied if the coefficient of variation of an optical signal (e.g., detected blue light) in the first window exceeds a given value (e.g., exceeds 0.2). If any of the three criteria are satisfied, then the process proceeds to step 1540. Otherwise, none of the three criteria are satisfied, the process returns to step 1520.

For illustrative purposes the disclosure focuses primarily on a number of different example embodiments of an ingestible device, and example embodiments of methods for determining a location of an ingestible device within a GI tract. However, the possible ingestible devices that may be constructed are not limited to these embodiments, and variations in the shape and design may be made without significantly changing the functions and operations of the device. Similarly, the possible procedures for determining a location of the ingestible device within the GI tract are not limited to the specific procedures and embodiments discussed (e.g., process 500 (FIG. 5), process 600 (FIG. 6), process 900 (FIG. 9), process 1200 (FIG. 12), process 1300 (FIG. 13), process 1400 (FIG. 14) and process 1500 (FIG. 15)). Also, the applications of the ingestible devices described herein are not limited merely to gathering data, sampling and testing portions of the gastrointestinal tract, or delivering medicament. For example, in some embodiments the ingestible device may be adapted to include a number of chemical, electrical, or optical diagnostics for diagnosing a number of diseases. Similarly, a number of different sensors for measuring bodily phenomenon or other physiological qualities may be included on the ingestible device. For example, the ingestible device may be adapted to measure elevated levels of certain chemical compounds or impurities in the gastrointestinal tract, or the combination of localization, sampling, and appropriate diagnostic and assay techniques incorporated into a sampling chamber may be particularly well suited to determine the presence of small intestinal bacterial overgrowth (SIBO).

At least some of the elements of the various embodiments of the ingestible device described herein that are implemented via software (e.g., software executed by control circuitry within PCB 120 (FIG. 2)) may be written in a high-level procedural language such as object oriented programming, a scripting language or both. Accordingly, the program code may be written in C, C++ or any other suitable programming language and may comprise modules or classes, as is known to those skilled in object oriented programming. Alternatively, or in addition, at least some of the elements of the embodiments of the ingestible device described herein that are implemented via software may be written in assembly language, machine language or firmware as needed. In either case, the language may be a compiled or an interpreted language.

At least some of the program code used to implement the ingestible device can be stored on a storage media or on a computer readable medium that is readable by a general or special purpose programmable computing device having a processor, an operating system and the associated hardware and software that is necessary to implement the functionality of at least one of the embodiments described herein. The program code, when read by the computing device, configures the computing device to operate in a new, specific and predefined manner in order to perform at least one of the methods described herein.

Furthermore, at least some of the programs associated with the systems, devices, and methods of the example embodiments described herein are capable of being distributed in a computer program product comprising a computer readable medium that bears computer usable instructions for one or more processors. The medium may be provided in various forms, including non-transitory forms such as, but not limited to, one or more diskettes, compact disks, tapes, chips, and magnetic and electronic storage. In some embodiments, the medium may be transitory in nature such as, but not limited to, wire-line transmissions, satellite transmissions, internet transmissions (e.g. downloads), media, digital and analog signals, and the like. The computer useable instructions may also be in various formats, including compiled and non-compiled code.

The techniques described above can be implemented using software for execution on a computer. For instance, the software forms procedures in one or more computer programs that execute on one or more programmed or programmable computer systems (which may be of various architectures such as distributed, client/server, or grid) each including at least one processor, at least one data storage system (including volatile and non-volatile memory and/or storage elements), at least one input device or port, and at least one output device or port.

The software may be provided on a storage medium, such as a CD-ROM, readable by a general or special purpose programmable computer or delivered (encoded in a propagated signal) over a communication medium of a network to the computer where it is executed. All of the functions may be performed on a special purpose computer, or using special-purpose hardware, such as coprocessors. The software may be implemented in a distributed manner in which different parts of the computation specified by the software are performed by different computers. Each such computer program is preferably stored on or downloaded to a storage media or device (e.g., solid state memory or media, or magnetic or optical media) readable by a general or special purpose programmable computer, for configuring and operating the computer when the storage media or device is read by the computer system to perform the procedures described herein. The inventive system may also be considered to be implemented as a computer-readable storage medium, configured with a computer program, where the storage medium so configured causes a computer system to operate in a specific and predefined manner to perform the functions described herein.

Methods and Mechanisms of Delivery

Figure 16:
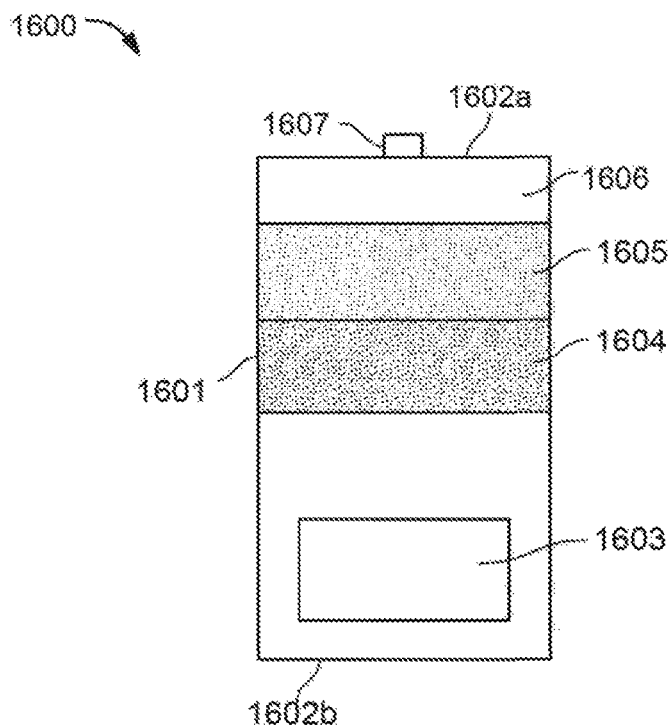
FIG. 16 illustrates an ingestible device for delivering a substance in the GI tract.

FIG. 16 provides an example mock-up diagram illustrating aspects of a structure of an ingestible device 1600 for delivering a dispensable substance, such as a formulation of a therapeutic agent described herein, according to some embodiments described herein. In some embodiments, the ingestible device 1600 may generally be in the shape of a capsule, a pill or any swallowable form that may be orally consumed by an individual. In this way, the ingestible device 1600 may be ingested by a patient and may be prescribed by healthcare practitioners and patients.

FIG. 16 provides an example mock-up diagram illustrating aspects of a structure of an ingestible device 1600 for delivering a dispensable substance, according to some embodiments described herein. In some embodiments, the ingestible device 1600 may generally be in the shape of a capsule, a pill or any swallowable form that may be orally consumed by an individual. In this way, the ingestible device 1600 may be ingested by a patient and may be prescribed by healthcare practitioners and patients.

The ingestible device 1600 includes a housing 1601 that may take a shape similar to a capsule, a pill, and/or the like, which may include two ends 1602a-b. The housing 1601 may be designed to withstand the chemical and mechanical environment of the GI tract (e.g., effects of muscle contractile forces and concentrated hydrochloric acid in the stomach). A broad range of materials that may be used for the housing 1601. Examples of these materials include, but are not limited to, thermoplastics, fluoropolymers, elastomers, stainless steel and glass complying with ISO 10993 and USP Class VI specifications for biocompatibility; and any other suitable materials and combinations thereof.

In some embodiment, the wall of the housing 1601 may have a thickness of 0.5 mm-1 mm, which is sufficient to sustain an internal explosion (e.g., caused by hydrogen ignition or over pressure inside the housing).

The housing 1601 may or may not have a pH-sensitive enteric coating to detect or otherwise be sensitive to a pH level of the environment external to the ingestible device. As discussed elsewhere in the application in more detail, the ingestible device 1600 may additionally or alternatively include one more sensors, e.g., temperature sensor, optical sense.

The housing 1601 may be formed by coupling two enclosure portions together. The ingestible device 1600 may include an electronic component within the housing 1600. The electronic component may be placed proximally to an end 1602b of the housing, and includes a printed circuit board (PCB), a battery, an optical sensing unit, and/or the like.

The ingestible device 1600 further includes a gas generating cell 1603 that is configured to generate gas and thus cause an internal pressure within the housing 1601. In some embodiments, the gas generating cell may include or be connected to a separate channel or valve of the ingestible device such that gas may be release through the channel or valve to create a motion to alter the position of the ingestible device within the GI tract. Such gas release can also be used to position the ingestible device relative to the intestinal lining. In another embodiment, gas may be released through the separate channel or valve to alter the surface orientation of the intestinal tissue prior to delivery of the dispensable substance.

A traveling plunger 1604 may be placed on top of the gas generating cell 1603 within the housing 1601. The traveling plunger 1604 is a membrane that separates the gas generating cell 1603 and a storage reservoir that stores the dispensable substance 1605. In some embodiments, the traveling plunger 1604 may be a movable piston. In some embodiments, the traveling plunger 1604 may instead be a flexible membrane such as but not limited to a diaphragm. In some embodiments, the traveling plunger 1604, which may have the form of a flexible diaphragm, may be placed along an axial direction of the housing 1601, instead of being placed on top of the gas generating cell 1603. The traveling plunger or the membrane 1604 may move (when the membrane 1604 is a piston) or deform (when the membrane 1604 is a diaphragm) towards a direction of the end 1602a of the housing, when the gas generating cell 1603 generates gas to create an internal pressure that pushes the membrane 1604. In this way, the membrane or traveling plunger 1604 may push the dispensable substance 1605 out of the housing via a dispensing outlet 1607.

The housing 1601 may include a storage reservoir storing one or more dispensable substances 1605 adjacent to the traveling plunger 1604. The dispensable substance 1605 may be a therapeutic or medical agent that may take a form of a powder, a compressed powder, a fluid, a semi-liquid gel, or any other dispensable or deliverable form. The delivery of the dispensable substance 1605 may take a form such as but not limited to bolus, semi-bolus, continuous, burst drug delivery, and/or the like. In some embodiments, a single bolus is delivered proximate to the disease location. In some embodiments, more than one bolus is released at one location or more than one location. In some embodiments the release of more than one bolus is triggered according to a pre-programmed algorithm. In some embodiments the release profile is continuous. In some embodiments the release profile is time-based. In some embodiments the release profile is location-based. In some embodiments, the amount delivered is based on the severity and/or extent of the disease in the following manner. In some embodiments, the bolus is delivered in one or more of the following locations: stomach; duodenum; proximal jejunum; ileum; cecum; ascending colon; transverse colon; descending colon.

In some embodiments the dispensable substance is a small molecule therapeutic that is released in the cecum and/or other parts of the large intestine. Small molecules that are administered by typical oral routes are primarily absorbed in the small intestine, with much lower absorption taking place in the large intestine (outside of the rectum). Accordingly, an ingestible device that is capable of releasing a small molecule selectively in the large intestine (e.g., the cecum) with resulting low systemic levels (even when high doses are used) is attractive for subjects with inflammatory bowel disease in the large intestine.

In some embodiments, the storage reservoir may include multiple chambers, and each chamber stores a different dispensable substance. For example, the different dispensable substances can be released at the same time via the dispensing outlet 1607. Alternatively, the multiple chambers may take a form of different layers within the storage reservoir such that the different dispensable substance from each chamber is delivered sequentially in an order. In one example, each of the multiple chambers is controlled by a separate traveling plunger, which may be propelled by gas generation. The electronic component may control the gas generating cell 1603 to generate gas to propel a specific traveling plunger, e.g., via a separate gas generation chamber, etc., to delivery the respective substance. In some embodiments, the content of the multiple chambers may be mixed or combined prior to release, for example, to activate the drug.

The ingestible device 1600 may include a dispensing outlet 1607 at one end 1602a of the housing 1601 to direct the dispensable substance 105 out of the housing. The dispensing outlet 1607 may include an exit valve, a slit or a hole, a jet injection nozzle with a syringe, and/or the like. When the traveling plunger 1604 moves towards the end 1602a of the housing 1601, an internal pressure within the storage reservoir may increase and push the dispensing outlet to be open to let the dispensable substance 1605 be released out of the housing 1601.

In an embodiment, a pressure relief device 1606 may be placed within the housing 1601, e.g., at the end 1602a of the housing 1601.

In some embodiments, the housing 1601 may include small holes (e.g., with a diameter smaller than 2 mm), e.g., on the side of the housing 1601, or at the end 1602a to facilitate loading the dispensable substance into the storage reservoir.

In some embodiments, a feedback control circuit (e.g., a feedback resistor, etc.) may be added to send feedback from the gas generating cell 1603 to the electronic component such that when the internal pressure reaches a threshold level, the electronic component may control the gas generating cell 1603 to turn off gas generation, or to activate other safety mechanism (e.g., feedback-controlled release valve, etc.). For example, an internal pressure sensor may be used to measure the internal pressure within the ingestible device and generate feedback to the feedback control circuit.

Figure 17:
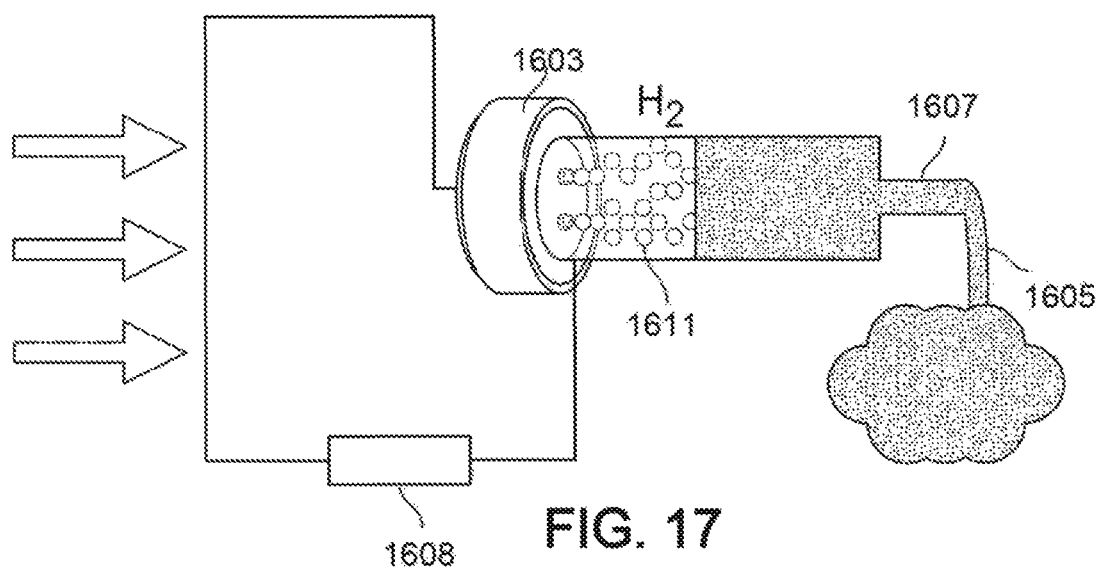
FIG. 17 illustrates aspects of a mechanism for an ingestible device with a gas generating cell configured to generate a gas to dispense a substance.

FIG. 17 provides an example diagram illustrating aspects of a mechanism for a gas generating cell 1603 configured to generate a gas to dispense a substance, according to some embodiments described herein. As shown in FIG. 17, the gas generating cell 1603 generates a gas 1611 which can propel the dispensable substance 1605 out of the dispensing outlet 1607. A variable resistor 1608 may be connected to a circuit with the gas generating cell 1603 such that the variable resistor 1608 may be used to control an intensity and/or an amount of gas 1611 (e.g., hydrogen) generated by the cell 1603. Specifically, the gas generating cell 1603 may be a battery form factor cell that is capable of generating hydrogen when a resistor is applied. In this way, as the gas generating cell 1603 only needs the use of a resistor only without any active power requirements, the gas generating cell 1603 may be integrated into an ingestible device such as a capsule with limited energy/power available. For example, the gas generating cell 1603 may be compatible with a capsule at a size of 26 mm×13 mm or smaller.

In some embodiments, based on the elution rate of gas from the cell, and an internal volume of the ingestible device, it may take time to generate sufficient gas 1611 to deliver the substance 1605, and the time required may be 30 seconds or longer. For example, the time to generate a volume of hydrogen equivalent to 500 µL of fluid would be approximately 5 minutes. A longer period of time may be needed based upon non-ideal conditions within the ingestible device, such as friction, etc. Thus, given that the production of gas (e.g., hydrogen) may take time, gas generation may need to start prior to the ingestible device arriving at the site of delivery to build pressure up within the device. The ingestible device may then need to know when it is approaching the site of delivery. For example, the device may start producing gas on an "entry transition," which is determined by temperature, so as to produce enough gas to be close to the pressure high enough to deliver the dispensable substance. The ingestible device may then only start producing gas again when it arrives at the site of delivery, which will cause the internal pressure within the ingestible device to reach a level required by the dispensing outlet to release the dispensable substance. Also, for regio-specific delivery, the ingestible device may estimate the time it takes to build up enough pressure to deliver the dispensable substance before the ingestible device arrives at a specific location, to activate gas generation.

For example, for systemic delivery, when an internal volume of the ingestible device is around 500 µL, a gas generation time of 2 hours, an initial pressure of approximately 300 pound per square inch absolute (psia) may be generated, with higher and lower pressures possible. The generated pressure may drop when air enters the storage reservoir which was previously occupied by the dispensable substance during the dispensing process. For systemic drug delivery, a force with a generated pressure of approximately 100 to 360 pound per square inch (psi) may be required for dermal penetration, e.g., to penetrate the mucosa or epithelial layer. The pressure may also vary depending on the nozzle design at the dispensing outlet, fluid viscosity, and surrounding tissue proximity and properties.

The gas 1611 that may be generated for a continuous delivery of drug (e.g., 1 cc H2 in 4 hours, 16 breaths per minute at 0.5 L tidal volume) may equate to 1 cc hydrogen in approximately 2000 L of exhaled air, or approximately 0.5 ppm H2, which is below physiologic values of exhaled hydrogen. Reducing this time to 10 minutes equates to approximately 13 ppm hydrogen. Thus, due to the length of intestine that may be covered during this time period, the ingestible device may possess a higher localized value than physiologic.

Figure 18:
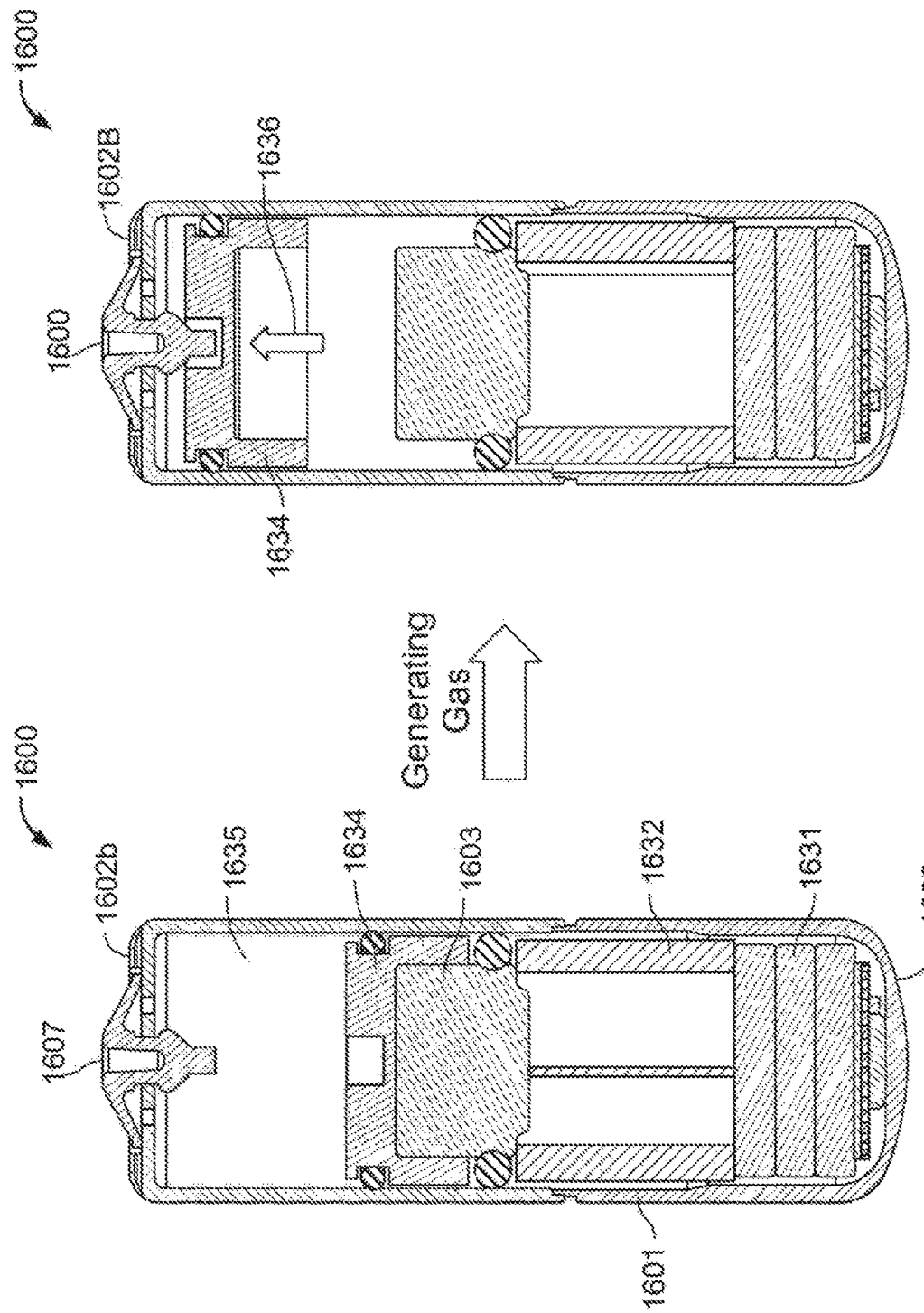
FIG. 18 illustrates an ingestible device having a piston to push for drug delivery.
Figure 19:
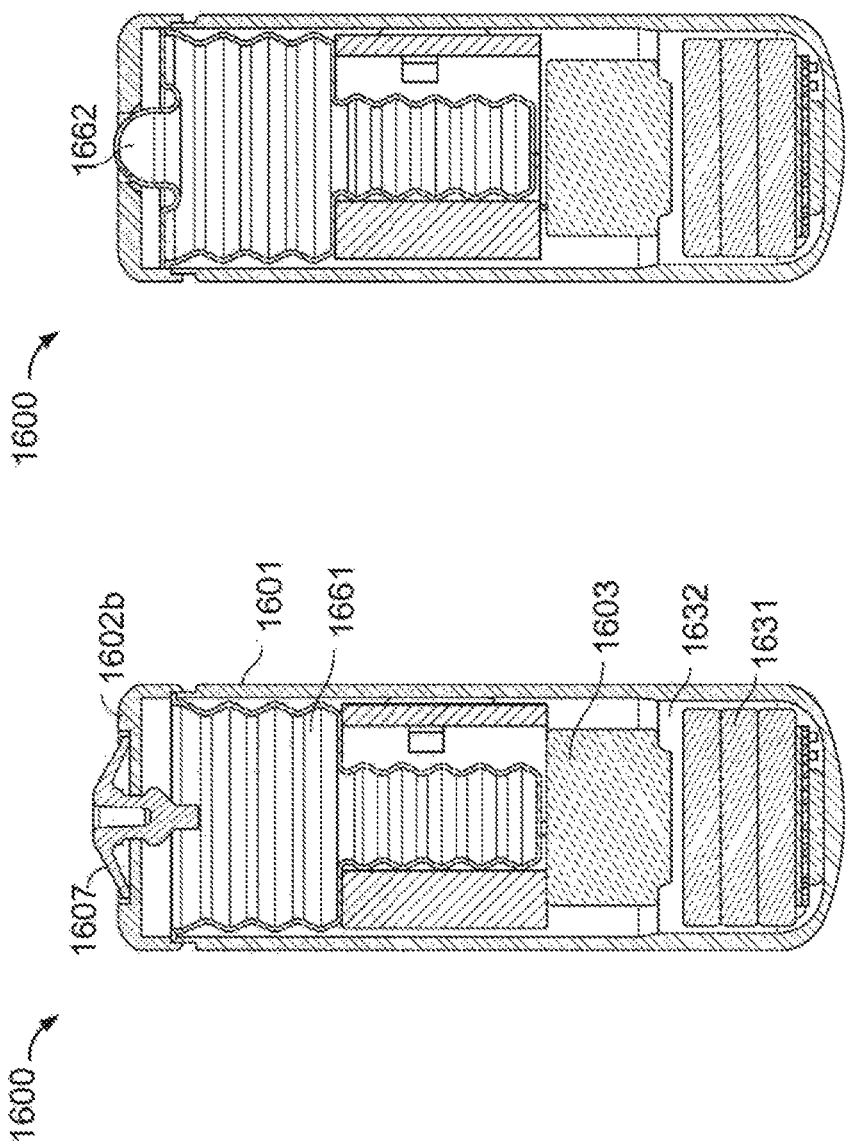
FIG. 19 illustrates an ingestible device having a bellow structure for a storage reservoir of dispensable substances.

FIGS. 18 and 19, disclosed in PCT International Application No. PCT/US2017/050642, which published as WO2018049133 and incorporated by reference herein in its entirety, illustrates an example of an ingestible device for localized delivery of pharmaceutical compositions disclosed herein, in accordance with particular implementations. The ingestible device 1600 includes a piston or drive element 1634 to push for drug delivery, in accordance with particular implementations described herein. The ingestible device 1600 may have one or more batteries 1631 placed at one end 1602*a* of a housing 1601 to provide power for the ingestible device 1600. A printed circuit board (PCB) 1632 may be placed adjacent to a battery or other power source 1631, and a gas generating cell 1603 may be mounted on or above the PCB 1632. The gas generating cell 1603 may be sealed from the bottom chamber (e.g., space including 1631 and 1632) of the ingestible device 1600. A movable piston 1634 may be placed adjacent to the gas generating cell 1603. In this way, gas generation from the gas generating cell 1603 may propel a piston 1634 to move towards another end 1602*b* of the housing 1601 such that the dispensable substance in a reservoir compartment 1635 can be pushed out of the housing through a dispensing outlet 1607, e.g., the movement is shown at 1636, with the piston 1634 at a position after dispensing the substance. The dispensing outlet 1607 may comprise a plug. The reservoir compartment 1635 can store the dispensable substance (e.g., drug substance), or alternatively the reservoir compartment can house a storage reservoir 1661 which comprises the dispensable substance. The reservoir compartment 1635 or storage reservoir 1661 may have a volume of approximately 600 μL or even more dispensable substance, which may be dispensed in a single bolus, or gradually over a period of time.

The battery cells 1631 may have a height of 1.65 mm each, and one to three batteries may be used. The height of the piston may be reduced with custom molded part for around 1.5 mm to save space. If the gas generating cell 1603 is integrated with the piston 1634, the overall height of the PCB, batteries and gas generating cell in total can be reduced to around 5 mm, thus providing more space for drug storage. For example, for an ingestible device of 7.8 mm in length (e.g., from end 1602*a* to the other end 1602*b*), a reservoir compartment 1635 or a storage reservoir 1661 of approximately 600 μL may be used for drug delivery. For another example, for an ingestible device of 17.5 mm in length, a reservoir compartment 1635 or a storage reservoir 1661 of approximately 1300 μL may be used for drug release.

In some implementations, at the reservoir 1635 or 1661 for storing a therapeutically effective amount of any of the agents described herein at least a portion of the device housing 1601. The therapeutically effective amount of the any of the agents described herein can be stored in the reservoir 1635 or 1661 at a particular pressure, for example, determined to be higher than a pressure inside the GI tract so that once the reservoir 1635 or 1661 is in fluid communication with the GI tract, the agent is automatically released. In certain implementations, the reservoir compartment 1635 includes a plurality of chambers, and each of the plurality of the chambers stores a different dispensable substance or a different storage reservoir 1661.

In certain embodiments, the storage reservoir 1661 is a compressible component or has compressible side walls. In particular embodiments, the compressible component can be composed, at least in part, or coated (e.g., internally) with polyvinyl chloride (PVC), silicone, DEHP (di-2-ethylhexyl phthalate), Tyvek, polyester film, polyolefin, polyethylene, polyurethane, or other materials that inhibit the immune modulator (e.g., any of the immune modulators described herein) from sticking to the reservoir and provide a sterile reservoir environment for the immune modulator. The storage reservoir 1661 can be hermetically sealed. The reservoir compartment 1635 or storage reservoir 1661 can be configured to store the immune modulator (e.g., any of the immune modulators described herein) in quantities in the range of 0.01 mL to 2 mL, such as 0.05 mL to 2 mL, such as 0.05 mL to 2 mL, such as 0.6 mL to 2 mL, such as 0.3 mL to 0.8 mL, such as 0.3 mL to 0.7 mL, such as 0.3 mL to 0.6 mL, such as 0.3 mL to 0.5 mL, such as 0.3 mL to 0.4 mL, or such as 0.4 mL. In some embodiments, the storage reservoir 1661 is attachable to the device housing 1601, for example, in the reservoir compartment. Accordingly, the storage reservoir 1635 can be loaded with the immune modulator (e.g., any of the immune modulators described herein) prior to being positioned in and/or coupled to the ingestible device housing 1601. The ingestible device housing 1601 includes one or more openings configured as a loading port to load the dispensable substance into the reservoir compartment. In another embodiment, the ingestible device housing 1601 includes one or more openings configured as a vent.

In certain embodiments, the ingestible device housing 1601 includes one or more actuation systems (e.g., gas generating cell 1603) for pumping the immune modulator (e.g., any of the immune modulators described herein) from the reservoir 1635. In some embodiments, the actuation system can include a mechanical, electrical, electromechanical, hydraulic, and/or fluid actuation system. For example, a chemical actuation means may use chemical reaction of mixing one or more reagents to generate a sufficient volume of gas to propel the piston or drive element 1634 for drug release. The actuation system can be integrated into the reservoir compartment 1635 or can be an auxiliary system acting on or outside of the reservoir compartment 1635. For example, the actuation system can include pumping system for pushing/pulling the immune modulator (e.g., any of the immune modulators described herein) out of the reservoir compartment 1635 or the actuation system can be configured to cause the reservoir compartment 1635 to change structurally so that the volume inside of the reservoir compartment 1635 changes, thereby dispensing the immune modulator from the reservoir compartment 1635. The actuation system can include an energy storage component such as a battery or a capacitor for powering the actuation system. The actuation system can be actuated via gas pressure or a system storing potential energy, such as energy from an elastic reservoir component being expanded during loading of the reservoir and after being positioned in the ingestible device housing 1601 being subsequently released from the expanded state when the ingestible device housing is at the location for release within the GI tract. In certain embodiments, the reservoir compartment 1635 can include a membrane portion, whereby the immune modulator (e.g., any of the immune modulators described herein) is dispensed from the reservoir compartment 1635 or storage reservoir 1661 via osmotic pressure.

In particular embodiments the storage reservoir 1661 is in a form of a bellow that is configured to be compressed via a pressure from the gas generating cell. The immune modulator may be loaded into the bellow, which may be compressed by gas generation from the gas generating cell or other actuation means to dispense the dispensable substance through the dispensing outlet 1607 and out of the housing 1601. In some embodiments, the ingestible device includes a capillary plate placed between the gas generating cell and the first end of the housing, and a wax seal between the gas generating cell and the reservoir, wherein the wax seal is configured to melt and the dispensable substance is pushed through the capillary plate by a pressure from the gas generating cell. The shape of the bellow may aid in controlled delivery. The reservoir compartment 1635 includes a dispensing outlet, such as a valve or dome slit 1662 extending out of an end of the housing 1601, in accordance with particular implementations. Thus when the bellow is being compressed, the dispensable substance may be propelled out of the bellow through the valve or the dome slit.

In certain embodiments, the reservoir compartment 1635 includes one or more valves (e.g., a valve in the dispensing outlet 1607) that are configured to move or open to fluidly couple the reservoir compartment 1635 to the GI tract. In certain embodiments, a housing wall of the housing 1601 can form a portion of the reservoir compartment 1635. In certain embodiments, the housing walls of the reservoir serve as a gasket. One or more of the one or more valves are positioned in the housing wall of the device housing 1601, in accordance with particular implementations. One or more conduits may extend from the reservoir 1635 to the one or more valves, in certain implementations.

In certain embodiments, a housing wall of the housing 1601 can be formed of a material that is configured to dissolve, for example, in response to contact at the disease site. In certain embodiments, a housing wall of the housing 1601 can be configured to dissolve in response to a chemical reaction or an electrical signal. The one or more valves and/or the signals for causing the housing wall of the housing 1601 to dissolve or dissipate can be controlled by one or more processors or controllers positioned on PCB 1632 in the device housing 1601. The controller is communicably coupled to one or more sensors or detectors configured to determine when the device housing 1601 is proximate to a disease site. The sensors or detectors comprise a plurality of electrodes comprising a coating, in certain implementations. Releasing of the immune modulator (e.g., any of the immune modulators described herein) from the reservoir compartment 1635 is triggered by an electric signal from the electrodes resulting from the interaction of the coating with the one or more sites of disease site. The one or more sensors can include a chemical sensor, an electrical sensor, an optical sensor, an electromagnetic sensor, a light sensor, a gas sensor, and/or a radiofrequency sensor. Methods for detecting volatile organic compounds (VOCs) and other gases from a biological sample include resistive metal oxide gas sensors/mixed metal oxide gas sensors, electrochemical gas sensors, optical/IR gas sensors, conducting polymer/composite polymer resistive/capacitive gas sensors, quartz crystal microbalance gas sensors, carbon nanotubes, and pellister/calorimetric gas sensors. Examples of ingestible gas sensors are described in US Patent Publication No. US20130289368, which published on Oct. 31, 2013, US Patent Publication No. US20170284956, which published on Oct. 5, 2017, and PCT Patent Publication No. WO2016197181, which published on Dec. 15, 2016. Examples of gases that can be detected in the gastrointestinal tract using a sensor include, but are not limited to, oxygen, hydrogen, and carbon dioxide.

In particular embodiments, the device housing 1601 can include one or more pumps configured to pump the therapeutically effective amount of the immune modulator from the reservoir compartment 1635. The pump is communicably coupled to the one or more controllers. The controller is configured to activate the pump in response to detection by the one or more detectors of the disease site and activation of the valves to allow the reservoir 1635 to be in fluid communication with the GI tract. The pump can include a fluid actuated pump, an electrical pump, or a mechanical pump.

In certain embodiments, the device housing 1601 comprises one or more anchor systems for anchoring the device housing 1601 or a portion thereof at a particular location in the GI tract adjacent the disease site. In some embodiments, a storage reservoir comprises an anchor system, and the storage reservoir comprising a releasable substance is anchored to the GI tract. The anchor system can be activated by the controller in response to detection by the one or more detectors of the intended site of release. In certain implementations, the anchor system includes legs or spikes configured to extend from the housing wall(s) of the device housing 1601. The spikes can be configured to retract and/or can be configured to dissolve over time. An example of an attachable device that becomes fixed to the interior surface of the GI tract is described in PCT Patent Application PCT/US2015/012209, "Gastrointestinal Sensor Implantation System," filed Jan. 21, 2015, which is hereby incorporated by reference herein in its entirety.

Figure 20:
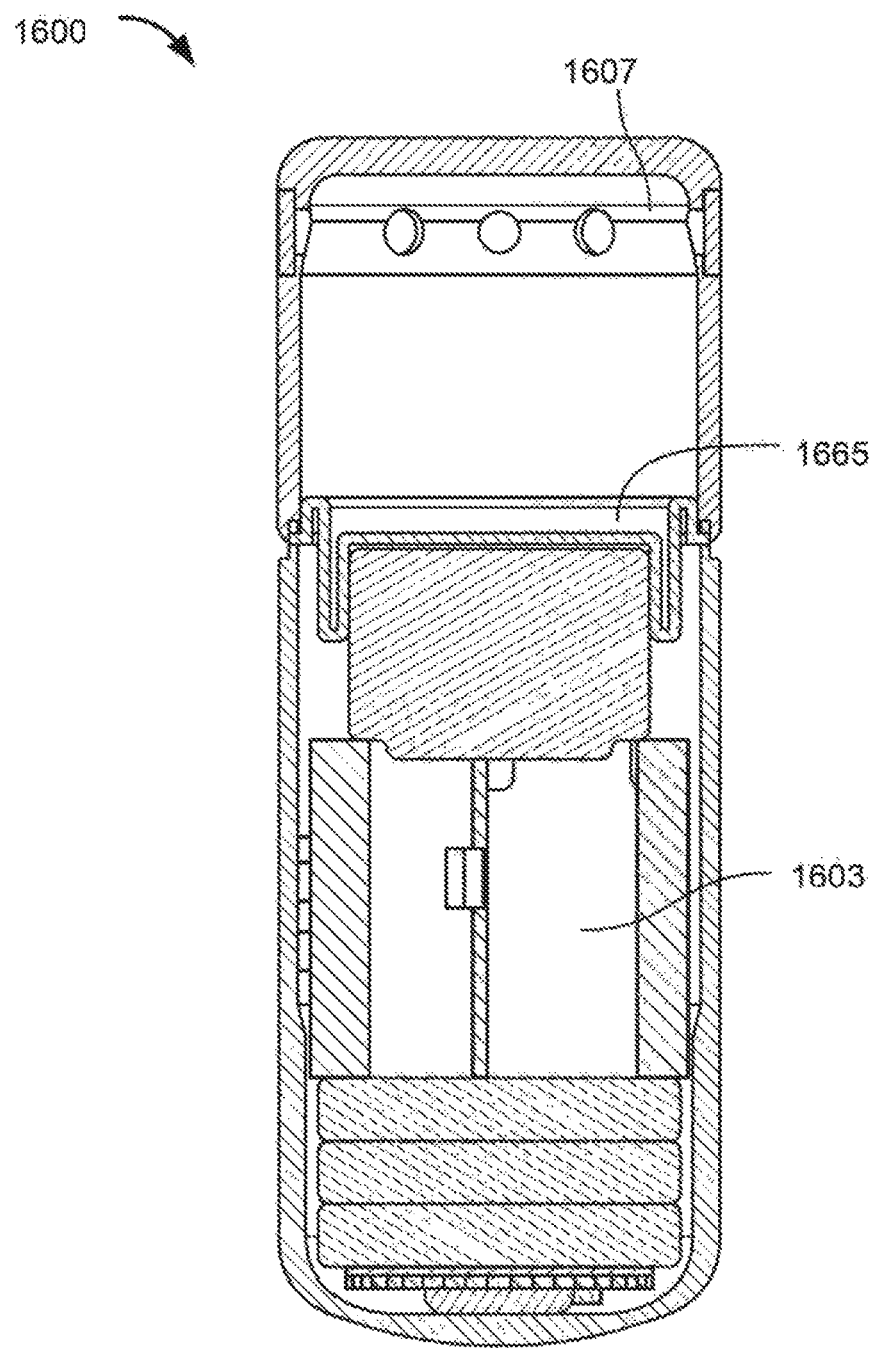
FIG. 20 illustrates an ingestible device having a flexible diaphragm to deform for drug delivery.

FIG. 20 provides an example structural diagram having a flexible diaphragm 1665 that may deform towards the dispensing outlet 1607 when the gas generating cell 1603 generates gas. The dispensable substance may then be propelled by the deformed diaphragm out of the housing through the dispensing outlet 1607. The dispensing outlet 1607 shown at FIG. 20 is in the form of a ring valve, however, any outlet design can be applied.

In some embodiments, an ingestible device can have an umbrella-shaped exit valve structure as a dispensing outlet of the ingestible device. Optionally, an ingestible device can have a flexible diaphragm to deform for drug delivery, and/or an integrated piston and gas generating cell such that the gas generating cell is movable with the piston to push for drug delivery.

In certain embodiments, an ingestible device can be anchored within the intestine by extending hooks from the ingestible device after it has entered the region of interest. For example, when the ingestible device determines it has arrived at a location within the GI tract, the hooks can be actuated to extend outside of the ingestible device to catch in the intestinal wall and hold the ingestible device in the respective location. In some embodiments, the hook can pierce into the intestinal wall to hold the ingestible device 100 in place. The hooks can be hollow. A hollow hook can be used to anchor the ingestible device and/or to dispense a substance from the dispensable substance, e.g., into the intestinal wall.

In some embodiments an ingestible device includes an intestinal gripper to grip a portion of the intestinal wall for delivering the dispensable substance. Such a gripper can include two or more arms configured to out of the device and close to grip a portion of the intestinal wall.

An injecting needle can be used with the anchoring arms to inject dispensable substance into the intestinal wall after a portion of the intestinal wall is gripped.

In some embodiments, when the gas generating cell generates gas to propel the piston to move towards the nozzle such that the dispensable substance can be pushed under the pressure to break a burst disc to be injected via the nozzle.

In some embodiments, an ingestible device has a jet delivery mechanism with enhanced usable volume of dispensable substance. For example, the nozzle may be placed at the center of the ingestible device, and gas channels may be placed longitudinally along the wall of the ingestible device to transport gas from the gas generating cell to propel the piston, which is placed at an end of the ingestible device.

In some embodiments, the ingestible device can use osmotic pressure to adhere a suction device of the ingestible device to the intestinal wall. For example, the ingestible device may have an osmotic mechanism that has a chamber storing salt crystals. The chamber can include a mesh placed in proximate to a burst valve at one end of the chamber, and a reverse osmosis (RO) membrane placed in proximate to a valve on the other end of the chamber. A suction device, e.g., two or more suction fingers, is placed outside of the chamber with an open outlet exposed to luminal fluid in the GI tract. When the osmotic mechanism is inactivated, e.g., the valve is closed so that no luminal fluid is drawn into the osmotic chamber. When the osmotic mechanism is activated by opening the valve, luminal fluid enters the ingestible device through an outlet of the suction device and enters the osmotic chamber through the valve. The salt in the chamber is then dissolved into the fluid. The RO membrane prevents any fluid to flow in the reverse direction, e.g., from inside the chamber to the valve. The fluid continues to flow until all the salt contained in the chamber is dissolved or until intestinal tissue is drawn into the suction device. As luminal fluid keeps flowing into the chamber, the solution of the luminal fluid with dissolved salt in the chamber may reduce osmotic pressure such that the suction force at may also be reduced. In this way, suction of the intestinal tissue may stall before the tissue is in contact with the valve to avoid damage to the intestinal tissue.

An ingestible device employing an osmotic mechanism can also include a suction device as illustrated. The suction device can be two or more suction fingers 347*a-b* disposed proximate to the outlet. The outlet can be connected to a storage reservoir storing the dispensable substance (e.g., therapeutic agent). The storage reservoir can contact a piston (similar to 104 in FIG. 16), which can be propelled by pressure generated from the osmotic pump to move towards the outlet. The osmotic pump can be similar to the osmotic mechanism described in the preceding paragraph. A breakaway section can be placed in proximate to the other end (opposite to the end where the outlet 107 is disposed) of the ingestible device.

In some embodiments, tumbling suction by an ingestible device is used. Such an ingestible device does not require any electronics or other actuation elements. Such an ingestible device may constantly, intermittently, or periodically tumble when travelling through the intestine. When the ingestible device tumbles to a position that the outlet is in direct contact with the intestinal wall, a suction process similar to that described in the preceding paragraph may occur. Additional structural elements such as fins, flutes or the like may be added to the outer wall of the ingestible device 100 to promote the tumbling motion.

In certain embodiments, the reservoir is an anchorable reservoir, which is a reservoir comprising one or more anchor systems for anchoring the reservoir at a particular location in the GI tract adjacent to the intended site of delivery of the immune modulator. In certain embodiments, the anchor system includes legs or spikes or other securing means such as a piercing element, a gripping element, a magnetic-flux-guiding element, or an adhesive material, configured to extend from the anchorable reservoir of the device housing. The spikes can be configured to retract and/or can be configured to dissolve over time. In some embodiments, the anchorable reservoir is suitable for localizing, positioning and/or anchoring. In some embodiments, the anchorable reservoir is suitable for localizing, and positioning and/or anchoring by an endoscope. In some embodiments, the anchorable reservoir is connected to the endoscope. In some embodiments, the anchorable reservoir is connected to the endoscope in a manner suitable for oral administration. In some embodiments, the anchorable reservoir is connected to the endoscope in a manner suitable for rectal administration. Accordingly, provided herein in some embodiments is an anchorable reservoir is connected to an endoscope wherein the anchorable reservoir comprises a therapeutically effective amount of any of the agents described herein. In some embodiments the endoscope is fitted with a spray catheter.

Exemplary embodiments of anchorable reservoirs are as follows. In more particular examples of the following exemplary embodiments the reservoir is connected to an endoscope.

In one embodiment, the anchorable reservoir comprises an implant capsule for insertion into a body canal to apply radiation treatment to a selected portion of the body canal. The reservoir includes a body member defining at least one therapeutic treatment material receiving chamber and at least one resilient arm member associated with the body member for removably engaging the body canal when the device is positioned therein.

In one embodiment the anchorable reservoir has multiple suction ports and permits multiple folds of tissue to be captured in the suction ports with a single positioning of the device and attached together by a tissue securement mechanism such as a suture, staple or other form of tissue bonding. The suction ports may be arranged in a variety of configurations on the reservoir to best suit the desired resulting tissue orientation.

In some embodiments an anchorable reservoir comprises a tract stimulator and/or monitor IMD comprising a housing enclosing electrical stimulation and/or monitoring circuitry and a power source and an elongated flexible member extending from the housing to an active fixation mechanism adapted to be fixed into the GI tract wall is disclosed. After fixation is effected, the elongated flexible member bends into a preformed shape that presses the housing against the mucosa so that forces that would tend to dislodge the fixation mechanism are minimized. The IMD is fitted into an esophageal catheter lumen with the fixation mechanism aimed toward the catheter distal end opening whereby the bend in the flexible member is straightened. The catheter body is inserted through the esophagus into the GI tract cavity to direct the catheter distal end to the site of implantation and fix the fixation mechanism to the GI tract wall. The IMD is ejected from the lumen, and the flexible member assumes its bent configuration and lodges the hermetically sealed housing against the mucosa. A first stimulation/sense electrode is preferably an exposed conductive portion of the housing that is aligned with the bend of the flexible member so that it is pressed against the mucosa. A second stimulation/sense electrode is located at the fixation site.

In some embodiments a reservoir for sensing one or more parameters of a patient is anchored to a tissue at a specific site and is released from a device, using a single actuator operated during a single motion. As an example, a delivery device may anchor the capsule to the tissue site and release the reservoir from the delivery device during a single motion of the actuator.

In some embodiments a device is provided comprising: a reservoir configured to contain a fluid, the reservoir having at least one outlet through which the fluid may exit the reservoir; a fluid contained within the reservoir; a primary material contained within the reservoir and having a controllable effective concentration in the fluid; and at least one electromagnetically responsive control element located in the reservoir or in a wall of the reservoir and adapted for modifying the distribution of the primary material between a first active form carried in the fluid and a second form within the reservoir in response to an incident electromagnetic control signal, the effective concentration being the concentration of the first active form in the fluid, whereby fluid exiting the reservoir carries the primary material in the first active form at the effective concentration.

In some embodiments systems and methods are provided for implementing or deploying medical or veterinary devices or reservoirs (a) operable for anchoring at least partly within a digestive tract, (b) small enough to pass through the tract per vias naturales and including a wireless-control component, (c) having one or more protrusions positionable adjacent to a mucous membrane, (d) configured to facilitate redundant modes of anchoring, (e) facilitating a "primary" material supply deployable within a stomach for an extended and/or controllable period, (f) anchored by one or more adaptable extender modules supported by a subject's head or neck, and/or (g) configured to facilitate supporting at least a sensor within a subject's body lumen for up to a day or more.

In certain embodiments, the reservoir is attachable to an ingestible device. In certain embodiments, the ingestible device comprises a housing and the reservoir is attachable to the housing. In certain embodiments, the attachable reservoir is also an anchorable reservoir, such as an anchorable reservoir comprising one or more anchor systems for anchoring the reservoir at a particular location in the GI tract as disclosed hereinabove.

Accordingly, in certain embodiments, provided herein is an immune modulator (e.g., any of the immune modulators described herein) for use in a method of treating an inflammatory disease or condition that arises in a tissue originating from the endoderm as disclosed herein, wherein the immune modulator is contained in a reservoir suitable for attachment to a device housing, and wherein the method comprises attaching the reservoir to the device housing to form the ingestible device, prior to orally administering the ingestible device to the subject.

In certain embodiments, provided herein is an attachable reservoir containing an immune modulator (e.g., any of the immune modulators described herein) for use in a method of treating an inflammatory disease or condition that arises in a tissue originating from the endoderm, wherein the method comprises attaching the reservoir to a device housing to form an ingestible device and orally administering the ingestible device to a subject, wherein the immune modulator is released by device at a location in the gastrointestinal tract of the subject that is proximate to the intended site of release of the immune modulator.

In certain embodiments, provided herein is an attachable reservoir containing an immune modulator, wherein the reservoir is attachable to a device housing to form an ingestible device that is suitable for oral administration to a subject and that is capable of releasing the immune modulator at a location in the gastrointestinal tract of the subject that is proximate to the intended site of release.

In particular implementation the ingestible device includes cameras (e.g., video cameras) that affords inspection of the entire GI tract without discomfort or the need for sedation, thus avoiding many of the potential risks of conventional endoscopy. Video imaging can be used to help determine one or more characteristics of the GI tract. In some embodiments, the ingestible device 101 may comprise a camera for generating video imaging data of the GI tract which can be used to determine, among other things, the location of the device. Examples of video imaging capsules include Medtronic's PillCam™, Olympus' Endocapsule®, and IntroMedic's MicroCam™. For a review of imaging capsules, see Basar et al. "Ingestible Wireless Capsule Technology: A Review of Development and Future Indication" International Journal of Antennas and Propagation (2012); 1-14). Other imaging technologies implemented with the device 101 can include thermal imaging cameras, and those that employ ultrasound or Doppler principles to generate different images (see Chinese patent application CN104473611: "Capsule endoscope system having ultrasonic positioning function."

Ingestible devices can be equipped with sources for generating reflected light, including light in the Ultraviolet, Visible, Near-infrared and/or Mid-infrared spectrum, and the corresponding detectors for spectroscopy and hyperspectral imaging. Likewise, autofluorescense may be used to characterize GI tissue (e.g., subsurface vessel information), or low-dose radiation (see Check-Cap™) can be used to obtain 3D reconstructed images.

Device Components

An ingestible device in accordance with particular embodiments of the present disclosure may comprise a component made of a non-digestible material and contain the immune modulator (e.g., any of the immune modulators described herein). In some embodiments, the material is plastic.

It is envisaged that the device is single-use. The device is loaded with a drug prior to the time of administration. In some embodiments, it may be preferred that there is provided a medicinal product comprising the device pre-filled with the drug.

Anchoring Components

Several systems may actively actuate and control the capsule position and orientation in different sections of the GI tract. Examples include leg-like or anchor-like mechanisms that can be deployed by an ingestible device to resist peristaltic forces in narrowed sections of the GI tract, such as the intestine, and anchor the device to a location. Other systems employ magnetic shields of different shapes that can interact with external magnetic fields to move the device. These mechanisms may be particularly useful in areas outside of the small intestine, like the cecum and large intestine.

An anchoring mechanism may be a mechanical mechanism. For example, a device may be a capsule comprising a plurality of legs configured to steer the capsule. The number of legs in the capsule may be, for example, two, four, six, eight, ten or twelve. The aperture between the legs of the device may be up to about 35 mm; about 30 to about 35 mm; about 35 to about 75 mm; or about 70 to about 75 mm. The contact area of each leg may be varied to reduce impact on the tissue. One or more motors in the capsule may each actuate a set of legs independently from the other. The motors may be battery-powered motors.

An anchoring mechanism may be a non-mechanical mechanism. For example, a device may be a capsule comprising a permanent magnet located inside the capsule. The capsule may be anchored at the desired location of the GI tract by an external magnetic field.

An anchoring mechanism may comprise a non-mechanical mechanism and a mechanical mechanism. For example, a device may be a capsule comprising one or more legs, one or more of which are coated with an adhesive material.

Locomotion Components

Ingestible devices can be active or passive, depending on whether they have controlled or non-controlled locomotion. Passive (non-controlled) locomotion is more commonly used among ingestible devices given the challenges of implementing a locomotion module. Active (controlled) locomotion is more common in endoscopic ingestible capsules. For example, a capsule may comprise a miniaturized locomotion system (internal locomotion). Internal locomotion mechanisms may employ independent miniaturized propellers actuated by DC brushed motors, or the use of water jets. As an example, a mechanism may comprise flagellar or flap-based swimming mechanisms. As an example, a mechanism may comprise cyclic compression/extension shape-memory alloy (SMA) spring actuators and anchoring systems based on directional micro-needles. As an example, a mechanism may comprise six SMA actuated units, each provided with two SMA actuators for enabling bidirectional motion. As an example, a mechanism may comprise a motor adapted to electrically stimulating the GI muscles to generate a temporary restriction in the bowel.

As an example, a capsule may comprise a magnet and motion of the capsule is caused by an external magnetic field. For example, a locomotion system may comprise an ingestible capsule and an external magnetic field source. For example, the system may comprise an ingestible capsule and magnetic guidance equipment such as, for example, magnetic resonance imaging and computer tomography, coupled to a dedicated control interface.

In some embodiments drug release mechanisms may also be triggered by an external condition, such as temperature, pH, movement, acoustics, or combinations thereof.

Sampling Components

Ingestible devices may comprise a mechanism adapted to permit the collection of tissue samples. In some examples, this is achieved using electro-mechanical solutions to collect and store the sample inside an ingestible device. As an example, a biopsy mechanism may include a rotational tissue cutting razor fixed to a torsional spring or the use of microgrippers to fold and collect small biopsies. As an example, Over-the-scope clips (OTSC®) may be used to perform endoscopic surgery and/or biopsy. As an example of the methods disclosed herein, the method may comprise releasing an immune modulator (e.g., any of the immune modulators described herein) and collecting a sample inside the device. As an example, the method may comprise releasing an immune modulator and collecting a sample inside the device in a single procedure.

Figure 21:
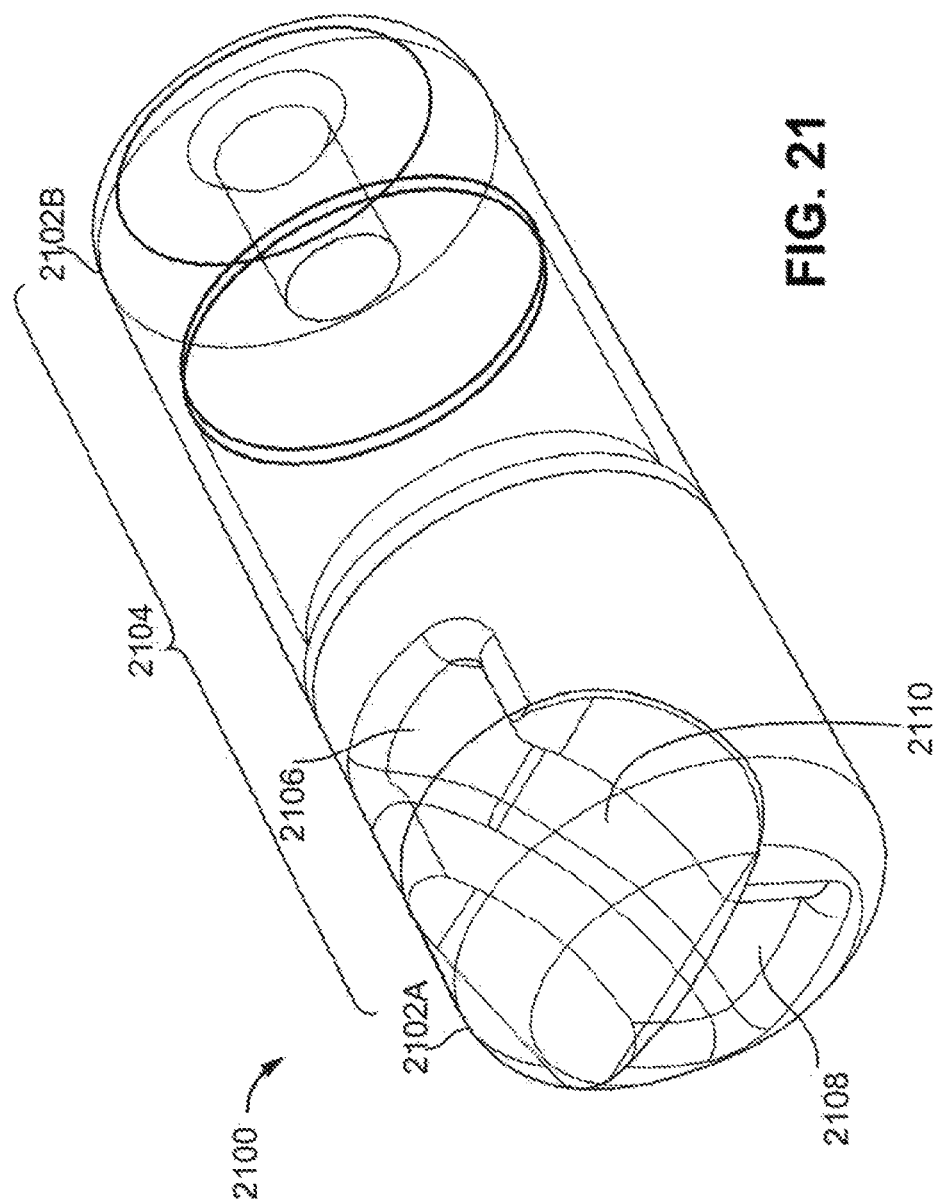
FIG. 21 shows an illustrative embodiment of an ingestible device with multiple openings in the housing.

FIG. 21 illustrates an example ingestible device 2100 with multiple openings in the housing. The ingestible device 2100 has an outer housing with a first end 2102A, a second end 2102B, and a wall 2104 extending longitudinally from the first end 2102A to the second end 2102B. Ingestible device 2100 has a first opening 2106 in the housing, which is connected to a second opening 2108 in the housing. The first opening 2106 of the ingestible device 2100 is oriented substantially perpendicular to the second opening 2108, and the connection between the first opening 2106 and the second opening 2108 forms a curved chamber 2110 within the ingestible device 2100.

The overall shape of the ingestible device 2100, or any of the other ingestible devices discussed in this disclosure, may be similar to an elongated pill or capsule.

In some embodiments, a portion of the curved chamber 2110 may be used as a sampling chamber, which may hold samples obtained from the GI tract. In some embodiments the curved chamber 2110 is subdivided into sub-chambers, each of which may be separated by a series of one or more valves or interlocks.

In some embodiments, the first opening 2106, the second opening 2108, or the curved chamber 2110 include one or more of a hydrophilic or hydrophobic material, a sponge, a valve, or an air permeable membrane.

The use of a hydrophilic material or sponge may allow samples to be retained within the curved chamber 2110, and may reduce the amount of pressure needed for fluid to enter through the first opening 2106 and dislodge air or gas in the curved chamber 2110. Examples of hydrophilic materials that may be incorporated into the ingestible device 2100 include hydrophilic polymers such as polyvinyl alcohol, polyvinyl pyrrolidone, and the like. Similarly, materials that have undergone various types of treatments, such as plasma treatments, may have suitable hydrophilic properties, and may be incorporated into the investible device 2100. Sponges may be made of any suitable material or combination of materials, such as fibers of cotton, rayon, glass, polyester, polyethylene, polyurethane, and the like. Sponges generally may be made from commercially available materials, such as those produced by Porex®.

As discussed in more detail below, in some embodiments, the sponges may be treated in order to change their absorbency or to help preserve samples.

In some embodiments, the sponges may be cut or abraded to change their absorbency or other physical properties.

Hydrophobic materials located near the second opening 2108 may repel liquids, discouraging liquid samples from entering or exiting the curved chamber 2110 through the second opening 2108. This may serve a similar function as an air permeable membrane. Examples of hydrophobic materials which may be incorporated into the ingestible device 2100 include polycarbonate, acrylics, fluorocarbons, styrenes, certain forms of vinyl, and the like.

The various materials listed above are provided as examples, and are not limiting. In practice, any type of suitable hydrophilic, hydrophobic, or sample preserving material may be used in the ingestible device 2100.

In some embodiments, an ingestible device includes a moveable valve as a diaphragm valve, which uses a mechanical actuator to move a flexible diaphragm in order to seal or unseal an aperture in a second portion of an inlet region, which may effectively block or unblock the inlet region. However, it will be understood that, in some embodiments, the moveable valve may be a different type of valve. For example, in some embodiments the moveable valve may be replaced by a pumping mechanism. As another example, in some embodiments the moveable valve is replaced with an osmotic valve A sampling chamber of an ingestible device can have an exit port to allow air or gas to exit the sampling chamber, while preventing at least a portion of the sample obtained by the ingestible device from exiting the sampling chamber. For example, the exit port may include a gas-permeable membrane. An ingestible device can include one-way valve as part of its exit port.

An ingestible device can include an outlet port connected to the volume within housing of the ingestible device. The outlet port may provide a path for the gas to exit the ingestible device and be released into the environment surrounding the ingestible device. This may prevent pressure from building up within the housing of the ingestible device. In some embodiments, an ingestible device does not include an outlet port, and the gas stays inside the volume of the ingestible device. In some embodiments, the outlet port may contain a gas permeable membrane, a one-way valve, a hydrophobic channel, or some other mechanism to avoid unwanted material, (e.g., fluids and solid particulates from within the GI tract), from entering the ingestible device through the outlet port.

In some embodiments, the ingestible device may include a sensor within or proximate to the sampling chamber. For example, this sensor may be used to detect various properties of a sample contained within the sampling chamber, or this sensor may be used to detect the results of an assay technique applied to the sample contained within the sampling chamber.

In some embodiments, a hydrophilic sponge is located within the sampling chamber, and the hydrophilic sponge may be configured to absorb the sample as the sample enters the sampling chamber. In some embodiments, the hydrophilic sponge fills a substantial portion of the sampling chamber, and holds the sample for an extended period of time. This may be particularly advantageous if the sample is collected from the ingestible device after the ingestible device exits the body. In some embodiments, the hydrophilic sponge is placed on only certain surfaces or fills only certain portions of the sampling chamber. For example, it may be possible to line certain walls (or all walls) of the sampling chamber with a hydrophilic sponge to assist in drawing in the sample, while leaving some (or none) of the walls of the sampling chamber uncovered. Leaving walls uncovered may allow the use of diagnostics or assay techniques that require a relatively un-obscured optical path.

In some embodiments, the ingestible device may include a sealed vacuum chamber connected to the exit port, or connected directly or indirectly to the sampling chamber. In some embodiments a pin valve may be used as a moveable valve (e.g., as moveable valve of ingestible device). In certain embodiments, a rotary valve may be used as a moveable valve (e.g., as moveable valve of ingestible device). In some embodiments, a flexible diaphragm, or diaphragm valve, may be used as a moveable valve (e.g., as moveable valve of ingestible device). In certain embodiments, a mechanism is near the diaphragm or in direct contact with the diaphragm. The spring mechanism may apply pressure to the diaphragm to oppose the pressure applied by the mechanical actuator, which may cause the flexible diaphragm to be moved into an open position when the mechanical actuator is not applying pressure to the flexible diaphragm. Additionally, this may ensure that the diaphragm valve remains open when the mechanical actuator is not applying pressure across the flexible diaphragm. In some embodiments, moving the mechanical actuator from a closed position to an open position causes a volume of the inlet region within the ingestible device to increase. This may cause the pressure within the inlet region to be reduced, generating suction to draw a sample into the inlet region.

Similarly, moving the mechanical actuator from an open position to a closed position may cause the volume of the inlet region to be reduced. This may cause the pressure within the inlet region to be increased, pushing the sample out of the inlet region. Depending on the design of the inlet region, the mechanical actuator, and the moveable valve, this may push the sample into the sampling chamber rather than pushing the sample back through the opening in the ingestible device.

Figure 22:
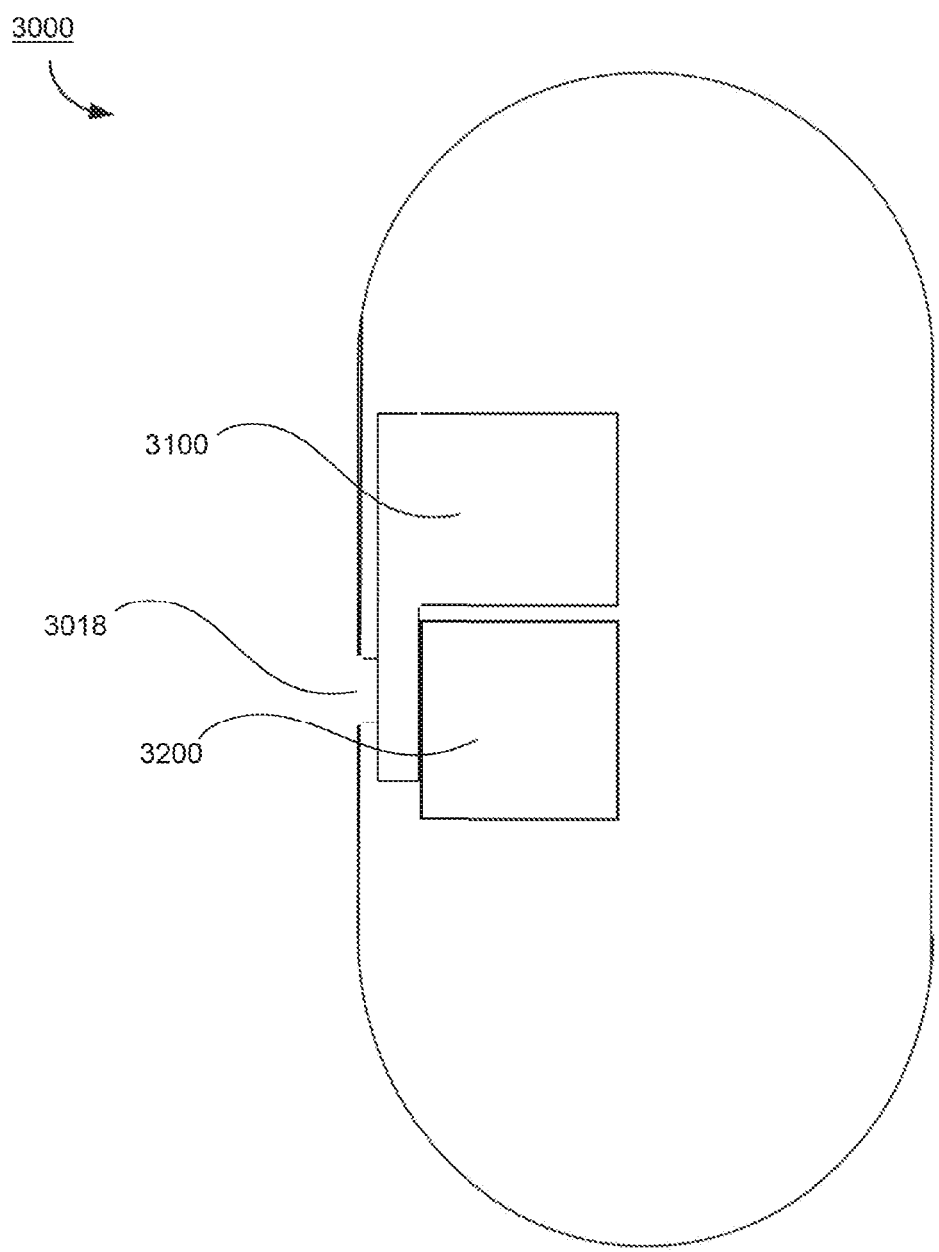
FIG. 22 shows a highly cross-section of an ingestible device including a valve system and a sampling system.

FIG. 22 depicts a cross-sectional view of a portion of the interior of ingestible device 3000. As shown in FIG. 22, the interior of ingestible device 3000 includes a valve system 3100 and a sampling system 3200. Valve system 3100 is depicted as having a portion that is flush with the opening 3018 so that valve system 3100 prevents fluid exterior to ingestible device 2000 from entering sampling system 3200. However, as described in more detail below with reference to FIGS. 22-27, valve system 3100 can change position so that valve system 3100 allows fluid exterior to ingestible device 3000 to enter sampling system 3200.

Figure 27:
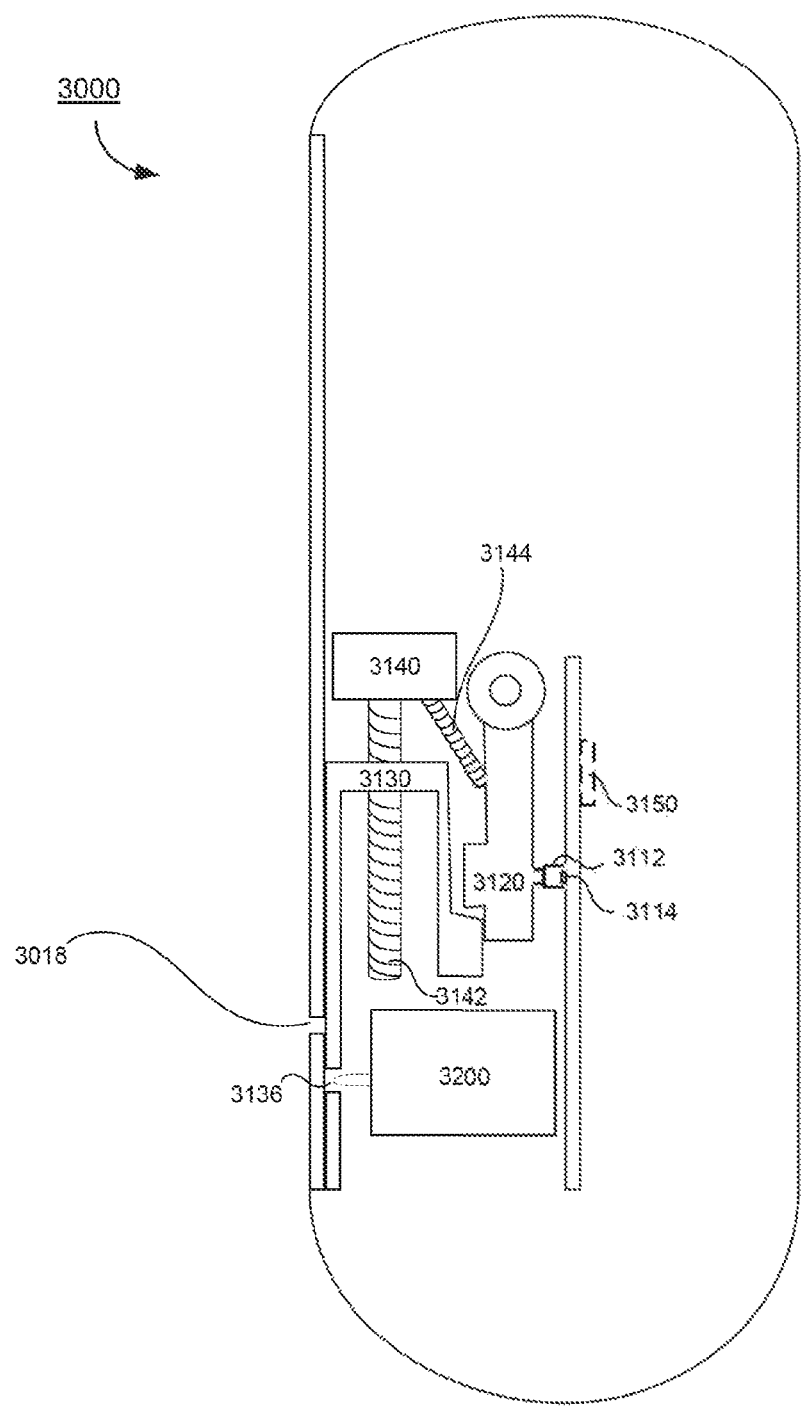
FIG. 27 illustrates a more detailed view of an ingestible device including a valve system and a sampling system.

FIGS. 23 and 27 illustrate valve system 3100 in more detail. As shown in FIG. 23, valve system 3100 includes an actuation mechanism 3110, a trigger 3120, and a gate 3130. In FIGS. 23 and 7, a leg 3132 of gate 3130 is flush against, and parallel with, housing wall 3016 so that gate leg 3132 covers opening 3018 to prevent fluid exterior to ingestible device 3000 (e.g., fluid in the GI tract) from entering the interior of ingestible device 3000. A protrusion 3134 of gate 3130 engages a lip 3122 of trigger 3120. A peg 3124 of trigger 3120 engages a wax pot 3112 of actuation mechanism 3110. Referring to FIG. 27, a biasing mechanism 3140 includes a compression spring 3142 that applies an upward force on gate 3130. Biasing mechanism 3140 also includes a torsion spring 3144 that applies a force on trigger 3120 in the counter-clockwise direction. In FIGS. 23 and 27, the force applied by torsion spring 3144 is counter-acted by the solid wax in pot 3112, and the force applied by compression spring 3142 is counter-acted by lip 3122.

FIG. 24A and FIG. 24B show an embodiment of the manner in which actuation mechanism 3110 actuates movement of trigger 3120. Similar to FIGS. 23 and 27, FIG. 24A shows a configuration in which peg 3124 applies a force against solid wax pot 3112 due to torsion spring 3144, and in which the solid nature of wax pot 3112 resists the force applied by peg 3124. A control unit 3150 is in signal communication with valve system 3100. During use of ingestible device 3000, a control unit 3150 receives a signal, indicating that the position of valve system 3100 should change, e.g., so that ingestible device 3000 can take a sample of a fluid in the GI tract. Control unit 3150 sends a signal that causes a heating system 3114 of actuation system 3100 to heat the wax in pot 3112 so that the wax melts. As shown in FIG. 24B, the melted wax is not able to resist the force applied by peg 3124 so that, under the force of torsion spring 3144, trigger 3120 moves in a counter-clockwise fashion.

Figure 25A:
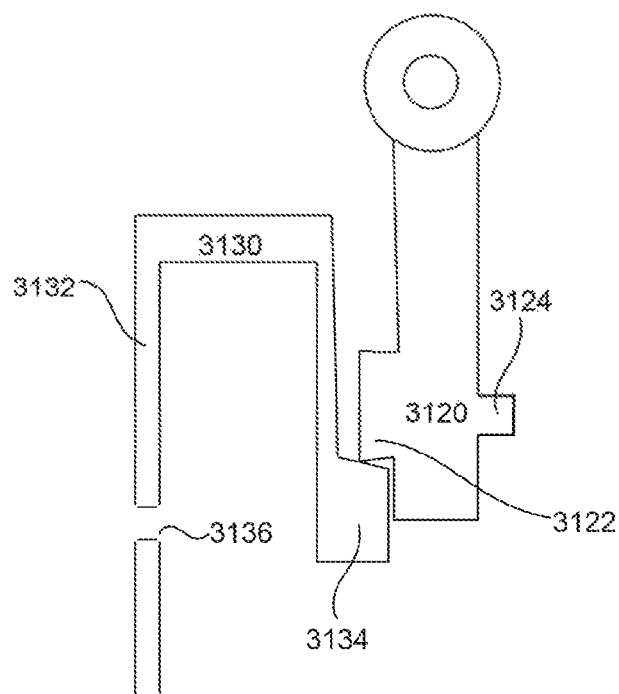
FIGS. 25A and 25B illustrate a portion of a two-stage valve system in its first and second stages, respectively.
Figure 25B:
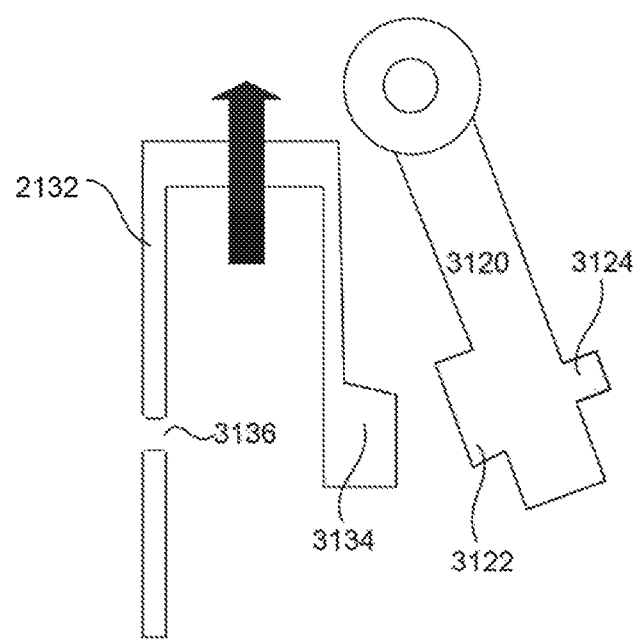

FIGS. 25A and 25B illustrate the interaction of trigger 3120 and gate 3130 before and after actuation. As shown in FIG. 25A, when wax pot 3112 is solid (corresponding to the configuration shown in FIG. 24A), protrusion 3134 engages lip 3122, which prevents the force of compression spring 3142 from moving gate 3130 upward. As shown in FIG. 25B, when the wax in pot 3112 melts (FIG. 24B), trigger 3120 moves counter-clockwise, and lip 3122 disengages from protrusion 3134. This allows the force of compression spring 3142 to move gate 3130 upward. As seen by comparing FIG. 25A to FIG. 25B, the upward movement of gate 3130 results in an upward movement of an opening 3136 in gate leg 3132.

Figures 26A, 26B:
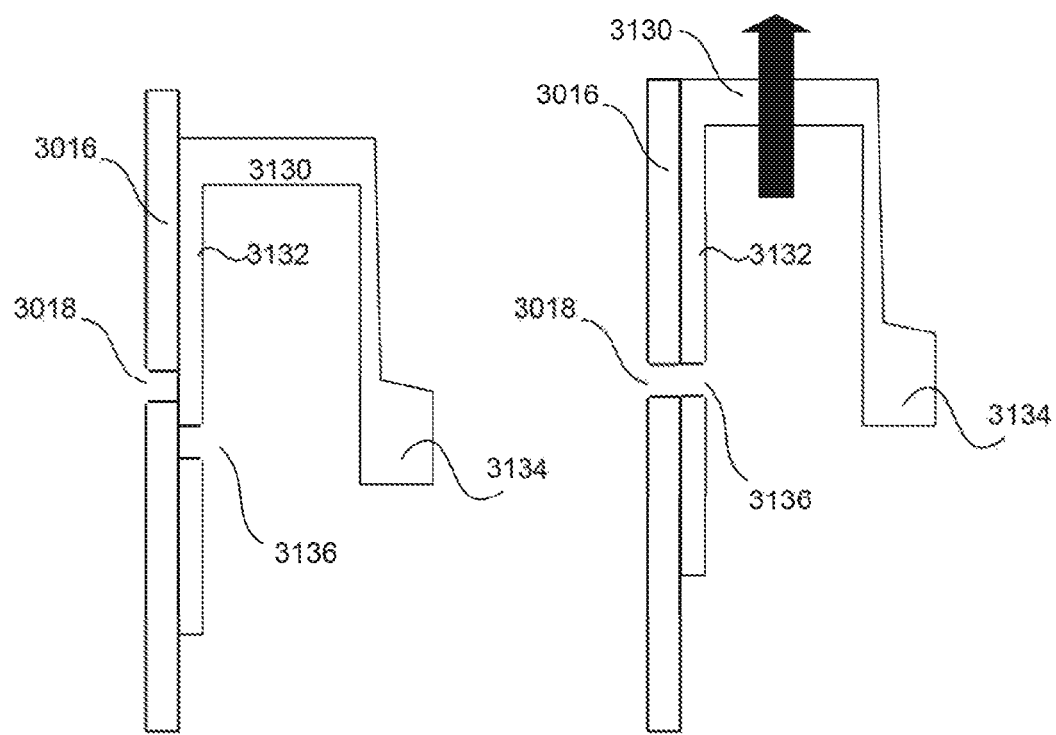
FIGS. 26A and 26B illustrate a portion of a two-stage valve system in its first and second stages, respectively.

FIGS. 26A and 26B illustrate the impact of the upward movement of opening 3136 on the ability of ingestible device 3000 to obtain a sample. As shown in FIG. 26A, when the wax in pot 3112 is solid (FIGS. 24A and 25A), opening 3136 in is not aligned with opening 3018 in wall 3016 of ingestible device 3000. Instead, gate leg 3132 covers opening 3018 and blocks fluid from entering the interior of ingestible device 3000. As shown in FIG. 26B, when the wax in pot 3112 is melted and trigger 3120 and gate 3130 have moved (FIGS. 24B and 42B), opening 3136 in gate 3130 is aligned with opening 3018 in wall 3016. In this configuration, fluid that is exterior to ingestible device 3000 (e.g., in the GI tract) can enter the interior of ingestible device 3000 via openings 3018 and 3036.

FIG. 27 illustrates a more detailed view of ingestible device 3000 including valve system 3100 and sampling system 3200.

While the foregoing description is made with regard to a valve system having one open position and one closed position (e.g., a two-stage valve system), the disclosure is not limited in this sense. Rather, the concepts described above with regard to a two stage valve system can be implemented with a valve system have more than two stages (e.g., three stages, four stages, five stages, etc.).

Figure 28:
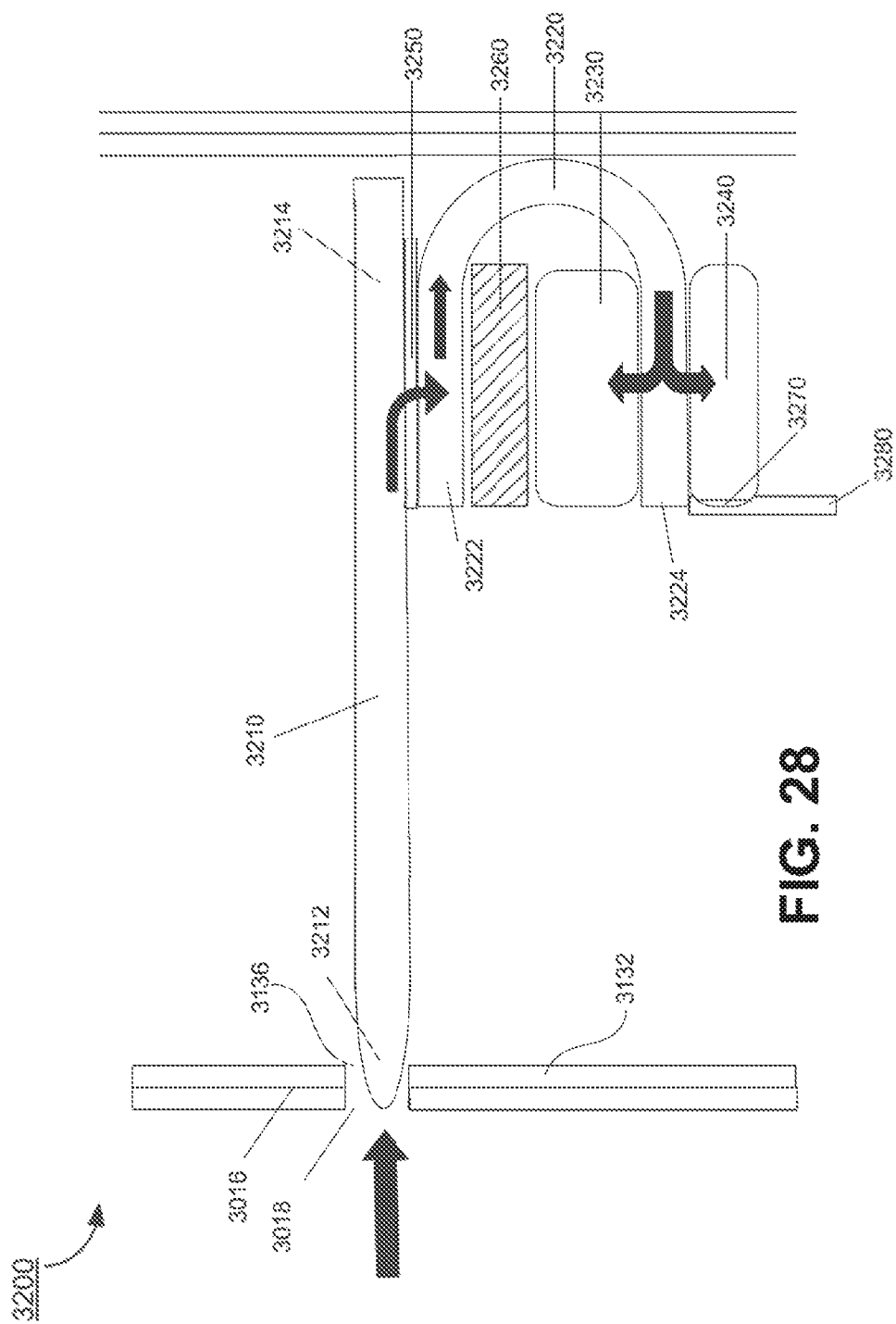
FIG. 28 illustrates a portion of an ingestible device including a sampling system and a two-stage valve system in its second stage.

As noted above in addition to a valve system, an ingestible device includes a sampling system. FIG. 28 illustrates a partial cross sectional view of ingestible device 3000 with sampling system 3200 and certain components of valve system 3100. Sampling system 3200 includes a series of sponges configured to absorb fluid from an opening, move the fluid to a location within the housing, and prepare the fluid for testing. Preparation for testing may include filtering the fluid and combining the fluid with a chemical assay. The assay may be configured to dye cells in the filtered sample. The series of sponges includes a wicking sponge 3210, a transfer sponge 3220, a volume sponge 3230, and an assay sponge 3240. Sampling system 3200 also includes a membrane 3270 located between assay sponge 3240 and a vent 3280 for gases to leave sampling system 3200. A cell filter 3250 is located between distal end 3214 of wicking sponge 3210 and a first end 3222 of transfer sponge 3220. Membrane 3270 is configured to allow one or more gases to leave sampling system 3200 via an opening 3280, while maintaining liquid in sampling system 3200.

Figure 29:
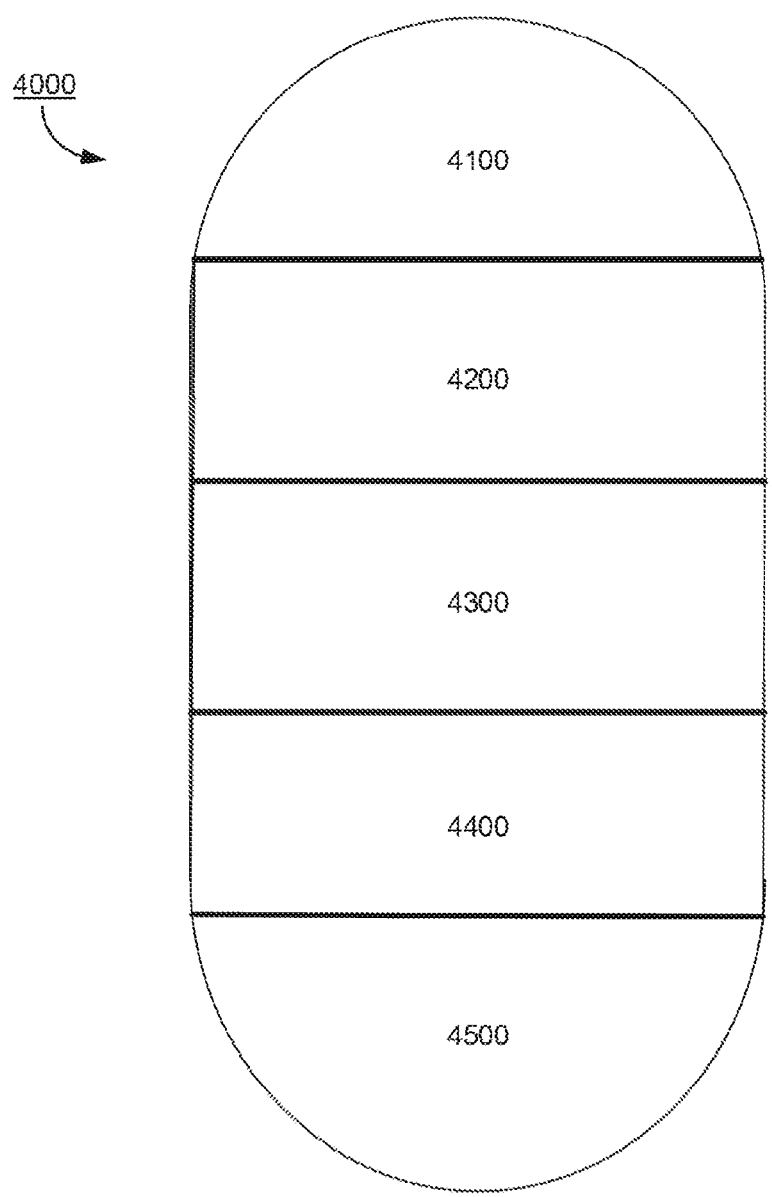
FIG. 29 is a highly schematic illustrate of an ingestible device.

FIG. 29 is a highly schematic illustration of an ingestible device 4000 that contains multiple different systems that cooperate for obtaining a sample and analyzing a sample, e.g., within the GI tract of a subject. Ingestible device 4000 includes a power system 4100 (e.g., one or more batteries), configured to power an electronics system 4200 (e.g., including a control system, optionally in signal communication with an external base station), a valve system 4300, a sampling system 4400, and an analytic system 4500. Exemplary analytical systems include assay systems, such as, for example, optical systems containing one or more sources of radiation and/or one more detectors.

Some or all of the sponges of the above-described sampling systems may contain one or more preservatives (see discussion above). Typically, the assay sponge and/or the volume sponge 3230 and/or the transfer sponge contain one or more preservatives. Typically, the preservative(s) are selected based on the analyte of interest, e.g., an analyte (such as a protein biomarker) for a GI disorder.

Communication Systems

An ingestible device may be equipped with a communication system adapted to transmit and/or receive data, including imaging and/or localization data. As an example, a communication system may employ radiofrequency transmission. Ingestible devices using radiofrequency communication are attractive because of their efficient transmission through the layers of the skin. This is especially true for low frequency transmission (UHF-433 ISM and lower, including the Medical Device Radio Communication Service band (MDRS) band 402-406 MHz). In another embodiment, acoustics are used for communications, including the transmission of data. For example, an ingestible capsule may be able to transmit information by applying one or more base voltages to an electromechanical transducer or piezoelectric (e.g., PZT, PVDF, etc.) device to cause the piezoelectric device to ring at particular frequencies, resulting in an acoustic transmission. A multi-sensor array for receiving the acoustic transmission may include a plurality of acoustic transducers that receive the acoustic transmission from a movable device such as an ingestible capsule as described in U.S. patent application Ser. No. 11/851,214 filed Sep. 6, 2007, incorporated by reference herein in its entirety.

As an example, a communication system may employ human body communication technology. Human body communication technology uses the human body as a conductive medium, which generally requires a large number of sensor electrodes on the skin. As an example, a communication system may integrate a data storage system.

Environmental Sensors

In some embodiments the device may comprise environmental sensors to measure pH, temperature, transit times, or combinations thereof. Other examples of environmental sensors include, but are not limited to a capacitance sensor, an impedance sensor, a heart rate sensor, acoustic sensor such as a microphone or hydrophone, image sensor, and/or a movement sensor. In one embodiment, the ingestible device comprises a plurality of different environmental sensors for generating different kinds of environmental data.

In order to avoid the problem of capsule retention, a thorough past medical and surgical history should be undertaken. In addition, several other steps have been proposed, including performing investigations such as barium followthrough. In cases where it is suspected that there is a high risk of retention, the patient is given a patency capsule a few days before swallowing an ingestible device. Any dissolvable non-endoscopic capsule may be used to determine the patency of the GI tract. The patency capsule is usually the same size as the ingestible device and can be made of cellophane. In some embodiments, the patency capsule contains a mixture of barium and lactose, which allows visualization by x-ray. The patency capsule may also include a radiotag or other label, which allows for it to be detected by radio-scanner externally. The patency capsule may comprise wax plugs, which allow for intestinal fluid to enter and dissolve the content, thereby dividing the capsule into small particles.

Accordingly, in some embodiments, the methods herein comprise (a) identifying a subject having an inflammatory disease or condition that arises in a tissue originating from the endoderm and (b) evaluating the subject for suitability to treatment. In some embodiments, the methods herein comprise evaluating for suitability to treatment a subject identified as having a disease or condition that arises in a tissue originating from the endoderm. In some embodiments, evaluating the subject for suitability to treatment comprises determining the patency of the subject's GI tract.

In some embodiments, an ingestible device comprises a tissue anchoring mechanism for anchoring the ingestible device to a subject's tissue. For example, an ingestible device could be administered to a subject and once it reaches the desired location for release of the immune modulator (e.g., any of the immune modulators described herein), the tissue attachment mechanism can be activated or deployed such that the ingestible device, or a portion thereof, is anchored to the desired location. In some embodiments, the tissue anchoring mechanism is reversible such that after initial anchoring, the tissue attachment device is retracted, dissolved, detached, inactivated or otherwise rendered incapable of anchoring the ingestible device to the subject's tissue. In some embodiments the attachment mechanism is placed endoscopically.

In some embodiments, a tissue anchoring mechanism comprises an osmotically-driven sucker. In some embodiments, the osmotically-driven sucker comprises a first valve on the near side of the osmotically-driven sucker (e.g., near the subject's tissue) and a second one-way valve that is opened by osmotic pressure on the far side of the osmotically-driven sucker, and an internal osmotic pump system comprising salt crystals and semi-permeable membranes positioned between the two valves. In such embodiments, osmotic pressure is used to adhere the ingestible device to the subject's tissue without generating a vacuum within the ingestible capsule. After the osmotic system is activated by opening the first valve, fluid is drawn in through the sucker and expelled through the second burst valve. Fluid continues to flow until all the salt contained in the sucker is dissolved or until tissue is drawn into the sucker. As liminal fluid is drawn through the osmotic pump system, solutes build up between the tissue and the first valve, reducing osmotic pressure. In some embodiments, the solute buildup stalls the pump before the tissue contacts the valve, preventing tissue damage. In some embodiments, a burst valve is used on the far side of the osmotically-driven sucker rather than a one-way valve, such that luminal fluid eventually clears the saline chamber and the osmotic flow reverses, actively pushing the subject's tissue out of the sucker. In some embodiments, the ingestible device may be anchored to the interior surface of tissues forming the GI tract of a subject. In one embodiment, the ingestible device comprises a connector for anchoring the device to the interior surface of the GI tract. The connector may be operable to ingestible device to the interior surface of the GI tract using an adhesive, negative pressure and/or fastener.

In some embodiments a device comprises a tract stimulator and/or monitor IMD comprising a housing enclosing electrical stimulation and/or monitoring circuitry and a power source and an elongated flexible member extending from the housing to an active fixation mechanism adapted to be fixed into the GI tract wall is disclosed. After fixation is effected, the elongated flexible member bends into a preformed shape that presses the housing against the mucosa so that forces that would tend to dislodge the fixation mechanism are minimized. The IMD is fitted into an esophageal catheter lumen with the fixation mechanism aimed toward the catheter distal end opening whereby the bend in the flexible member is straightened. The catheter body is inserted through the esophagus into the GI tract cavity to direct the catheter distal end to the site of implantation and fix the fixation mechanism to the GI tract wall. The IMD is ejected from the lumen, and the flexible member assumes its bent configuration and lodges the hermetically sealed housing against the mucosa. A first stimulation/sense electrode is preferably an exposed conductive portion of the housing that is aligned with the bend of the flexible member so that it is pressed against the mucosa. A second stimulation/sense electrode is located at the fixation site.

In some embodiments a device includes a fixation mechanism to anchor the device to tissue within a body lumen, and a mechanism to permit selective de-anchoring of the device from the tissue anchoring site without the need for endoscopic or surgical intervention. An electromagnetic device may be provided to mechanically actuate the de-anchoring mechanism. Alternatively, a fuse link may be electrically blown to de-anchor the device. As a further alternative, a rapidly degradable bonding agent may be exposed to a degradation agent to de-anchor the device from a bonding surface within the body lumen.

In some embodiments a device is as disclosed in patent publication WO2015112575A1, incorporated by reference herein in its entirety. The patent publication is directed to a gastrointestinal sensor implantation system. In some embodiments an orally-administrable capsule comprises a tissue capture device or reservoir removably coupled to the orally-administrable capsule, where the tissue capture device including a plurality of fasteners for anchoring the tissue capture device to gastrointestinal tissue within a body In some embodiments, the ingestible device contains an electric energy emitting means, a radio signal transmitting means, a medicament storage means and a remote actuatable medicament releasing means. The capsule signals a remote receiver as it progresses through the alimentary tract in a previously mapped route and upon reaching a specified site is remotely triggered to release a dosage of medicament. Accordingly, in some embodiments, releasing the agent is triggered by a remote electromagnetic signal.

In some embodiments, the ingestible device includes a housing introducible into a body cavity and of a material insoluble in the body cavity fluids, but formed with an opening covered by a material which is soluble in body cavity fluids. A diaphragm divides the interior of the housing into a medication chamber including the opening, and a control chamber. An electrolytic cell in the control chamber generates a gas when electrical current is passed therethrough to deliver medication from the medication chamber through the opening into the body cavity at a rate controlled by the electrical current. Accordingly, in some embodiments, releasing the immune modulator is triggered by generation in the composition of a gas in an amount sufficient to expel the immune modulator.

In some embodiments, the ingestible device includes an oral drug delivery device having a housing with walls of water permeable material and having at least two chambers separated by a displaceable membrane. The first chamber receives drug and has an orifice through which the drug is expelled under pressure. The second chamber contains at least one of two spaced apart electrodes forming part of an electric circuit which is closed by the ingress of an aqueous ionic solution into the second chamber. When current flows through the circuit, gas is generated and acts on the displaceable membrane to compress the first chamber and expel the active ingredient through the orifice for progressive delivery to the gastrointestinal tract.

In some embodiments, the ingestible device includes an ingestible device for delivering a substance to a chosen location in the GI tract of a mammal includes a receiver of electromagnetic radiation for powering an openable part of the device to an opened position for dispensing of the substance. The receiver includes a coiled wire that couples the energy field, the wire having an air or ferrite core. In a further embodiment, the device includes an apparatus for generating the electromagnetic radiation, the apparatus including one or more pairs of field coils supported in a housing. The device optionally includes a latch defined by a heating resistor and a fusible restraint. The device may also include a flexible member that may serve one or both the functions of activating a transmitter circuit to indicate dispensing of the substance; and restraining of a piston used for expelling the substance.

In some embodiments, the ingestible device includes an ingestible device for delivering a substance to a chosen location in the GI tract of a mammal includes a receiver of electromagnetic radiation for powering an openable part of the device to an opened position for dispensing of the substance. The receiver includes a coiled wire that couples the energy field, the wire having an air or ferrite core. In a further embodiment, the device includes an apparatus for generating the electromagnetic radiation, the apparatus including one or more pairs of field coils supported in a housing. The device optionally includes a latch defined by a heating resistor and a fusible restraint. The device may also include a flexible member that may serve one or both the functions of activating a transmitter circuit to indicate dispensing of the substance; and restraining of a piston used for expelling the substance.

In some embodiments, the ingestible device is a device a swallowable capsule. A sensing module is disposed in the capsule. A bioactive substance dispenser is disposed in the capsule. A memory and logic component is disposed in the capsule and in communication with the sensing module and the dispenser.

In some embodiments, localized administration is implemented via an electronic probe which is introduced into the intestinal tract of a living organism and which operates autonomously therein, adapted to deliver one or more therapy agents. In one embodiment, the method includes loading the probe with one or more therapy agents, and selectively releasing the agents from the probe at a desired location of the intestinal tract in order to provide increased efficacy over traditional oral ingestion or intravenous introduction of the agent(s).

In some embodiments, the ingestible device includes electronic control means for dispensing the drug substantially to the intended site in the GI tract, according to a pre-determined drug release profile obtained prior to administration from the specific mammal.

Accordingly, in some embodiments, releasing the immune modulator (e.g., any of the immune modulators described herein) is triggered by an electromagnetic signal generated within the device. The releasing may occur according to a pre-determined drug release profile.

In some embodiments, the ingestible device can include at least one guide tube, one or more tissue penetrating members positioned in the guide tube, a delivery member, an actuating mechanism and a release element. The release element degrades upon exposure to various conditions in the intestine so as to release and actuate the actuating mechanism. Embodiments of the device are particularly useful for the delivery of drugs which are poorly absorbed, tolerated and/or degraded within the GI tract.

In some embodiments, the ingestible device includes an electronic pill comprising at least one reservoir with a solid powder or granulate medicament or formulation, a discharge opening and an actuator responsive to control circuitry for displacing medicine from the reservoir to the discharge opening. The medicament or formulation comprises a dispersion of one or more active ingredients—e.g., solids in powder or granulate form—in an inert carrier matrix. Optionally, the active ingredients are dispersed using intestinal moisture absorbed into the pill via a semi-permeable wall section.

In some embodiments, the ingestible device includes a sensor comprising a plurality of electrodes having a miniature size and a lower power consumption and a coating exterior to the electrodes, wherein the coating interacts with a target condition thereby producing a change in an electrical property of the electrodes, wherein the change is transduced into an electrical signal by the electrodes. Accordingly, in some embodiments, releasing the immune modulators is triggered by an electric signal by the electrodes resulting from the interaction of the coating with the intended site of release. Further provided herein is a system for medication delivery comprising such sensor and a pill.

In some embodiments, the ingestible device includes an electronic pill comprising a plurality of reservoirs, each of the reservoirs comprising a discharge opening covered by a removable cover. The pill comprises at least one actuator responsive to control circuitry for removing the cover from the discharge opening. The actuator can for example be a spring loaded piston breaking a foil cover when dispensing the medicament. Alternatively, the cover can be a rotatable disk or cylinder with an opening which can be brought in line with the discharge opening of a reservoir under the action of the actuator.

In some embodiments, the ingestible device includes an electronically and remotely controlled pill or medicament delivery system. The pill includes a housing; a reservoir for storing a medicament; an electronically controlled release valve or hatch for dispensing one or more medicaments stored in the reservoir while traversing the gastrointestinal tract; control and timing circuitry for opening and closing the valve; and a battery. The control and timing circuitry opens and closes the valve throughout a dispensing time period in accordance with a preset dispensing timing pattern which is programmed within the control and timing circuitry. RF communication circuitry receives control signals for remotely overriding the preset dispensing timing pattern, reprogramming the control and timing circuitry or terminating the dispensing of the medicament within the body. The pill includes an RFID tag for tracking, identification, inventory and other purposes.

In some embodiments, the ingestible device includes an electronic capsule which has a discrete drive element comprising: a housing, electronics for making the electronic capsule operable, a pumping mechanism for dosing and displacing a substance, a power source for powering the electronic capsule and enabling the electronics and the pumping mechanism to operate, and a locking mechanism; and a discrete payload element comprising: a housing, a reservoir for storing the substance, one or more openings in the housing for releasing the substance from the reservoir and a locking mechanism for engaging the drive element locking mechanism. Engagement of the drive element locking mechanism with the payload element locking mechanism secures the drive element to the payload element, thereby making the electronic capsule operable and specific.

In some embodiments, the ingestible device may be a mucoadhesive device configured for release of an active agent.

In some embodiments, the ingestible device includes an apparatus that includes an ingestible medical treatment device, which is configured to initially assume a contracted state having a volume of less than 4 $cm^3$. The device includes a gastric anchor, which initially assumes a contracted size, and which is configured to, upon coming in contact with a liquid, expand sufficiently to prevent passage of the anchor through a round opening having a diameter of between 1 cm and 3 cm. The device also includes a duodenal unit, which is configured to pass through the opening, and which is coupled to the gastric anchor such that the duodenal unit is held between 1 cm and 20 cm from the gastric anchor.

In some embodiments, the ingestible device includes a medical robotic system and method of operating such comprises taking intraoperative external image data of a patient anatomy, and using that image data to generate a modeling adjustment for a control system of the medical robotic system (e.g., updating anatomic model and/or refining instrument registration), and/or adjust a procedure control aspect (e.g., regulating substance or therapy delivery, improving targeting, and/or tracking performance).

In one embodiment the ingestible device may also include one or more environmental sensors. Environmental sensor may be used to generate environmental data for the environment external to device in the gastrointestinal (GI) tract of the subject. In some embodiments, environmental data is generated at or near the location within the GI tract of the subject where a drug is delivered. Examples of environmental sensor include, but are not limited to a capacitance sensor, a temperature sensor, an impedance sensor, a pH sensor, a heart rate sensor, acoustic sensor, image sensor (e.g., a hydrophone), and/or a movement sensor (e.g., an accelerometer). In one embodiment, the ingestible device comprises a plurality of different environmental sensors for generating different kinds of environmental data.

In one embodiment, the image sensor is a video camera suitable for obtaining images in vivo of the tissues forming the GI tract of the subject. In one embodiment, the environmental data is used to help determine one or more characteristics of the GI tract, including the location of disease (e.g., presence or location of inflamed tissue and/or lesions associated with inflammatory bowel disease). In some embodiments, the ingestible device may comprise a camera for generating video imaging data of the GI tract which can be used to determine, among other things, the location of the device.

In another embodiment, the ingestible device described herein may be localized using a gamma scintigraphy technique or other radio-tracker technology as employed by Phaeton Research's Enterion™ capsule (See Teng, Renli, and Juan Maya. "Absolute bioavailability and regional absorption of ticagrelor in healthy volunteers." Journal of Drug Assessment 3.1 (2014): 43-50), or monitoring the magnetic field strength of permanent magnet in the ingestible device (see T. D. Than, et al., "A review of localization systems for robotic endoscopic capsules," IEEE Trans. Biomed. Eng., vol. 59, no. 9, pp. 2387-2399 Sep. 2012).

In one embodiment, the one or more environmental sensors measure pH, temperature, transit times, or combinations thereof.

In some embodiments, releasing the immune modulator (e.g., any of the immune modulators described herein) is dependent on the pH at or in the vicinity of the location. In some embodiments the pH in the jejunum is from 6.1 to 7.2, such as 6.6. In some embodiments the pH in the mid small bowel is from 7.0 to 7.8, such as 7.4. In some embodiments the pH in the ileum is from 7.0 to 8.0, such as 7.5. In some embodiments the pH in the right colon is from 5.7 to 7.0, such as 6.4. In some embodiments the pH in the mid colon is from 5.7 to 7.4, such as 6.6. In some embodiments the pH in the left colon is from 6.3 to 7.7, such as 7.0. In some embodiments, the gastric pH in fasting subjects is from about 1.1 to 2.1, such as from 1.4 to 2.1, such as from 1.1 to 1.6, such as from 1.4 to 1.6. In some embodiments, the gastric pH in fed subjects is from 3.9 to 7.0, such as from 3.9 to 6.7, such as from 3.9 to 6.4, such as from 3.9 to 5.8, such as from 3.9 to 5.5, such as from 3.9 to 5.4, such as from 4.3 to 7.0, such as from 4.3 to 6.7, such as from 4.3 to 6.4, such as from 4.3 to 5.8, such as from 4.3 to 5.5, such as from 4.3 to 5.4. In some embodiments, the pH in the duodenum is from 5.8 to 6.8, such as from 6.0 to 6.8, such as from 6.1 to 6.8, such as from 6.2 to 6.8, such as from 5.8 to 6.7, such as from 6.0 to 6.7, such as from 6.1 to 6.7, such as from 6.2 to 6.7, such as from 5.8 to 6.6, such as from 6.0 to 6.6, such as from 6.1 to 6.6, such as from 6.2 to 6.6, such as from 5.8 to 6.5, such as from 6.0 to 6.5, such as from 6.1 to 6.5, such as from 6.2 to 6.5.

In some embodiments, releasing the immune modulator (e.g., any of the immune modulators described herein) is not dependent on the pH at or in the vicinity of the location. In some embodiments, releasing the immune modulator (e.g., any of the immune modulators described herein) is triggered by degradation of a release component located in the capsule. In some embodiments, the release of the immune modulator is not triggered by degradation of a release component located in the capsule. In some embodiments, the release of the immune modulator is not dependent on enzymatic activity at or in the vicinity of the location. In some embodiments, releasing the immune modulator is not dependent on bacterial activity at or in the vicinity of the location.

In some embodiments, the pharmaceutical composition is an ingestible device, comprising:
    a housing defined by a first end, a second end substantially opposite from the first end, and a wall extending longitudinally from the first end to the second end;
    a reservoir located within the housing and containing the immune modulator (e.g., any of the immune modulators described herein),
        wherein a first end of the reservoir is attached to the first end of the housing; a mechanism for releasing the immune modulator from the reservoir; and
    an exit valve configured to allow the immune modulator to be released out of the housing from the reservoir.

In some embodiments, the ingestible device further comprises:
    an electronic component located within the housing; and
    a gas generating cell located within the housing and adjacent to the electronic component,
        wherein the electronic component is configured to activate the gas generating cell to generate gas.

In some embodiments, the ingestible device further comprises:
    a safety device placed within or attached to the housing, wherein the safety device is configured to relieve an internal pressure within the housing when the internal pressure exceeds a threshold level.

In some embodiments, the pharmaceutical composition is an ingestible device, comprising:
    a housing defined by a first end, a second end substantially opposite from the first end, and a wall extending longitudinally from the first end to the second end;
    an electronic component located within the housing;
    a gas generating cell located within the housing and adjacent to the electronic component,
        wherein the electronic component is configured to activate the gas generating cell to generate gas;

a reservoir located within the housing,
    wherein the reservoir stores a dispensable substance and a first end of the reservoir is attached to the first end of the housing;
an exit valve located at the first end of the housing,
    wherein the exit valve is configured to allow the dispensable substance to be released out of the first end of the housing from the reservoir; and
a safety device placed within or attached to the housing,
    wherein the safety device is configured to relieve an internal pressure within the housing when the internal pressure exceeds a threshold level.

In some embodiments, the pharmaceutical composition is an ingestible device, comprising:
a housing defined by a first end, a second end substantially opposite from the first end, and a wall extending longitudinally from the first end to the second end;
an electronic component located within the housing,
a gas generating cell located within the housing and adjacent to the electronic component,
    wherein the electronic component is configured to activate the gas generating cell to generate gas;
a reservoir located within the housing,
    wherein the reservoir stores a dispensable substance and a first end of the reservoir is attached to the first end of the housing;
an injection device located at the first end of the housing,
    wherein the jet injection device is configured to inject the dispensable substance out of the housing from the reservoir; and
a safety device placed within or attached to the housing,
    wherein the safety device is configured to relieve an internal pressure within the housing.

In some embodiments, the pharmaceutical composition is an ingestible device, comprising:
a housing defined by a first end, a second end substantially opposite from the first end, and a wall extending longitudinally from the first end to the second end;
an optical sensing unit located on a side of the housing,
    wherein the optical sensing unit is configured to detect a reflectance from an environment external to the housing;
an electronic component located within the housing;
a gas generating cell located within the housing and adjacent to the electronic component,
    wherein the electronic component is configured to activate the gas generating cell to generate gas in response to identifying a location of the ingestible device based on the reflectance;
a reservoir located within the housing,
    wherein the reservoir stores a dispensable substance and a first end of the reservoir is attached to the first end of the housing;
a membrane in contact with the gas generating cell and configured to move or deform into the reservoir by a pressure generated by the gas generating cell; and
a dispensing outlet placed at the first end of the housing,
    wherein the dispensing outlet is configured to deliver the dispensable substance out of the housing from the reservoir.

In one embodiment, drug delivery is triggered when it encounters the site of release in the GI tract.

In one embodiment, the one or more environmental sensors measure pH, temperature, transit times, or combinations thereof.

In some embodiments, releasing the immune modulator (e.g., any of the immune modulators described herein) is dependent on the pH at or in the vicinity of the location. In some embodiments the pH in the jejunum is from 6.1 to 7.2, such as 6.6. In some embodiments the pH in the mid small bowel is from 7.0 to 7.8, such as 7.4. In some embodiments the pH in the ileum is from 7.0 to 8.0, such as 7.5. In some embodiments the pH in the right colon is from 5.7 to 7.0, such as 6.4. In some embodiments the pH in the mid colon is from 5.7 to 7.4, such as 6.6. In some embodiments the pH in the left colon is from 6.3 to 7.7, such as 7.0. In some embodiments, the gastric pH in fasting subjects is from about 1.1 to 2.1, such as from 1.4 to 2.1, such as from 1.1 to 1.6, such as from 1.4 to 1.6. In some embodiments, the gastric pH in fed subjects is from 3.9 to 7.0, such as from 3.9 to 6.7, such as from 3.9 to 6.4, such as from 3.9 to 5.8, such as from 3.9 to 5.5, such as from 3.9 to 5.4, such as from 4.3 to 7.0, such as from 4.3 to 6.7, such as from 4.3 to 6.4, such as from 4.3 to 5.8, such as from 4.3 to 5.5, such as from 4.3 to 5.4. In some embodiments, the pH in the duodenum is from 5.8 to 6.8, such as from 6.0 to 6.8, such as from 6.1 to 6.8, such as from 6.2 to 6.8, such as from 5.8 to 6.7, such as from 6.0 to 6.7, such as from 6.1 to 6.7, such as from 6.2 to 6.7, such as from 5.8 to 6.6, such as from 6.0 to 6.6, such as from 6.1 to 6.6, such as from 6.2 to 6.6, such as from 5.8 to 6.5, such as from 6.0 to 6.5, such as from 6.1 to 6.5, such as from 6.2 to 6.5.

In some embodiments, releasing the immune modulator is not dependent on the pH at or in the vicinity of the location. In some embodiments, releasing the immune modulator is triggered by degradation of a release component located in the capsule. In some embodiments, the immune modulator is not triggered by degradation of a release component located in the capsule. In some embodiments, wherein releasing the immune modulator is not dependent on enzymatic activity at or in the vicinity of the location. In some embodiments, releasing the immune modulator is not dependent on bacterial activity at or in the vicinity of the location.

In some embodiments, the pharmaceutical composition is an ingestible device, comprising:
a housing defined by a first end, a second end substantially opposite from the first end, and a wall extending longitudinally from the first end to the second end;
a reservoir located within the housing and containing the immune modulator,
    wherein a first end of the reservoir is attached to the first end of the housing;
a mechanism for releasing the immune modulator from the reservoir; and
an exit valve configured to allow the immune modulator to be released out of the housing from the reservoir.

In some embodiments, the ingestible device further comprises:
an electronic component located within the housing; and
a gas generating cell located within the housing and adjacent to the electronic component,
    wherein the electronic component is configured to activate the gas generating cell to generate gas.

In some embodiments, the ingestible device further comprises:
a safety device placed within or attached to the housing,
    wherein the safety device is configured to relieve an internal pressure within the housing when the internal pressure exceeds a threshold level.

In some embodiments, the pharmaceutical composition is an ingestible device, comprising:
a housing defined by a first end, a second end substantially opposite from the first end, and a wall extending longitudinally from the first end to the second end;

an electronic component located within the housing;
a gas generating cell located within the housing and adjacent to the electronic component,
   wherein the electronic component is configured to activate the gas generating cell to generate gas;
a reservoir located within the housing,
   wherein the reservoir stores a dispensable substance and a first end of the reservoir is attached to the first end of the housing;
an exit valve located at the first end of the housing,
   wherein the exit valve is configured to allow the dispensable substance to be released out of the first end of the housing from the reservoir; and a safety device placed within or attached to the housing,
   wherein the safety device is configured to relieve an internal pressure within the housing when the internal pressure exceeds a threshold level.

In some embodiments, the pharmaceutical composition is an ingestible device, comprising:
a housing defined by a first end, a second end substantially opposite from the first end, and a wall extending longitudinally from the first end to the second end;
an electronic component located within the housing,
a gas generating cell located within the housing and adjacent to the electronic component,
   wherein the electronic component is configured to activate the gas generating cell to generate gas;
a reservoir located within the housing,
   wherein the reservoir stores a dispensable substance and a first end of the reservoir is attached to the first end of the housing;
an injection device located at the first end of the housing,
   wherein the jet injection device is configured to inject the dispensable substance out of the housing from the reservoir; and
a safety device placed within or attached to the housing,
   wherein the safety device is configured to relieve an internal pressure within the housing.

In some embodiments, the pharmaceutical composition is an ingestible device, comprising:
a housing defined by a first end, a second end substantially opposite from the first end, and a wall extending longitudinally from the first end to the second end;
an optical sensing unit located on a side of the housing,
   wherein the optical sensing unit is configured to detect a reflectance from an environment external to the housing;
an electronic component located within the housing;
a gas generating cell located within the housing and adjacent to the electronic component,
   wherein the electronic component is configured to activate the gas generating cell to generate gas in response to identifying a location of the ingestible device based on the reflectance;
a reservoir located within the housing,
   wherein the reservoir stores a dispensable substance and a first end of the reservoir is attached to the first end of the housing;
a membrane in contact with the gas generating cell and configured to move or deform into the reservoir by a pressure generated by the gas generating cell; and
a dispensing outlet placed at the first end of the housing,
   wherein the dispensing outlet is configured to deliver the dispensable substance out of the housing from the reservoir.

In some embodiments, the pharmaceutical composition is an ingestible device as disclosed in U.S. Patent Application Ser. No. 62/385,553, incorporated by reference herein in its entirety.

In some embodiments, the pharmaceutical composition is an ingestible device as disclosed in the following applications, each of which is incorporated by reference herein in its entirety: U.S. Ser. Nos. 14/460,893; 15/514,413; 62/376,688; 62/385,344; 62/478,955; 62/434,188; 62/434,320; 62/431,297; 62/434,797; 62/480,187; 62/502,383; and 62/540,873.

In some embodiments, the pharmaceutical composition is an ingestible device comprising a localization mechanism as disclosed in international patent application PCT/US2015/052500, incorporated by reference herein in its entirety.

In some embodiments, the pharmaceutical composition is not a dart-like dosage form.

In some embodiments provided herein is an ingestible device, comprising:
an immune modulator;
one or more processing devices; and
one more machine readable hardware storage devices storing instructions that are executable by the one or more processing devices to determine a location of the ingestible device in a portion of a GI tract of a subject to an accuracy of at least 85%. In some embodiments, the accuracy is at least 90%. In some embodiments, the accuracy is at least 95%.

In some embodiments, the accuracy is at least 97%. In some embodiments, the accuracy is at least 98%. In some embodiments, the accuracy is at least 99%. In some embodiments, the accuracy is 100%. In some embodiments, the portion of the GI tract of the subject comprises the duodenum. In some embodiments, the portion of the GI tract of the subject comprises the jejunum. In some embodiments, the portion of the GI tract of the subject comprises the terminal ileum, cecum and colon. In some embodiments, the ingestible device further comprises first and second light sources, wherein the first light source is configured to emit light at a first wavelength, and the second light source is configured to emit light at a second wavelength different from the first wavelength. In some embodiments, the ingestible device further comprises first and second detectors, wherein the first detector is configured to detect light at the first wavelength, and the second detector is configured to detect light at the second wavelength.

In some embodiments, provided herein is an ingestible device, comprising:
an immune modulator;
one or more processing devices; and
one more machine readable hardware storage devices storing instructions that are executable by the one or more processing devices to determine that the ingestible device is in the cecum of a subject to an accuracy of at least 70%. In some embodiments, the accuracy is at least 75%. In some embodiments, the accuracy is at least 80%. In some embodiments, the accuracy is at least 85%. In some embodiments, the accuracy is at least 88%. In some embodiments, the accuracy is at least 89%.

In some embodiments, provided herein is an ingestible device, comprising:
an immune modulator;
one or more processing devices; and
one more machine readable hardware storage devices storing instructions that are executable by the one or more processing devices to transmit data to a device capable of implementing the data to determine a location of the medical device in a portion of a GI tract of a subject to an accuracy of at least 85%. In some embodiments, the accuracy is at least 90%. In some embodiments, the accuracy is at least 95%. In some embodiments, the accuracy is at least 97%. In some embodiments, the accuracy is at least 98%. In some embodiments, the accuracy is at least 99%. In some embodiments, the accuracy is 100%. In some embodiments, the portion of the GI tract of the subject comprises the duodenum. In some embodiments, the portion of the GI tract of the subject comprises the jejunum. In some embodiments, the portion of the GI tract of the subject comprises the terminal ileum, cecum and colon. In some embodiments, the ingestible device further comprises first and second light sources, wherein the first light source is configured to emit light at a first wavelength, and the second light source is configured to emit light at a second wavelength different from the first wavelength. In some embodiments, the ingestible device further comprises first and second detectors, wherein the first detector is configured to detect light at the first wavelength, and the second detector is configured to detect light at the second wavelength. In some embodiments, the data comprise intensity data for at least two different wavelengths of light.

In some embodiments, provided herein is an ingestible device, comprising:
  an immune modulator;
  one or more processing devices; and
  one more machine readable hardware storage devices storing instructions that are executable by the one or more processing devices to transmit data to an external device capable of implementing the data to determine that the ingestible device is in the cecum of subject to an accuracy of at least 70%. In some embodiments, the accuracy is at least 75%. In some embodiments, the accuracy is at least 80%. In some embodiments, the accuracy is at least 85%. In some embodiments, the accuracy is at least 88%. In some embodiments, the accuracy is at least 89%.

In some embodiments, provided herein is a method of treating an inflammatory disease or condition arising in a tissue that originates from the endoderm in a subject, comprising: releasing an immune modulator at a location in the gastrointestinal tract of the subject that is proximate to an intended site of release, wherein the method comprises administering orally to the subject an ingestible device as disclosed herein, the method further comprising determining a location of the ingestible medical device in a portion of a GI tract of the subject to an accuracy of at least 85%. In some embodiments, the accuracy is at least 90%. In some embodiments, the accuracy is at least 95%. In some embodiments, the accuracy is at least 97%. In some embodiments, the accuracy is at least 98%. In some embodiments, the accuracy is at least 99%. In some embodiments, the accuracy is 100%. In some embodiments, the portion of the GI tract of the subject comprises the duodenum. In some embodiments, the portion of the GI tract of the subject comprises the jejunum. In some embodiments, the portion of the GI tract of the subject comprises the terminal ileum, cecum and colon. In some embodiments, determining the location of the ingestible device within the GI tract of a subject comprises determining reflected light signals within the GI tract, wherein the reflected signals comprise light of at least two different wavelengths. In some embodiments, the reflected signals comprise light of at least three different wavelengths. In some embodiments, the reflected light comprise first and second wavelengths; the first wavelength is between 495-600 nm; and the second wavelength is between 400-495 nm. In some embodiments, the first and second wavelengths are separated by at least 50 nm.

In some embodiments, provided herein is a method of treating an inflammatory disease or condition arising in a tissue originating from the endoderm in a subject, comprising: releasing an immune modulator at a location in the gastrointestinal tract of the subject that is proximate to the intended site of release, wherein the method comprises administering orally to the subject an ingestible device as disclosed herein, the method further comprising determining a location of the ingestible medical device within the GI tract of the subject based on measured reflected light signals within the GI tract, where the reflected signals comprise light of at least two different wavelengths. In some embodiments, the reflected signals comprise light of at least three different wavelengths. In some embodiments, the at least two different wavelengths comprise first and second wavelengths; the first wavelength is between 495-600 nm; and the second wavelength is between 400-495 nm. In some embodiments, the first and second wavelengths are separated by at least 50 nm.

In some embodiments, provided herein is an ingestible device, comprising:
  a housing;
  a gas generating cell located within the housing; and
  a storage reservoir located within the housing,
    wherein the storage reservoir stores an immune modulator, and an opening in the housing is configured to allow the immune modulator to be released out of the housing from the storage reservoir via an opening in the ingestible device.

In some embodiments, the housing is defined by a first end, a second end substantially opposite from the first end, and a wall extending longitudinally from the first end to the second end;
  wherein an electronic component is located within the housing and the gas generating cell is adjacent to the electronic component,
  wherein the electronic component is configured to activate the gas generating cell to generate gas;
  wherein a first end of the storage reservoir is connected to the first end of the housing;
  wherein an exit valve is located at the first end of the housing and is configured to allow the immune modulator to be released out of the first end of the housing; and wherein the ingestible device further comprises a safety device placed within or attached to the housing,
  wherein the safety device is configured to relieve an internal pressure within the housing when the internal pressure exceeds a threshold level.

In some embodiments, provided herein is an ingestible device, comprising:
  a gas generating cell located within the housing;
  a storage reservoir located within the housing,
    wherein the storage reservoir stores an immune modulator; and
  an injection device configured to inject the immune modulator out of the housing from the storage reservoir via an opening in the ingestible device.

In some embodiments, the housing is defined by a first end, a second end substantially opposite from the first end, and a wall extending longitudinally from the first end to the second end;

wherein an electronic component is located within the housing and the gas generating cell is adjacent to the electronic component, wherein the electronic component is configured to activate the gas generating cell to generate gas;

wherein a first end of the storage reservoir is connected to the first end of the housing;

wherein the injection device is located at the first end of the housing and is configured to inject the immune modulator out of the housing via an opening in the ingestible device; and wherein the ingestible device further comprises a safety device placed within or attached to the housing, and wherein the safety device is configured to relieve an internal pressure within the housing.

In some embodiments, provided herein is an ingestible device, comprising:

a housing;

an optical sensing unit supported by a side of the housing, wherein the optical sensing unit is configured to detect a reflectance from an environment external to the housing;

a gas generating cell located within the housing, wherein the ingestible device is configured so that, in response to identifying a location of the ingestible device based on a reflectance detected by the optical sensing unit, the gas generating cell generates a gas;

a storage reservoir located within the housing, wherein the storage reservoir stores an immune modulator; and wherein the ingestible device is configured so that, when the gas generating cell generates the gas, the immune modulator is delivered out of the housing from the storage reservoir via an opening in the ingestible device.

In some embodiments, the housing is defined by a first end, a second end substantially opposite from the first end, and a wall extending longitudinally from the first end to the second end;

wherein the optical sensing unit is supported by the side of the housing, wherein the ingestible device further comprises an electronic component located within the housing;

wherein the gas generating cell is adjacent to the electronic component, wherein the electronic component is configured to activate the gas generating cell to generate gas;

wherein a first end of the storage reservoir is connected to the first end of the housing;

wherein the ingestible device further comprises a membrane in contact with the gas generating cell and configured to move or deform into the storage reservoir by a pressure generated by the gas generating cell; and wherein the ingestible device further comprises a dispensing outlet placed at the first end of the housing and configured to deliver the immune modulator out of the housing.

In some embodiments of any ingestible device disclosed herein comprising an immune modulator, the immune modulator is present in a therapeutically effective amount.

In case of conflict between the present specification and any subject matter incorporated by reference herein, the present specification, including definitions, will control.

Devices and Methods for Detection of Analytes in GI tract

Detection of certain analytes in the GI tract may be useful in the identification of the nature and severity of the disease, in accurately locating the site(s) of disease, and in assessing patient response to a therapeutic agent. The appropriate therapeutic agent may accordingly be released at the correct locations(s), dosage, or timing for the disease. As discussed further herein, analytes may include biomarkers associated with a disease or associated with patient response and/or therapeutic agents previously administered to treat the disease. In some embodiments, the disclosure provides an ingestible device for detecting an analyte in a sample, the ingestible device comprising a sampling chamber that is configured to hold a composition comprising: (1) a plurality of donor particles, each of the plurality of donor particles comprising a photosensitizer and having coupled thereto a first antigen-binding agent that binds to the analyte, wherein the photosensitizer, in its excited state, is capable of generating singlet oxygen; and (2) a plurality of acceptor particles, each of the plurality of acceptor particles comprising a chemiluminescent compound and having coupled thereto a second antigen-binding agent that binds to the analyte, wherein the chemiluminescent compound is capable of reacting with singlet oxygen to emit luminescence. In some embodiments, the first and the second analyte-binding agents are antigen-binding agents (e.g., antibodies). In some embodiments, the first and the second antigen-binding agents bind to the same epitope of the analyte (e.g., a protein). In some embodiments, the first and the second antigen-binding agents bind to separate epitopes of the analyte (e.g., a protein) that spatially overlap. In some embodiments, the first and the second antigen-binding agents bind to the separate epitopes of the analyte (e.g., a protein) that do not spatially overlap.

In some embodiments, this disclosure provides an ingestible device for detecting an analyte in a sample, the ingestible device comprising a sampling chamber that is configured to hold an absorbable material (e.g., an absorbable pad or sponge) having absorbed therein a composition comprising: (1) a plurality of donor particles, each of the plurality of donor particles comprising a photosensitizer and having coupled thereto a first antigen-binding agent that binds to the analyte, wherein the photosensitizer, in its excited state, is capable of generating singlet oxygen; and (2) a plurality of acceptor particles, each of the plurality of acceptor particles comprising a chemiluminescent compound and having coupled thereto a second antigen-binding agent that binds to the analyte, wherein the chemiluminescent compound is capable of reacting with singlet oxygen to emit luminescence. In some embodiments, the first and the second analyte-binding agents are antigen-binding agents (e.g., antibodies). In some embodiments, the first and the second antigen-binding agents bind to the same epitope of the analyte (e.g., a protein). In some embodiments, the first and the second antigen-binding agents bind to separate epitopes of the analyte (e.g., a protein) that spatially overlap. In some embodiments, the first and the second antigen-binding agents bind to the separate epitopes of the analyte (e.g., a protein) that do not spatially overlap.

In certain embodiments, the disclosure provides a kit comprising an ingestible device as described herein. In some embodiments, the kit further comprises instructions, e.g., for detecting or quantifying an analyte in a sample.

In some embodiments, the disclosure provides methods for determining an analyte in a sample. In certain embodiments, this disclosure provides a method of detecting an analyte in a fluid sample of a subject, comprising: (1) providing an ingestible device; (2) transferring the fluid sample of the subject into the sampling chamber of the ingestible device in vivo; (3) irradiating the composition held in the sampling chamber of the ingestible device with light to excite the photosensitizer; and (4) measuring total luminescence or rate of change of luminescence emitted from the composition held in the sampling chamber of the ingestible device as a function of time, thereby determining the level of the analyte in the fluid sample. In some embodiments, the method further comprises comparing the level of the analyte in the fluid sample with the level of analyte in a reference sample (e.g., a reference sample obtained from a healthy subject). In some embodiments, the level of the analyte in the sample is used to diagnose and/or monitor a disease or disorder in the subject.

In some embodiments, the disclosure provides a method of detecting an analyte in a fluid sample of a subject, comprising: (1) providing an ingestible device, the device comprising a sampling chamber that is configured to hold an absorbable material (e.g., an absorbable pad or sponge) having absorbed therein a composition, as described herein; (2) transferring the fluid sample of the subject into the sampling chamber of the ingestible device in vivo; (3) fully or partially saturating the absorbable material held in the sampling chamber of the ingestible device with the fluid sample; (4) irradiating the absorbable material held in the sampling chamber of the ingestible device with light to excite the photosensitizer; and (5) measuring total luminescence or rate of change of luminescence emitted from the composition held in the sampling chamber of the ingestible device as a function of time, thereby determining the level of the analyte in the fluid sample. In some embodiments, the method further comprises comparing the level of the analyte in the fluid sample with the level of analyte in a reference sample (e.g., a reference sample obtained from a healthy subject). In some embodiments, the level of the analyte in the sample is used to diagnose and/or monitor a disease or disorder in the subject.

In some embodiments, the disclosure provides a method of assessing or monitoring the need to treat a subject suffering from or at risk of overgrowth of bacterial cells in the gastrointestinal (GI) tract, comprising: (1) providing an ingestible device for detecting an analyte; (2) transferring a fluid sample from the GI tract of the subject into the sampling chamber of the ingestible device in vivo; (3) irradiating the composition held in the sampling chamber of the ingestible device with light to excite the photosensitizer; (4) measuring total luminescence or rate of change of luminescence emitted from the composition held in the sampling chamber of the ingestible device as a function of time; (5) correlating the total luminescence or the rate of change of luminescence as a function of time measured in step (4) to the amount of the analyte in the fluid sample; and (6) correlating the amount of the analyte in the fluid sample to the number of viable bacterial cells in the fluid sample. In some embodiments, a number of viable bacterial cells determined in step (6) greater than a control number of viable bacterial cells, indicates a need for treatment (e.g., with an antibiotic agent described herein). In some embodiments, the control number of viable bacterial cells is $10^3$, $10^4$, $10^5$, $10^6$, $10^7$, $10^8$, $10^9$, or more. For example, in some embodiments, a number of viable bacterial cells determined in step (6) greater that about $10^3$ CFU/mL indicates a need for treatment. In some embodiments, a number of viable bacterial cells determined in step (6) greater that about $10^4$ CFU/mL indicates a need for treatment. In some embodiments, a number of the viable bacterial cells determined in step (6) greater than about $10^5$ CFU/mL indicates a need for treatment, e.g., with an antibiotic agent as described herein. In some embodiments, a number of viable bacterial cells determined in step (6) greater that about $10^6$ or more CFU/mL indicates a need for treatment.

In some embodiments, the total luminescence or the rate of change of luminescence as a function of time of the sponge is measured over multiple time points for an extended period of time in step (4). For instance, in some embodiments, the total luminescence or rate of change of luminescence as a function of time of the sample is measured continuously for a period of 0-1800 minutes, 0-1600 minutes, 0-1500 minutes, 0-1440 minutes, 0-1320 minutes, 0-1000 minutes, 0-900 minutes, 0-800 minutes, 0-700 minutes, 0-600 minutes, 0-500 minutes, 0-400 minutes, 0-350 minutes, 0-330 minutes, 0-300 minutes, 0-270 minutes, or 0-220 minutes. In some embodiments, the total luminescence or the rate of change of luminescence as a function of time of said sample is measured continuously for a period of 0-330 minutes. In some embodiments, the method is performed in vivo. In some embodiments, the method includes communicating the results of the onboard assay(s) to an ex vivo receiver. In some embodiments, the total luminescence or the rate of change of luminescence as a function of time of the sponge is measured over multiple time points for an extended period of time in step (5). For instance, in some embodiments, the total luminescence or rate of change of luminescence as a function of time of the sample is measured continuously for a period of 0-1800 minutes, 0-1600 minutes, 0-1500 minutes, 0-1440 minutes, 0-1320 minutes, 0-1000 minutes, 0-900 minutes, 0-800 minutes, 0-700 minutes, 0-600 minutes, 0-500 minutes, 0-400 minutes, 0-350 minutes, 0-330 minutes, 0-300 minutes, 0-270 minutes, or 0-220 minutes. In some embodiments, the total luminescence or the rate of change of luminescence as a function of time of said sample is measured continuously for a period of 0-330 minutes. In some embodiments, the method is performed in vivo. In some embodiments, the method includes communicating the results of the onboard assay(s) to an ex vivo receiver.

In some embodiments, the disclosure provides a method of assessing or monitoring the need to treat a subject suffering from or at risk of overgrowth of bacterial cells in the gastrointestinal tract, comprising: (1) providing an ingestible device for detecting an analyte, the device comprising a sampling chamber that is configured to hold an absorbable material (e.g., an absorbable pad or sponge) having absorbed therein a composition, as described herein; (2) transferring a fluid sample from the GI tract of the subject into the sampling chamber of the ingestible device in vivo; (3) fully or partially saturating the absorbable material held in the sampling chamber of the ingestible device with the fluid sample; (4) irradiating the absorbable material held in the sampling chamber of the ingestible device with light to excite the photosensitizer; (5) measuring total luminescence or rate of change of luminescence emitted from the composition held in the sampling chamber of the ingestible device as a function of time; (6) correlating the total luminescence or the rate of change of luminescence as a function of time measured in step (5) to the amount of the analyte in the fluid sample; and (7) correlating the amount of the analyte in the fluid sample to the number of viable bacterial cells in the fluid sample. In some embodiments, a number of viable bacterial cells determined in step (7) greater than a control number of viable bacterial cells indicates a need for treatment (e.g., with an antibiotic agent described herein). In some embodiments, the control number of viable bacterial cells is $10^3$, $10^4$, $10^5$, $10^6$, $10^7$, $10^8$, $10^9$, or more. For example, in some embodiments, a number of viable bacterial cells determined in step (7) greater that about $10^3$ CFU/mL indicates a need for treatment. In some embodiments, a number of viable bacterial cells determined in step (7) greater that about $10^4$ CFU/mL indicates a need for treatment. In some embodiments, a number of the viable bacterial cells determined in step (7) greater than about $10^5$ CFU/mL indicates a need for treatment, e.g., with an antibiotic agent as described herein. In some embodiments, a number of viable bacterial cells determined in step (7) greater that about $10^6$ or more CFU/mL indicates a need for treatment.

In some embodiments, the disclosure, provides a method of measuring the presence, absence or amount of one or more analytes from one or more samples in the gastrointestinal tract. In some embodiments the one or more analytes are measured multiple times, for example, at different time points or at different locations. In one embodiment, a single device measures one or more analytes or more time points or locations; thereby creating a "molecular map" of a physiological region. Measurements can be taken at any location in the gastrointestinal tract. For example, in one aspect, analytes from samples from one or more of the duodenum, jejunum, ileum, ascending colon, transverse colon or descending colon can be measured to create a molecular map of the small and large intestine. In one aspect, the sample is from the duodenum. In one aspect, In one aspect, the sample is from the jejunum. In one aspect, the sample is from the ileum. In one aspect, the sample is from the ascending colon. In one aspect, the sample is from the transverse colon. In one aspect, the sample is from the descending colon.

In another aspect, a series of measurements can be taken over a shorter distance of the gastrointestinal tract (e.g., the ileum) to create a higher resolution molecular map. In some embodiments, previous endoscopic imaging may identify a diseased area for molecular mapping. For example, a gastroenterologist may use imaging (e.g., an endoscope equipped with a camera) to identify the presence of Crohn's Disease in the ileum and cecum of a patient, and the methods and techniques herein may be used to measure inflammation-associated analytes in this diseased area of the patient. In a related embodiment, the inflammation-associated analytes, or any analyte, may be measured every one or more days to monitor disease flare-ups, or response to therapeutics.

Analytes

The compositions and methods described herein can be used to detect, analyze, and/or quantitate a variety of analytes in a human subject. "Analyte" as used herein refers to a compound or composition to be detected in a sample. Exemplary analytes suitable for use herein include those described in U.S. Pat. No. 6,251,581, which is incorporated by reference herein in its entirety. Broadly speaking, an analyte can be any substance (e.g., a substance with one or more antigens) capable of being detected. An exemplary and non-limiting list of analytes includes ligands, proteins, blood clotting factors, hormones, cytokines, polysaccharides, mucopolysaccharides, microorganisms (e.g., bacteria), microbial antigens, and therapeutic agents (including fragments and metabolites thereof).

For instance, the analyte may be a ligand, which is monovalent (monoepitopic) or polyvalent (polyepitopic), usually antigenic or haptenic, and is a single compound or plurality of compounds which share at least one common epitopic or determinant site. The analyte can be a part of a cell such as bacteria or a cell bearing a blood group antigen such as A, B, D, etc., a human leukocyte antigen (HLA), or other cell surface antigen, or a microorganism, e.g., bacterium (e.g. a pathogenic bacterium), a fungus, protozoan, or a virus (e.g., a protein, a nucleic acid, a lipid, or a hormone). In some embodiments, the analyte can be a part of an exosome (e.g., a bacterial exosome). In some embodiments, the analyte is derived from a subject (e.g., a human subject). In some embodiments, the analyte is derived from a microorganism present in the subject. In some embodiments, the analyte is a nucleic acid (e.g., a DNA molecule or a RNA molecule), a protein (e.g., a soluble protein, a cell surface protein), or a fragment thereof, that can be detected using any of the devices and methods provided herein.

The polyvalent ligand analytes will normally be poly (amino acids), i.e., a polypeptide (i.e., protein) or a peptide, polysaccharides, nucleic acids (e.g., DNA or RNA), and combinations thereof. Such combinations include components of bacteria, viruses, chromosomes, genes, mitochondria, nuclei, cell membranes, and the like.

In some embodiments, the polyepitopic ligand analytes have a molecular weight of at least about 5,000 Da, more usually at least about 10,000 Da. In the poly(amino acid) category, the poly(amino acids) of interest may generally have a molecular weight from about 5,000 Da to about 5,000,000 Da, more usually from about 20,000 Da to 1,000,000 Da; among the hormones of interest, the molecular weights will usually range from about 5,000 Da to 60,000 Da.

In some embodiments, the monoepitopic ligand analytes generally have a molecular weight of from about 100 to 2,000 Da, more usually from 125 to 1,000 Da.

A wide variety of proteins may be considered as to the family of proteins having similar structural features, proteins having particular biological functions, proteins related to specific microorganisms, particularly disease causing microorganisms, etc. Such proteins include, for example, immunoglobulins, cytokines, enzymes, hormones, cancer antigens, nutritional markers, tissue specific antigens, etc.

In some embodiments, the analyte is a protein. In some embodiments, the analyte is a protein, e.g., an enzyme (e.g., a hemolysin, a protease, a phospholipase), a soluble protein, an exotoxin. In some embodiments, the analyte is a fragment of a protein, a peptide, or an antigen. In some embodiments, the analyte is a peptide of at least 5 amino acids (e.g., at least 6, at least 7, at least 8, at least 9, at least 10, at least 25, at least, 50, or at least 100 amino acids). Exemplary lengths include 6, 7, 8, 9, 10, 11, 12, 13, 14, 15, 16, 17, 18, 19, 20, 21, 22, 23, 24, 25, 26, 27, 28, 29, 30, 50, 75, or 100 amino acids. Exemplary classes of protein analytes include, but are not limited to: protamines, histones, albumins, globulins, scleroproteins, phosphoproteins, mucoproteins, chromoproteins, lipoproteins, nucleoproteins, glycoproteins, T-cell receptors, proteoglycans, cell surface receptors, membrane-anchored proteins, transmembrane proteins, secreted proteins, HLA, and unclassified proteins.

In some embodiments, the analyte is an affimer (see, e.g., Tiede et al. (2017) *eLife* 6: e24903, which is expressly incorporated herein by reference).

Exemplary analytes include: Prealbumin, Albumin, $\alpha_1$-Lipoprotein, $\alpha_1$-Antitrypsin, $\alpha_1$-Glycoprotein, Transcortin, 4.6S-Postalbumin, $\alpha_1$-glycoprotein, $\alpha_{1X}$-Glycoprotein, Thyroxin-binding globulin, Inter-$\alpha$-trypsin-inhibitor, Gc-globulin (Gc 1-1, Gc 2-1, Gc 2-2), Haptoglobin (Hp 1-1, Hp 2-1, Hp 2-2), Ceruloplasmin, Cholinesterase, $\alpha_2$-Lipoprotein(s), Myoglobin, C-Reactive Protein, $\alpha_2$-Macroglobulin, $\alpha_2$-HS-glycoprotein, Zn-$\alpha_2$-glycoprotein, $\alpha$2-Neuramino-glycoprotein, Erythropoietin, $\beta$-lipoprotein, Transferrin, Hemopexin, Fibrinogen, Plasminogen, $\beta_2$-glycoprotein I, $\beta_2$-glycoprotein II, Immunoglobulin G (IgG) or γG-globulin, Immunoglobulin A (IgA) or γA-globulin, Immunoglobulin M (IgM) or γM-globulin, Immunoglobulin D (IgD) or γD-Globulin (γD), Immunoglobulin E (IgE) or γE-Globulin (γE), Free κ and λ light chains, and Complement factors: C'1, (C'1q, C'1r, C'1s, C'2, C'3 (β₁A, α₂D), C'4, C'5, C'6, C'7, C'8, C'9.

Additional examples of analytes include tumor necrosis factor-α (TNFα), interleukin-12 (IL-12), IL-23, IL-6, α2β1 integrin, α1β1 integrin, α4β7 integrin, integrin α4β1 (VLA-4), E-selectin, ICAM-1, α5β1 integrin, α4β1 integrin, VLA-4, α2β1 integrin, α5β3 integrin, α5β5 integrin, αIIbβ3 integrin, MAdCAM-1, SMAD7, JAK1, JAK2, JAK3, TYK-2, CHST15, IL-1, IL-1α, IL-1β, IL-18, IL-36α, IL-36β, IL-36K, IL-38, IL-33, IL-13, CD40L, CD40, CD3K, CD3δ, CD3ε, CD3ζ, TCR, TCRα, TCRβ, TCRδ, TCRK, CD14, CD20, CD25, IL-2, IL-2B chain, IL-2 K chain, CD28, CD80, CD86, CD49, MMP1, CD89, IgA, CXCL10, CCL11, an ELR chemokine, CCR2, CCR9, CXCR3, CCR3, CCR5, CCL2, CCL8, CCL16, CCL25, CXCR1m CXCR2m CXCL1, CXCL2, CXCL3, CXCL4, CXCL5, CXCL6, CXCL7, and CXCL8, and a nucleic acid (e.g., mRNA) encoding any of the same.

In some embodiments, the analyte is a blood clotting factor. Exemplary blood clotting factors include, but are not limited to:

| International designation | Name |
|---|---|
| I | Fibrinogen |
| II | Prothrombin |
| IIa | Thrombin |
| III | Tissue thromboplastin |
| V and VI | Proaccelerin, accelerator globulin |
| VII | Proconvertin |
| VIII | Antihemophilic globulin (AHG) |
| IX | Christmas factor plasma thromboplastin component (PTC) |
| X | Stuart-Prower factor, autoprothrombin III |
| XI | Plasma thromboplastin antecedent (PTA) |
| XII | Hagemann factor |
| XIII | Fibrin-stabilizing factor |

In some embodiments, the analyte is a hormone. Exemplary hormones include, but are not limited to: Peptide and Protein Hormones, Parathyroid hormone, (parathromone), Thyrocalcitonin, Insulin, Glucagon, Relaxin, Erythropoietin, Melanotropin (melancyte-stimulating hormone; intermedin), Somatotropin (growth hormone), Corticotropin (adrenocorticotropic hormone), Thyrotropin, Follicle-stimulating hormone, Luteinizing hormone (interstitial cell-stimulating hormone), Luteomammotropic hormone (luteotropin, prolactin), Gonadotropin (chorionic gonadotropin), Secretin, Gastrin, Angiotensin I and II, Bradykinin, and Human placental lactogen, thyroxine, cortisol, triiodothyronine, testosterone, estradiol, estrone, progestrone, luteinizing hormone-releasing hormone (LHRH), and immunosuppressants such as cyclosporin, FK506, mycophenolic acid, and so forth.

In some embodiments, the analyte is a peptide hormone (e.g., a peptide hormone from the neurohypophysis). Exemplary peptide hormones from the neurohypophysis include, but are not limited to: Oxytocin, Vasopressin, and releasing factors (RF) (e.g., corticotropin releasing factor (CRF), luteinizing hormone releasing factor (LRF), thyrotropin releasing factor (TRF), Somatotropin-RF, growth hormone releasing factor (GRF), follicle stimulating hormone-releasing factor (FSH-RF), prolactin inhibiting factor (PIF), and melanocyte stimulating hormone inhibiting factor (MIF)).

In some embodiments, the analyte is a cytokine or a chemokine. Exemplary cytokines include, but are not limited to: interleukin-1 (IL-1), interleukin-2 (IL-2), interleukin-6 (IL-6), epidermal growth factor (EGF), tumor necrosis factor (TNF, e.g., TNF-α or TNF-β), and nerve growth factor (NGF).

In some embodiments, the analyte is a cancer antigen. Exemplary cancer antigens include, but are not limited to: prostate-specific antigen (PSA), carcinoembryonic antigen (CEA), α-fetoprotein, Acid phosphatase, CA19.9, and CA125.

In some embodiments, the analyte is a tissue-specific antigen. Exemplary tissue specific antigens include, but are not limited to: alkaline phosphatase, myoglobin, CPK-MB, calcitonin, and myelin basic protein.

In some embodiments, the analyte is a mucopolysaccharide or a polysaccharide.

In some embodiments, the analyte is a microorganism, or a molecule derived from or produced by a microorganism (e.g., a bacteria, a virus, prion, or a protozoan). For example, in some embodiments, the analyte is a molecule (e.g., an protein or a nucleic acid) that is specific for a particular microbial genus, species, or strain (e.g., a specific bacterial genus, species, or strain). In some embodiments, the microorganism is pathogenic (i.e., causes disease). In some embodiments, the microorganism is non-pathogenic (e.g., a commensal microorganism). Exemplary microorganisms include, but are not limited to:

| | |
|---|---|
| Corynebacteria | |
| *Corynebacterium diphtheria* | |
| Pneumococci | |
| *Diplococcus pneumoniae* | |
| Streptococci | |
| *Streptococcus pyrogenes* | |
| *Streptococcus salivarus* | |
| Staphylococci | |
| *Staphylococcus aureus* | |
| *Staphylococcus albus* | |
| Neisseria | |
| *Neisseria meningitidis* | |
| *Neisseria gonorrhea* | |
| Enterobacteriaciae | |
| *Escherichia coli* | |
| *Aerobacter aerogenes* | The coliform |
| *Klebsiella pneumoniae* | bacteria |
| *Salmonella typhosa* | |
| *Salmonella choleraesuis* | The Salmonellae |
| *Salmonella typhimurium* | |
| *Shigella dysenteria* | |
| *Shigella schmitzii* | |
| *Shigella arabinotarda* | |
| | The Shigellae |
| *Shigella flexneri* | |
| *Shigella boydii* | |
| *Shigella sonnei* | |
| Other enteric bacilli | |
| *Proteus vulgaris* | |
| *Proteus mirabilis* | Proteus species |
| *Proteus morgani* | |
| *Pseudomonas aeruginosa* | |
| *Alcaligenes faecalis* | |
| *Vibrio cholerae* | |

-continued

| | |
|---|---|
| Hemophilus-Bordetella group | *Rhizopus oryzae* |
| Hemophilus influenza, *H. ducryi* | *Rhizopus arrhizua* |
| | Phycomycetes |
| *Hemophilus hemophilus* | *Rhizopus nigricans* |
| *Hemophilus aegypticus* | *Sporotrichum schenkii* |
| *Hemophilus parainfluenza* | *Flonsecaea pedrosoi* |
| *Bordetella pertussis* | *Fonsecacea compact* |
| Pasteurellae | *Fonsecacea dermatidis* |
| *Pasteurella pestis* | *Cladosporium carrionii* |
| *Pasteurella tulareusis* | *Phialophora verrucosa* |
| Brucellae | *Aspergillus nidulans* |
| *Brucella melltensis* | *Madurella mycetomi* |
| *Brucella abortus* | *Madurella grisea* |
| *Brucella suis* | *Allescheria boydii* |
| Aerobic Spore-forming Bacilli | *Phialophora jeanselmei* |
| *Bacillus anthracis* | *Microsporum gypseum* |
| *Bacillus subtilis* | *Trichophyton mentagrophytes* |
| *Bacillus megaterium* | *Keratinomyces ajelloi* |
| *Bacillus cereus* | *Microsporum canis* |
| Anaerobic Spore-forming Bacilli | *Trichophyton rubrum* |
| *Clostridium botulinum* | *Microsporum adouini* |
| *Clostridium tetani* | Viruses |
| *Clostridium perfringens* | Adenoviruses |
| *Clostridium novyi* | Herpes Viruses |
| *Clostridium septicum* | *Herpes simplex* |
| *Clostridium histoyticum* | Varicella (Chicken pox) |
| *Clostridium tertium* | Herpes Zoster (Shingles) |
| *Clostridium bifermentans* | Virus B |
| *Clostridium sporogenes* | Cytomegalovirus |
| Mycobacteria | Pox Viruses |
| *Mycobacterium tuberculosis* hominis | Variola (smallpox) |
| *Mycobacterium bovis* | Vaccinia |
| *Mycobacterium avium* | *Poxvirus bovis* |
| *Mycobacterium leprae* | Paravaccinia |
| *Mycobacterium paratuberculosis* | *Molluscum contagiosum* |
| Actinomycetes (fungus-ike bacteria) | Picornaviruses |
| *Actinomyces Isaeli* | Poliovirus |
| *Actinomyces bovis* | Coxsackievirus |
| *Actinomyces naeslundii* | Echoviruses |
| *Nocardia asteroides* | Rhinoviruses |
| *Nocardia brasiliensis* | Myxoviruses |
| The Spirochetes | Influenza(A, B, and C) |
| *Treponema pallidum* | Parainfluenza (1-4) |
| *Treponema pertenue* | Mumps Virus |
| *Spirillum minus* | |
| *Streptobacillus monoiliformis* | Newcastle Disease Virus |
| *Treponema carateum* | Measles Virus |
| *Borrelia recurrentis* | Rinderpest Virus |
| *Leptospira icterohemorrhagiae* | Canine Distemper Virus |
| *Leptospira canicola* | Respiratory Syncytial Virus |
| Trypanasomes | Rubella Virus |
| Mycoplasmas | Arboviruses |
| *Mycoplasma pneumoniae* | |
| Other pathogens | Eastern Equine Encephalitis Virus |
| *Listeria monocytogenes* | Western Equine Encephalitis Virus |
| *Erysipeothrix rhusiopathiae* | Sindbis Virus |
| *Streptobacillus moniliformis* | Chikugunya Virus |
| *Donvania granulomatis* | Semliki Forest Virus |
| *Entamoeba histolytica* | Mayora Virus |
| *Plasmodium falciparum* | St. Louis Encephalitis |
| *Plasmodium japonicum* | California Encephalitis Virus |
| *Bartonella bacilliformis* | Colorado Tick Fever Virus |
| Rickettsia (bacteria-like parasites) | Yellow Fever Virus |
| *Rickettsia prowazekii* | Dengue Virus |
| *Rickettsia mooseri* | Reoviruses |
| *Rickettsia rickettsii* | Reovirus Types 1-3 |
| *Rickettsia conori* | Retroviruses |
| *Rickettsia australis* | Human Immunodeficiency Viruses I and II (HTLV) |
| *Rickettsia sibiricus* | |
| *Rickettsia akari* | Human T-cell Lymphotrophic Virus I & II (HIV) |
| *Rickettsia tsutsugamushi* | |
| *Rickettsia burnetti* | Hepatitis |
| *Rickettsia quintana* | Hepatitis A Virus |
| Chlamydia (unclassifiable parasites bacterial/viral) | Hepatitis B Virus |
| | Hepatitis C Virus |
| Chlamydia agents (naming uncertain) | Tumor Viruses |
| *Chlamydia trachomatis* | |
| Fungi | Rauscher Leukemia Virus |
| *Cryptococcus neoformans* | Gross Virus |
| *Blastomyces dermatidis* | Maloney Leukemia Virus |
| *Histoplasma capsulatum* | |
| *Coccidioides immitis* | Human Papilloma Virus |
| *Paracoccidioides brasliensis* | |
| *Candida albicans* | |
| *Aspergillus fumigatus* | |
| *Mucor corymbifer* | |
| (*Absidia corymbifera*) | |

In some embodiments, the analyte is a bacterium. Exemplary bacteria include, but are not limited to: *Escherichia coli* (or *E. coli*), *Bacillus anthracis, Bacillus cereus, Clostridium botulinum, Clostridium difficile, Yersinia pestis, Yersinia enterocolitica, Francisella tularensis, Brucella species, Clostridium perfringens, Burkholderia mallei, Burkholderia pseudomallei, Staphylococcus species, Mycobacterium species,* Group A *Streptococcus,* Group B *Streptococcus, Streptococcus pneumoniae, Helicobacter pylori, Salmonella enteritidis, Mycoplasma hominis, Mycoplasma orale, Mycoplasma salivarium, Mycoplasma fermentans, Mycoplasma pneumoniae, Mycobacterium bovis, Mycobacterium tuberculosis, Mycobacterium avium, Mycobacterium leprae, Rickettsia rickettsii, Rickettsia akari, Rickettsia prowazekii, Rickettsia canada, Bacillus subtilis, Bacillus subtilis niger, Bacillus thuringiensis, Coxiella burnetti, Faecalibacterium prausnitzii* (also known as *Bacteroides praussnitzii*), *Roseburia hominis, Eubacterium rectale, Dialister invisus, Ruminococcus albus, Ruminococcus callidus,* and *Ruminococcus bromii*. Additional exemplary bacteria include bacteria of the phyla Firmicutes (e.g., *Clostridium* clusters XIVa and IV), bacteria of the phyla Bacteroidetes (e.g., *Bacteroides fragilis* or *Bacteroides vulgatus*), and bacteria of the phyla Actinobacteria (e.g., Coriobacteriaceae spp. or *Bifidobacterium adolescentis*). Bacteria of the *Clostridium* cluster XIVa includes species belonging to, for example, the *Clostridium, Ruminococcus, Lachnospira, Roseburia, Eubacterium, Coprococcus, Dorea,* and *Butyrivibrio* genera. Bacteria of the *Clostridium* cluster IV includes species belonging to, for example, the *Clostridium, Ruminococcus, Eubacterium* and *Anaerofilum* genera. In some embodiments, the analyte is *Candida,* e.g., *Candida albicans.* In some embodiments, the analyte is a byproduct from a bacterium or other microorganism, e.g., helminth ova, enterotoxin (*Clostridium difficile* toxin A; TcdA) or cytotoxin (*Clostridium difficile* toxin B; TcdB).

In some embodiments, the bacterium is a pathogenic bacterium. Non-limiting examples of pathogenic bacteria belong to the genera *Bacillus, Bordetella, Borrelia, Brucella, Campylobacter, Chlamydia, Chlamydophila, Clostridium, Corynebacterium, Enterobacter, Enterococcus, Escherichia, Francisella, Haemophilus, Helicobacter, Legionella, Leptospira, Listeria, Mycobacterium, Mycoplasma, Neisseria, Pseudomonas, Rickettsia, Salmonella, Shigella, Staphylococcus, Streptococcus, Treponema, Vibrio,* and *Yersinia.* Non-limiting examples of specific pathogenic bacterial species include a strain of *Bacillus anthracis,* a strain of a strain of *Bordetella pertussis,* a strain of a strain of *Borrelia burgdorferi,* a strain of a strain of *Brucella abortus,* a strain of a strain of *Brucella canis,* a strain of a strain of *Brucella melitensis,* a strain of a strain of *Brucella suis,* a strain of a strain of *Campylobacter jejuni,* a strain of *Chlamydia pneumoniae,* a strain of *Chlamydia trachomatis,* a strain of *Chlamydophila psittaci,* a strain of *Clostridium botulinum,* a strain of *Clostridium difficile,* a strain of *Clostridium perfringens*, a strain of *Clostridium tetani*, a strain of *Corynebacterium diphtheria*, a strain of *Enterobacter* sakazakii, a strain of *Enterococcus faecalis*, a strain of *Enterococcus faecium*, a strain of *Escherichia coli* (e.g., *E. coli* 0157 H7), a strain of *Francisella tularensis*, a strain of *Haemophilus* influenza, a strain of *Helicobacter pylori*, a strain of *Legionella pneumophila*, a strain of Leptospira interrogans, a strain of *Listeria monocytogenes*, a strain of *Mycobacterium leprae*, a strain of *Mycobacterium tuberculosis*, a strain of *Mycobacterium ulcerans*, a strain of *Mycoplasma* pneumonia, a strain of *Neisseria gonorrhoeae*, a strain of *Neisseria meningitides*, a strain of *Pseudomonas aeruginosa*, a strain of *Rickettsia rickettsia*, a strain of *Salmonella typhi* and *Salmonella typhimurium*, a strain of *Shigella sonnei*, a strain of *Staphylococcus aureus*, a strain of *Staphylococcus epidermidis*, a strain of *Staphylococcus saprophyticus*, a strain of *Streptococcus agalactiae*, a strain of *Streptococcus pneumonia*, a strain of *Streptococcus pyogenes*, a strain of *Treponema pallidum*, a strain of *Vibrio cholera*, a strain of *Yersinia enterocolitica*, and, a strain of *Yersinia pestis*.

In some embodiments, the bacterium is a commensal bacterium (e.g., a probiotic). In some embodiments, the bacterium has been previously administered to a subject, e.g., as a live biotherapeutic agent. Exemplary commensal bacteria include, but are not limited to, *Faecalibacterium prausnitzii* (also referred to as *Bacteroides praussnitzii*), *Roseburia hominis*, *Eubacterium rectale*, *Dialister invisus*, *Ruminococcus albus*, *Ruminococcus* gnavus, *Ruminococcus* torques, *Ruminococcus callidus*, and *Ruminococcus bromii*.

In some embodiments, the analyte is a virus. In some embodiments, the virus is a pathogenic virus. Non-limiting examples of pathogenic viruses belong to the families Adenoviridae, Picornaviridae, Herpesviridae, Hepadnaviridae, Flaviviridae, Retroviridae, Orthomyxoviridae, Paramyxoviridae, Papovaviridae, Polyomavirus, Rhabdoviridae, and Togaviridac.

In some embodiments, the analyte is a fungus. In some embodiments, the fungi is a pathogenic fungus. Non-limiting examples of pathogenic fungi belong to the genera *Asperfillus*, *Canidia*, *Cryptococcus*, *Histoplasma*, *Pneumocystis*, and *Stachybotrys*. Non-limiting examples of specific pathogenic fungi species include a strain of *Aspergillus clavatus*, *Aspergillus fumigatus*, *Aspergillus flavus*, *Canidia albicans*, *Cryptococcus albidus*, *Cryptococcus gattii*, *Cryptococcus laurentii*, *Cryptococcus neoformans*, *Histoplasma capsulatum*, *Pneumocystis jirovecii*, *Pneumocystis carinii*, and *Stachybotrys chartarum*.

In some embodiments, the analyte is a protozoan. In some embodiments, the analyte is a pathogenic protozoan. Non-limiting examples of pathogenic protozoa belong to the genera *Acanthamoeba*, *Balamuthia*, *Cryptosporidium*, *Dientamoeba*, *Endolimax*, *Entamoeba*, *Giardia*, *Iodamoeba*, *Leishmania*, *Naegleria*, *Plasmodium*, *Sappinia*, *Toxoplasma*, *Trichomonas*, and *Trypanosoma*. Non-limiting examples of specific pathogenic protozoa species include a strain of *Acanthamoeba* spp., *Balamuthia mandrillaris*, *Cryptosporidium canis*, *Cryptosporidium felis*, *Cryptosporidium hominis*, *Cryptosporidium meleagridis*, *Cryptosporidium muris*, *Cryptosporidium parvum*, *Dientamoeba fragilis*, *Endolimax nana*, *Entamoeba dispar*, *Entamoeba hartmanni*, *Entamoeba histolytica*, *Entamoeba coli*, *Entamoeba moshkovskii*, *Giardia lamblia*, *Iodamoeba butschlii*, *Leishmania aethiopica*, *Leishmania braziliensis*, *Leishmania chagasi*, *Leishmania donovani*, *Leishmania infantum*, *Leishmania major*, *Leishmania mexicana*, *Leishmania tropica*, *Naegleria fowleri*, *Plasmodium falciparum*, *Plasmodium knowlesi*, *Plasmodium malariae*, *Plasmodium ovale*, *Plasmodium vivax*, *Sappinia diploidea*, *Toxoplasma gondii*, *Trichomonas vaginalis*, *Trypanosoma brucei*, and *Trypanosoma cruzi*.

In some embodiments, the analyte is secreted by or expressed on the cell surface of a microorganism (e.g., a bacterium, a colonic bacterium, a viable bacterium, a dead bacterium, a parasite (e.g., *Giardia lamblia*, *Cryptosporidium*, *Cystoisosporiasis belli*, and *Balantidium coli*), a virus (e.g., a herpes virus, a cytomegalovirus, a herpes simplex virus, an Epstein-Barr virus, a human papilloma virus, a rotavirus, a human herpesvirus-8; Goodgame (1999) Curr. Gastroenterol. Rep. 1 (4): 292-300). In some embodiments, the analyte is secreted by or expressed on the cell surface of a Gram-negative bacterium (e.g., *E. coli*, *Helicobacter pylori*). In some embodiments, the analyte is secreted by or expressed on the cell surface (e.g., a bacterial surface epitope) of a Gram-positive bacterium (e.g., *Staphylococcus aureus*, *Clostridium botulinum*, *Clostridium difficile*).

In some embodiments, the analyte is a molecule expressed on the surface of a bacterial cell (e.g., a bacterial cell surface protein). In some embodiments, the analyte is a bacterial toxin (e.g., TcdA and/or TcdB from *Clostridium difficile*). In some embodiments, the analyte is CFA/I fimbriae, flagella, lipopolysaccharide (LPS), lipoteichoic acid, or a peptidoglycan. Non-limiting examples of bacterium that may express an analyte that can be detected using any of the devices and methods described herein include: *Bacillus anthracis*, *Bacillus cereus*, *Clostridium botulinum*, *Clostridium difficile*, *Escherichia coli*, *Yersinia pestis*, *Yersinia enterocolitica*, *Francisella tularensis*, *Brucella species*, *Clostridium perfringens*, *Burkholderia mallei*, *Burkholderia pseudomallei*, *Helicobacter pylori*, *Staphylococcus species*, *Mycobacterium species*, Group A *Streptococcus*, Group B *Streptococcus*, *Streptococcus pneumoniae*, *Francisella tularensis*, *Salmonella enteritidis*, *Mycoplasma hominis*, *Mycoplasma orale*, *Mycoplasma salivarium*, *Mycoplasma fermentans*, *Mycoplasma pneumoniae*, *Mycobacterium bovis*, *Mycobacterium tuberculosis*, *Mycobacterium avium*, *Mycobacterium leprae*, *Rickettsia rickettsii*, *Rickettsia akari*, *Rickettsia prowazekii*, *Rickettsia canada*, *Bacillus subtilis*, *Bacillus subtilis niger*, *Bacillus thuringiensis*, *Coxiella bumetti*, *Candida albicans*, *Bacteroides fragilis*, *Leptospira interrogans*, *Listeria monocytogenes*, *Pasteurella multocida*, *Salmonella typhi*, *Salmonella typhimurium*, *Shigella dysenteriae*, *Shigella flexneria*, *Shigella sonnei*, *Vibrio cholera*, and *Vibrio parahaemolyticus*.

In some embodiments, the analyte is a byproduct from a bacterium or another microorganism, e.g., helminth ova, enterotoxin (*Clostridium difficile* toxin A; TcdA), cytotoxin (*Clostridium difficile* toxin B; TcdB), ammonia. In some embodiments, the analyte is an antigen from a microorganism (e.g., a bacteria, virus, prion, fungus, protozoan or a parasite).

In some embodiments, the analytes include drugs, metabolites, pesticides, pollutants, and the like. Included among drugs of interest are the alkaloids. Among the alkaloids are morphine alkaloids, which includes morphine, codeine, heroin, dextromethorphan, their derivatives and metabolites; cocaine alkaloids, which include cocaine and benzyl ecgonine, their derivatives and metabolites; ergot alkaloids, which include the diethylamide of lysergic acid; steroid alkaloids; iminazoyl alkaloids; quinazoline alkaloids; isoquinoline alkaloids; quinoline alkaloids, which include quinine and quinidine; diterpene alkaloids, their derivatives and metabolites.

In some embodiments, the analyte is a steroid selected from the estrogens, androgens, andreocortical steroids, bile acids, cardiotonic glycosides and aglycones, which includes digoxin and digoxigenin, saponins and sapogenins, their derivatives and metabolites. Also included are the steroid mimetic substances, such as diethylstilbestrol.

In some embodiments, the analyte is a bile acid. In some embodiments, the presence, absence, and/or a specific level of one or more bile acids in the GI tract of a subject is indicative of a condition or disease state (e.g., a GI disorder and/or a non-GI disorder (e.g., a systemic disorder). For example, in some embodiments, the compositions and methods described herein may be used to detect and/or quantify a bile acid in the GI tract of the subject to diagnose a condition such as bile acid malabsorption (also known as bile acid diarrhea). In some embodiments, the analyte is a metabolite in the serotonin, tryptophan and/or kynurenine pathways, including but not limited to, serotonin (5-HT), 5-hydroxyindole acetic acid (5-HIAA), 5-hydroxytryptophan (5-HTP), kynurenine (K), kynurenic acid (KA), 3-hydroxykynurenine (3-HK), 3-hydroxyanthranilic acid (3-HAA), quinolinic acid, anthranilic acid, and combinations thereof. 5-HT is a molecule that plays a role in the regulation of gastrointestinal motility, secretion, and sensation. Imbalances in the levels of 5-HT are associated with several diseases including inflammatory bowel syndrome (IBS), autism, gastric ulcer formation, non-cardiac chest pain, and functional dyspepsia (see, e.g., Faure et al. (2010) *Gastroenterology* 139 (1): 249-58 and Muller et al. (2016) *Neuroscience* 321:24-41, and International Publication No. WO 2014/188377, each of which are incorporated herein by reference). Conversion of metabolites within the serotonin, tryptophan and/or kynurenine pathways affects the levels of 5-HT in a subject. Therefore, measuring the levels of one or more of the metabolites in this pathway may be used for the diagnosis, management and treatment of a disease or disorder associated with 5-HT imbalance including but not limited to IBS, autism, carcinoid syndrome, depression, hypertension, Alzheimer's disease, constipation, migraine, and serotonin syndrome. One or more analytes in the serotonin, tryptophan and/or kynurenine pathways can be detected and/or quantitated using, for example, methods and analyte-binding agents that bind to these metabolites including, e.g., antibodies, known in the art (see, e.g., International Publication No. WO2014/188377, the entire contents of which are expressly incorporated herein by reference).

In some embodiments, the analyte is a lactam having from 5 to 6 annular members selected from barbituates, e.g., phenobarbital and secobarbital, diphenylhydantoin, primidone, ethosuximide, and metabolites thereof.

In some embodiments, the analyte is an aminoalkylbenzene, with alkyl of from 2 to 3 carbon atoms, selected from the amphetamines; catecholamines, which includes ephedrine, L-dopa, epinephrine; narceine; papaverine; and metabolites thereof.

In some embodiments, the analyte is a benzheterocyclic selected from oxazepam, chlorpromazine, tegretol, their derivatives and metabolites, the heterocyclic rings being azepines, diazepines and phenothiazines.

In some embodiments, the analyte is a purine selected from theophylline, caffeine, their metabolites and derivatives.

In some embodiments, the analyte is marijuana, cannabinol or tetrahydrocannabinol.

In some embodiments, the analyte is a vitamin such as vitamin A, vitamin B, e.g. vitamin $B_{12}$, vitamin C, vitamin D, vitamin E and vitamin K, folic acid, thiamine.

In some embodiments, the analyte is selected from prostaglandins, which differ by the degree and sites of hydroxylation and unsaturation.

In some embodiments, the analyte is a tricyclic antidepressant selected from imipramine, dismethylimipramine, amitriptyline, nortriptyline, protriptyline, trimipramine, chlomipramine, doxepine, and desmethyldoxepin.

In some embodiments, the analyte is selected from antineoplastics, including methotrexate.

In some embodiments, the analyte is an antibiotic as described herein, including, but not limited to, penicillin, chloromycetin, actinomycetin, tetracycline, terramycin, and metabolites and derivatives.

In some embodiments, the analyte is a nucleoside and nucleotide selected from ATP, NAD, FMN, adenosine, guanosine, thymidine, and cytidine with their appropriate sugar and phosphate substituents.

In some embodiments, the analyte is selected from methadone, meprobamate, serotonin, meperidine, lidocaine, procainamide, acetylprocainamide, propranolol, griseofulvin, valproic acid, butyrophenones, antihistamines, chloramphenicol, anticholinergic drugs, such as atropine, their metabolites and derivatives.

In some embodiments, the analyte is a metabolite related to a diseased state. Such metabolites include, but are not limited to spermine, galactose, phenylpyruvic acid, and porphyrin Type 1.

In some embodiments, the analyte is an aminoglycoside, such as gentamicin, kanamicin, tobramycin, or amikacin.

In some embodiments, the analyte is a pesticide. Among pesticides of interest are polyhalogenated biphenyls, phosphate esters, thiophosphates, carbamates, polyhalogenated sulfenamides, their metabolites and derivatives.

In some embodiments, the analyte has a molecular weight of about 500 Da to about 1,000,000 Da (e.g., about 500 to about 500,000 Da, about 1,000 to about 100,000 Da).

In some embodiments, the analyte is a receptor, with a molecular weight ranging from 10,000 to $2 \times 10^8$ Da, more usually from 10,000 to $10^6$ Da. For immunoglobulins, IgA, IgG, IgE and IgM, the molecular weights will generally vary from about 160,000 Da to about $10^6$ Da. Enzymes will normally range in molecular weight from about 10,000 Da to about 1,000,000 Da. Natural receptors vary widely, generally having a molecular weight of at least about 25,000 Da and may be $10^6$ or higher Da, including such materials as avidin, DNA, RNA, thyroxine binding globulin, thyroxine binding prealbumin, transcortin, etc.

In some embodiments, the term "analyte" further includes polynucleotide analytes such as those polynucleotides defined below. These include m-RNA, r-RNA, t-RNA, DNA, DNA-RNA duplexes, etc. The term analyte also includes polynucleotide-binding agents, such as, for example, restriction enzymes, transcription factors, transcription activators, transcription repressors, nucleases, polymerases, histones, DNA repair enzymes, intercalating gagents, chemotherapeutic agents, and the like.

In some embodiments, the analyte may be a molecule found directly in a sample such as a body fluid from a host. The sample can be examined directly or may be pretreated to render the analyte more readily detectable. Furthermore, the analyte of interest may be determined by detecting an agent probative of the analyte of interest (i.e., an analyte-binding agent), such as a specific binding pair member complementary to the analyte of interest, whose presence will be detected only when the analyte of interest is present in a sample. Thus, the agent probative of the analyte becomes the analyte that is detected in an assay.

In some embodiments, the analyte a nucleic acid (e.g., a bacterial DNA molecule or a bacterial RNA molecule (e.g., a bacterial tRNA, a transfer-messenger RNA (tmRNA)). See, e.g., Sjostrom et al. (2015) Scientific Reports 5:15329; Ghosal (2017) Microbial Pathogenesis 104:161-163; Shen et al. (2012) Cell Host Microbe. 12 (4): 509-520.

In some embodiments, the analyte is a component of an outer membrane vesicle (OMV) (e.g., an OmpU protein, Elluri et al. (2014) PloS One 9: e106731). See, e.g., Kulp and Kuehn (2010) Annual Review of microbiology 64:163-184; Berleman and Auer (2013) Environmental microbiology 15:347-354; Wai et al. (1995) Microbiology and immunology 39:451-456; Lindmark et al. (2009) BMC microbiology 9:220; Sjostrom et al. (2015) Scientific Reports 5:15329.

In some embodiments, the analyte is G-CSF, which can stimulate the bone marrow to produce granulocytes and stem cells and release them into the bloodstream.

In some embodiments, the analyte is an enzyme such as glutathione S-transferase. For example, the ingestible device can include P28GST, a 28 kDa helminth protein from Schistosoma with potent immunogenic and antioxidant properties. P28GST prevents intestinal inflammation in experimental colitis through a Th2-type response with mucosal eosinophils and can be recombinantly produced (e.g., in S. cerevisiae). See, for example, U.S. Pat. No. 9,593,313, Driss et al., Mucosal Immunology, 2016 9, 322-335; and Capron et al., Gastroenterology, 146 (5): S-638.

In some embodiments, the analyte is a metabolite in the serotonin, tryptophan and/or kynurenine pathways, including but not limited to, serotonin (5-HT), 5-hydroxyindole acetic acid (5-HIAA), 5-hydroxytryptophan (5-HTP), kynurenine (K), kynurenic acid (KA), 3-hydroxykynurenine (3-HK), 3-hydroxyanthranilic acid (3-HAA), quinolinic acid, anthranilic acid, and combinations thereof.

In some embodiments, analytes are therapeutic agents or drugs. In some embodiments, analytes are biomarkers. The therapeutic agents disclosed herein are can also be analytes. Examples of biomarkers are provided herein.

In some embodiments, analytes are therapeutic agents, fragments thereof, and metabolites thereof (e.g., antibiotics). In some embodiments, the analytes are antibodies. In some embodiments, the analytes are antibiotics. Additional exemplary analytes (e.g., antibodies and antibiotics) are provided below.

Antibodies

In some embodiments, the analyte or the analyte-binding agent is an antibody. In some embodiments, the antibody can be a humanized antibody, a chimeric antibody, a multivalent antibody, or a fragment thereof. In some embodiments, an antibody can be a scFv-Fc (Sokolowska-Wedzina et al., Mol. Cancer Res. 15 (8): 1040-1050, 2017), a VHH domain (Li et al., Immunol. Lett. 188:89-95, 2017), a VNAR domain (Hasler et al., Mol. Immunol. 75:28-37, 2016), a (scFv) 2, a minibody (Kim et al., PLOS One 10 (1): c113442, 2014), or a BiTE. In some embodiments, an antibody can be a DVD-Ig (Wu et al., Nat. Biotechnol. 25 (11): 1290-1297, 2007; WO 08/024188; WO 07/024715), and a dual-affinity re-targeting antibody (DART) (Tsai et al., Mol. Ther. Oncolytics 3:15024, 2016), a triomab (Chelius et al., MAbs 2 (3): 309-319, 2010), kih IgG with a common LC (Kontermann et al., Drug Discovery Today 20 (7): 838-847, 2015), a crossmab (Regula et al., EMBO Mol. Med. 9 (7): 985, 2017), an ortho-Fab IgG (Kontermann et al., Drug Discovery Today 20 (7): 838-847, 2015), a 2-in-1-IgG (Kontermann et al., Drug Discovery Today 20 (7): 838-847, 2015), IgG-scFv (Cheal et al., Mol. Cancer Ther. 13 (7): 1803-1812, 2014), scFv2-Fc (Natsume et al., J. Biochem. 140 (3): 359-368, 2006), a bi-nanobody (Kontermann et al., Drug Discovery Today 20 (7): 838-847, 2015), tanden antibody (Kontermann et al., Drug Discovery Today 20 (7): 838-847, 2015), a DART-Fc (Kontermann et al., Drug Discovery Today 20 (7): 838-847, 2015), a scFv-HSA-scFv (Kontermann et al., Drug Discovery Today 20 (7): 838-847, 2015), DNL-Fab3 (Kontermann et al., Drug Discovery Today 20 (7): 838-847, 2015), DAF (two-in-one or four-in-one), DutaMab, DT-IgG, knobs-in-holes common LC, knobs-in-holes assembly, charge pair antibody, Fab-arm exchange antibody, SEED-body, Triomab, LUZ-Y, Fcab, kλ-body, orthogonal Fab, DVD-IgG, IgG (H)-scFv, scFv-(H) lgG, IgG (L)-scFv, scFv-(L)-IgG, IgG (L,H)-Fc, IgG (H)-V, V (H)-IgG, IgG (L)-V, V (L)-IgG, KIH IgG-scFab, 2scFv-IgG, IgG-2scFv, scFv4-Ig, Zybody, DVI-IgG, nanobody (e.g., antibodies derived from Camelus bactriamus, Calelus dromaderius, or Lama paccos) (U.S. Pat. No. 5,759,808; Stijlemans et al., J. Biol. Chem. 279:1256-1261, 2004; Dumoulin et al., Nature 424: 783-788, 2003; and Pleschberger et al., Bioconjugate Chem. 14:440-448, 2003), nanobody-HSA, a diabody (e.g., Poljak, Structure 2 (12): 1121-1123, 1994; Hudson et al., J. Immunol. Methods 23 (1-2): 177-189, 1999), a TandAb (Reusch et al., mAbs 6 (3): 727-738, 2014), scDiabody (Cuesta et al., Trends in Biotechnol. 28 (7): 355-362, 2010), scDiabody-CH3 (Sanz et al., Trends in Immunol. 25 (2): 85-91, 2004), Diabody-CH3 (Guo et al.), Triple Body, miniantibody, minibody, TriBi minibody, scFv-CH3 KIH, Fab-scFv, scFv-CH-CL-scFv, F(ab')2-scFV2, scFv-KIH, Fab-scFv-Fc, tetravalent HCAb, scDiabody-Fc, diabody-Fc, tandem scFv-Fc, intrabody (Huston et al., Human Antibodies 10 (3-4): 127-142, 2001; Wheeler et al., Mol. Ther. 8 (3): 355-366, 2003; Stocks, Drug Discov. Today 9 (22): 960-966, 2004), dock and lock bispecific antibody, ImmTAC, HSAbody, scDiabody-HSA, tandem scFv, IgG-IgG, Cov-X-Body, and scFv1-PEG-scFv2.

In some embodiments, an antibody can be an IgNAR, a bispecific antibody (Milstein and Cuello, Nature 305:537-539, 1983; Suresh et al., Methods in Enzymology 121:210, 1986; WO 96/27011; Brennan et al., Science 229:81, 1985; Shalaby et al., J. Exp. Med. 175:217-225, 1992; Kolstelny et al., J. Immunol. 148 (5): 1547-1553, 1992; Hollinger et al., Proc. Natl. Acad. Sci. U.S.A. 90:6444-6448, 1993; Gruber et al., J. Immunol. 152:5368, 1994; Tutt et al., J. Immunol. 147:60, 1991), a bispecific diabody, a triabody (Schoonooghe et al., BMC Biotechnol. 9:70, 2009), a tetrabody, scFv-Fc knobs-into-holes, a scFv-Fc-scFv, a (Fab'scFv)₂, a V-IgG, a IvG-V, a dual V domain IgG, a heavy chain immunoglobulin or a camelid (Holt et al., Trends Biotechnol. 21 (11): 484-490, 2003), an intrabody, a monoclonal antibody (e.g., a human or humanized monoclonal antibody), a heteroconjugate antibody (e.g., U.S. Pat. No. 4,676,980), a linear antibody (Zapata et al., Protein Eng. 8 (10:1057-1062, 1995), a trispecific antibody (Tutt et al., J. Immunol. 147:60, 1991), a Fabs-in-Tandem immunoglobulin (WO 15/103072), or a humanized camelid antibody.

In some embodiments, the antibody binds specifically to a metabolite in the serotonin, tryptophan and/or kynurenine pathways, including but not limited to, serotonin (5-HT), 5-hydroxyindole acetic acid (5-HIAA), 5-hydroxytryptophan (5-HTP), kynurenine (K), kynurenic acid (KA), 3-hydroxykynurenine (3-HK), 3-hydroxyanthranilic acid (3-HAA), quinolinic acid, anthranilic acid. Exemplary antibodies that bind to metabolites in these pathways are disclosed, for example, in International Publication No. WO2014/188377, the entire contents of which are incorporated herein by reference.

In some embodiments, the antibody is specific for a particular genus, species, or strain of a microorganism, and may therefore be used for the detection, analysis and/or quantitation of the microorganism using the detection methods described below. In some embodiments, the antibody specifically binds to a surface-specific biomolecule (e.g., a pilus subunit or a flagella protein) present in a particular genus, species or strain of microorganism, and does not cross-react with other microorganisms. In some embodiments, these antibodies may be used in the methods described herein to diagnose a subject with a particular infection or disease, or to monitor an infection (e.g., during or after treatment). In some embodiments, the antibody specifically binds to an antigen present in a particular genera, species or strain of a microorganism. Exemplary antigens, the corresponding microorganism that can be detected, and the disease caused by the microorganism (in parentheticals) include: outer membrane protein A OmpA (*Acinetobacter baumannii*, Acinetobacter infections)); HIV p24 antigen, HIV envelope proteins (Gp120, Gp41, Gp160) (HIV (Human immunodeficiency virus), AIDS (Acquired immunodeficiency syndrome)); galactose-inhibitable adherence protein GIAP, 29 kDa antigen Eh29, GaVGalNAc lectin, protein CRT, 125 kDa immunodominant antigen, protein M17, adhesin ADH112, protein STIRP (*Entamoeba histolytica*, Amoebiasis); protective Antigen PA, edema factor EF, lethal factor LF, the S-layer homology proteins SLH (*Bacillus anthracis*, Anthrax); nucleocapsid protein NP, glycoprotein precursor GPC, glycoprotein GP1, glycoprotein GP2 (Junin virus, Argentine hemorrhagic fever); 41 kDa allergen Asp v13, allergen Asp f3, major conidial surface protein rodlet A, protease Pep1p, GPI-anchored protein Gel1p, GPI-anchored protein Crflp (*Aspergillus* genus, Aspergillosis); outer surface protein A OspA, outer surface protein OspB, outer surface protein OspC, decorin binding protein A DbpA, flagellar filament 41 kDa core protein Fla, basic membrane protein A precursor BmpA (Immunodominant antigen P39), outer surface 22 kDa lipoprotein precursor (antigen IPLA7), variable surface lipoprotein vlsE (*Borrelia* genus, Borrelia infection); OmpA-like transmembrane domain-containing protein Omp31, immunogenic 39-kDa protein M5 P39, 25 kDa outer-membrane immunogenic protein precursor Omp25, outer membrane protein MotY Omp16, conserved outer membrane protein D15, malate dehydrogenase Mdh, component of the Type-IV secretion system (T4SS) VirJ, lipoprotein of unknown function BAB1-0187 (*Brucella* genus, Brucellosis); major outer membrane protein PorA, flagellin FlaA, surface antigen CjaA, fibronectin binding protein CadF, aspartate/glutamate-binding ABC transporter protein PebIA, protein FspA1, protein FspA2 (*Campylobacter* genus, Campylobacteriosis); glycolytic enzyme enolase, secreted aspartyl proteinases SAP1-10, glycophosphatidylinositol (GPI)-linked cell wall protein, adhesin Als3p, cell surface hydrophobicity protein CSH (usually *Candida albicans* and other *Candida* species, Candidiasis); envelope glycoproteins (gB, gC, gE, gH, gl, gK, gL) (Varicella zoster virus (VZV), Chickenpox); major outer membrane protein MOMP, probable outer membrane protein PMPC, outer membrane complex protein B OmcB (*Chlamydia trachomatis*, Chlamydia); major outer membrane protein MOMP, outer membrane protein 2 Omp2, (*Chlamydophila pneumoniae*, Chlamydophila pneumoniae infection); outer membrane protein U Porin ompU, (*Vibrio cholerae*, Cholera); surface layer proteins SLPs, Cell Wall Protein CwpV, flagellar protein FliC, flagellar protein FliD) (*Clostridium difficile*, Clostridium difficile infection); acidic ribosomal protein P2 CpP2, mucin antigens Muc1, Muc2, Muc3 Muc4, Muc5, Muc6, Muc7, surface adherence protein CP20, surface adherence protein CP23, surface protein CP12, surface protein CP21, surface protein CP40, surface protein CP60, surface protein CP15, surface-associated glycopeptides gp40, surface-associated glycopeptides gp15, oocyst wall protein AB, profilin PRF, apyrase (*Cryptosporidium* genus, Cryptosporidiosis); membrane protein pp15, capsid-proximal tegument protein pp150 (Cytomegalovirus, Cytomegalovirus infection); prion protein (vCJD prion, Variant Creutzfeldt-Jakob disease (vCJD, nvCJD)); cyst wall proteins CWP1, CWP2, CWP3, variant surface protein VSP, VSP1, VSP2, VSP3, VSP4, VSP5, VSP6, 56 kDa antigen (Giardia intestinalis, Giardiasis); minor pilin-associated subunit pilC, major pilin subunit and variants pilE, pilS (*Neisseria gonorrhoeae*, Gonorrhea); outer membrane protein A OmpA, outer membrane protein C OmpC, outer membrane protein K17 OmpK17 (*Klebsiella granulomatis*, Granuloma inguinale (Donovanosis)); fibronectin-binding protein Sfb (*Streptococcus pyogenes*, Group A streptococcal infection); outer membrane protein P6 (*Haemophilus influenzae*, Haemophilus influenzae infection); integral membrane proteins, aggregation-prone proteins, O-antigen, toxin-antigens Stx2B, toxin-antigen Stx1B, adhesion-antigen fragment Int28, protein EspA, protein EspB, Intimin, protein Tir, protein IntC300, protein Eae (*Escherichia coli* 0157: H7, O111 and 0104: H4, Hemolytic-uremic syndrome (HUS)); hepatitis A surface antigen HBAg (Hepatitis A Virus, Hepatitis A); hepatitis B surface antigen HBsAg (Hepatitis B Virus, Hepatitis B); envelope glycoprotein E1 gp32 gp35, envelope glycoprotein F2 NS1 gp68 gp70, capsid protein C, (Hepatitis C Virus, Hepatitis C); type IV pilin PilE, outer membrane protein MIP, major outer membrane protein MompS (*Legionella pneumophila*, Legionellosis (Legionnaires' disease, Pontiac fever)); minor pilin-associated subunit pilC, major pilin subunit and variants pilE, pilS (*Neisseria meningitidis*, Meningococcal disease); adhesin P1, adhesion P30 (*Mycoplasma pneumoniae*, Mycoplasma pneumonia); F1 capsule antigen, outer membrane protease Pla, (*Yersinia pestis*, Plague); surface adhesin PsaA, cell wall surface anchored protein psrP (*Streptococcus pneumoniae*, Pneumococcal infection); flagellin FliC, invasion protein SipC, glycoprotein gp43, outer membrane protein LamB, outer membrane protein PagC, outer membrane protein TolC, outer membrane protein NmpC, outer membrane protein FadL, transport protein SadA (*Salmonella* genus, Salmonellosis); collagen adhesin Cna, fibronectin-binding protein A FnbA, secretory antigen SssA (*Staphylococcus* genus, Staphylococcal food poisoning); collagen adhesin Can. (*Staphylococcus* genus, Staphylococcal infection); fibronectin-binding protein A FbpA (Ag85A), fibronectin-binding protein D FbpD, fibronectin-binding protein C FbpC1, heat-shock protein HSP65, protein PST-S (*Mycobacterium tuberculosis*, Tuberculosis); and outer membrane protein FobA, outer membrane protein FobB, type IV pili glycosylation protein, outer membrane protein tolC, protein TolQ (*Francisella tularensis*, Tularemia). Additional exemplary microorganisms and corresponding antigens are disclosed, e.g., in U.S. Publication No. 2015/0118264, the entire contents of which are expressly incorporated herein by reference.

In some embodiments, a plurality of antibodies (e.g., 2, 3, 4, 5, 6, 7, 8, 9, 10, 15, 20, 25, 30, or more antibodies) are used as analyte-binding agents in any of the methods described herein (e.g., to detect the presence of one or more analytes in a sample). In some embodiments, the plurality of antibodies bind to the same analyte (e.g., an antigen). In some embodiments, the plurality of antibodies bind to the same epitope present on the analyte (e.g., an antigen). In some embodiments, the plurality of antibodies bind to different epitopes present on the same analyte. In some embodiments, the plurality of antibodies bind to overlapping epitopes present on the same analyte. In some embodiments, the plurality of antibodies bind to non-overlapping epitopes present on the same analyte.

Antibiotics

In some embodiments, the analyte or analyte-binding agent is an antibiotic. An "antibiotic" or "antibiotic agent" refers to a substance that has the capacity to inhibit or slow down the growth of, or to destroy bacteria and/or other microorganisms. In some embodiments, the antibiotic agent is a bacteriostatic antibiotic agent. In some embodiments, the antibiotic is a bacteriolytic antibiotic agent. Exemplary antibiotic agents are set forth in the U.S. Patent Publication US 2006/0269485, which is hereby incorporated by reference herein in its entirety.

In some embodiments, the antibiotic agent is selected from the classes consisting of beta-lactam antibiotics, aminoglycosides, ansa-type antibiotics, anthraquinones, antibiotic azoles, antibiotic glycopeptides, macrolides, antibiotic nucleosides, antibiotic peptides, antibiotic polyenes, antibiotic polyethers, quinolones, antibiotic steroids, sulfonamides, tetracycline, dicarboxylic acids, antibiotic metals, oxidizing agents, substances that release free radicals and/or active oxygen, cationic antimicrobial agents, quaternary ammonium compounds, biguanides, triguanides, bisbiguanides and analogs and polymers thereof and naturally occurring antibiotic compounds. In some embodiments, the antibiotic is rifaximin.

Beta-lactam antibiotics include, but are not limited to, 2-(3-alanyl) clavam, 2-hydroxymethylclavam, 8-epi-thienamycin, acetyl-thienamycin, amoxicillin, amoxicillin sodium, amoxicillin trihydrate, amoxicillin-potassium clavulanate combination, ampicillin, ampicillin sodium, ampicillin trihydrate, ampicillin-sulbactam, apalcillin, aspoxicillin, azidocillin, azlocillin, aztreonam, bacampicillin, biapenem, carbenicillin, carbenicillin disodium, carfecillin, carindacillin, carpetimycin, cefacetril, cefaclor, cefadroxil, cefalexin, cefaloridine, cefalotin, cefamandole, cefamandole, cefapirin, cefatrizine, cefatrizine propylene glycol, cefazedone, cefazolin, cefbuperazone, cefcapene, cefcapene pivoxil hydrochloride, cefdinir, cefditoren, cefditoren pivoxil, cefepime, cefetamet, cefetamet pivoxil, cefixime, cefinenoxime, cefmetazole, cefminox, cefminox, cefmolexin, cefodizime, cefonicid, cefoperazone, cefforanide, cefoselis, cefotaxime, cefotetan, cefotiam, cefoxitin, cefozopran, cefpiramide, cefpirome, cefpodoxime, cefpodoxime proxetil, cefprozil, cefquinome, cefradine, cefroxadine, cefsulodin, ceftazidime, cefteram, cefteram pivoxil, ceftezole, ceftibuten, ceftizoxime, ceftriaxone, cefuroxime, cefuroxime axetil, cephalosporin, cephamycin, chitinovorin, ciclacillin, clavulanic acid, clometocillin, cloxacillin, cycloserine, deoxy pluracidomycin, dicloxacillin, dihydro pluracidomycin, epicillin, epithienamycin, ertapenem, faropenem, flomoxef, flucloxacillin, hetacillin, imipenem, lenampicillin, loracarbef, mecillinam, meropenem, metampicillin, meticillin, mezlocillin, moxalactam, nafcillin, northienamycin, oxacillin, panipenem, penamecillin, penicillin, phenethicillin, piperacillin, tazobactam, pivampicillin, pivcefalexin, pivmecillinam, pivmecillinam hydrochloride, pluracidomycin, propicillin, sarmoxicillin, sulbactam, sulbenicillin, talampicillin, temocillin, terconazole, thienamycin, ticarcillin and analogs, salts and derivatives thereof.

Aminoglycosides include, but are not limited to, 1,2'-N-DL-isoseryl-3',4'-dideoxykanamycin B, 1,2'-N-DL-isoseryl-kanamycin B, 1,2'-N-[(S)-4-amino-2-hydroxybutyryl]-3',4'-dideoxykanamycin B, 1,2'-N-[(S)-4-amino-2-hydroxybutyryl]-kanamycin B, 1-N-(2-Aminobutanesulfonyl) kanamycin A, 1-N-(2-aminoethanesulfonyl) 3',4'-dideoxyribostamycin, 1-N-(2-Aminoethanesulfonyl) 3'-deoxyribostamycin, 1-N-(2-aminoethanesulfonyl) 3'4'-dideoxykanamycin B, 1-N-(2-aminoethanesulfonyl) kanamycin A, 1-N-(2-aminoethanesulfonyl) kanamycin B, 1-N-(2-aminoethanesulfonyl) ribostamycin, 1-N-(2-aminopropanesulfonyl) 3'-deoxykanamycin B, 1-N-(2-aminopropanesulfonyl) 3'4'-dideoxykanamycin B, 1-N-(2-aminopropanesulfonyl) kanamycin A, 1-N-(2-aminopropanesulfonyl) kanamycin B, 1-N-(L-4-amino-2-hydroxy-butyryl) 2,'3'-dideoxy-2'-fluorokanamycin A, 1-N-(L-4-amino-2-hydroxy-propionyl) 2,'3'-dideoxy-2'-fluorokanamycin A, 1-N-DL-3',4'-dideoxy-isoserylkanamycin B, 1-N-DL-isoserylkanamycin, 1-N-DL-isoserylkanamycin B, 1-N-[L-(−)-(alpha-hydroxy-gamma-aminobutyryl)]-XK-62-2,2',3'-dideoxy-2'-fluorokanamycin A,2-hydroxygentamycin A3,2-hydroxygentamycin B, 2-hydroxygentamycin B1, 2-hydroxygentamycin JI-20A, 2-hydroxygentamycin JI-20B, 3"-N-methyl-4"-C-methyl-3',4'-dodeoxy kanamycin A, 3"-N-methyl-4"-C-methyl-3',4'-dodeoxy kanamycin B, 3"-N-methyl-4"-C-methyl-3',4'-dodeoxy-6'-methyl kanamycin B, 3',4'-Dideoxy-3'-eno-ribostamycin,3',4'-dideoxyneamine,3',4'-dideoxyribostamycin, 3'-deoxy-6'-N-methyl-kanamycin B,3'-deoxyncamine,3'-deoxyribostamycin, 3'-oxysaccharocin,3,3'-nepotrehalosadiamine, 3-demethoxy-2"-N-formimidoylistamycin B disulfate tetrahydrate, 3-demethoxyistamycin B,3-O-demethyl-2-N-formimidoylistamycin B, 3-O-demethylistamycin B,3-trehalosamine,4",6"-dideoxydibekacin, 4-N-glycyl-KA-6606VI, 5"-Amino-3',4',5"-trideoxy-butirosin A, 6"-deoxydibekacin,6'-epifortimicin A, 6-deoxy-neomycin (structure 6-deoxy-neomycin B),6-deoxy-neomycin B, 6-deoxy-ncomycin C, 6-deoxy-paromomycin, acmimycin, AHB-3',4'-dideoxyribostamycin, AHB-3'-deoxykanamycin B, AHB-3'-deoxyneamine, AHB-3'-deoxyribostamycin, AHB-4"-6"-dideoxydibekacin, AHB-6"-deoxydibekacin, AHB-dideoxyneamine, AHB-kanamycin B, AHB-methyl-3'-deoxykanamycin B, amikacin, amikacin sulfate, apramycin, arbekacin, astromicin, astromicin sulfate, bekanamycin, bluensomycin, boholmycin, butirosin, butirosin B, catenulin, coumamidine gamma1, coumamidine gamma2,D,L-1-N-(alpha-hydroxy-beta-aminopropionyl)-XK-62-2, dactimicin, de-O-methyl-4-N-glycyl-KA-6606VI, de-O-methyl-KA-6606I, de-O-methyl-KA-7038I, destomycin A, destomycin B, di-N6',O3-demethylistamycin A, dibekacin, dibekacin sulfate, dihydrostreptomycin, dihydrostreptomycin sulfate, epi-formamidoylglycidylfortimicin B, epihygromycin, formimidoyl-istamycin A, formimidoyl-istamycin B, fortimicin B, fortimicin C, fortimicin D, fortimicin KE, fortimicin KF, fortimicin KG, fortimicin KG1 (stereoisomer KG1/KG2), fortimicin KG2 (stereoisomer KG1/KG2), fortimicin KG3, framycetin, framycetin sulphate, gentamicin, gentamycin sulfate, globeomycin, hybrimycin A1, hybrimycin A2, hybrimycin B1, hybrimycin B2, hybrimycin C1, hybrimycin C2, hydroxystreptomycin, hygromycin, hygromycin B, isepamicin, isepamicin sulfate, istamycin, kanamycin, kanamycin sulphate, kasugamycin, lividomycin, marcomycin, micronomicin, micronomicin sulfate, mutamicin, myomycin, N-demethyl-7-O-demethylcelesticetin, demethylcelesticetin, methanesulfonic acid derivative of istamycin, nebramycin, nebramycin, neomycin, netilmicin, oligostatin, paromomycin, quintomycin, ribostamycin, saccharocin, seldomycin, sisomicin, sorbistin, spectinomycin, streptomycin, tobramycin, trehalosmaine, trestatin, validamycin, verdamycin, xylostasin, zygomycin and analogs, salts and derivatives thereof.

Ansa-type antibiotics include, but are not limited to, 21-hydroxy-25-demethyl-25-methylth ioprotostreptovaricin, 3-methylth iorifamycin, ansamitocin, atropisostreptovaricin, awamycin, halomicin, maytansine, naphthomycin, rifabutin, rifamide, rifampicin, rifamycin, rifapentine, rifaximin (e.g., Xifaxan®), rubradirin, streptovaricin, tolypomycin and analogs, salts and derivatives thereof.

Antibiotic anthraquinones include, but are not limited to, auramycin, cinerubin, ditrisarubicin, ditrisarubicin C, figaroic acid fragilomycin, minomycin, rabelomycin, rudolfomycin, sulfurmycin and analogs, salts and derivatives thereof.

Antibiotic azoles include, but are not limited to, azanidazole, bifonazole, butoconazol, chlormidazole, chlormidazole hydrochloride, cloconazole, cloconazole monohydrochloride, clotrimazol, dimetridazole, cconazole, econazole nitrate, enilconazole, fenticonazole, fenticonazole nitrate, fezatione, fluconazole, flutrimazole, isoconazole, isoconazole nitrate, itraconazole, ketoconazole, lanoconazole, metronidazole, metronidazole benzoate, miconazole, miconazole nitrate, neticonazole, nimorazole, niridazole, omoconazol, ornidazole, oxiconazole, oxiconazole nitrate, propenidazole, secnidazol, sertaconazole, sertaconazole nitrate, sulconazole, sulconazole nitrate, tinidazole, tioconazole, voriconazol and analogs, salts and derivatives thereof.

Antibiotic glycopeptides include, but are not limited to, acanthomycin, actaplanin, avoparcin, balhimycin, bleomycin B (copper bleomycin), chloroorienticin, chloropolysporin, demethylvancomycin, enduracidin, galacardin, guanidylfungin, hachimycin, demethylvancomycin, N-nonanoyl-teicoplanin, phleomycin, platomycin, ristocetin, staphylocidin, talisomycin, teicoplanin, vancomycin, victomycin, xylocandin, zorbamycin and analogs, salts and derivatives thereof.

Macrolides include, but are not limited to, acetylleucomycin, acetylkitasamycin, angolamycin, azithromycin, bafilomycin, brefeldin, carbomycin, chalcomycin, cirramycin, clarithromycin, concanamycin, deisovaleryl-niddamycin, demycinosyl-mycinamycin, Di-O-methyltiacumicidin, dirithromycin, erythromycin, erythromycin estolate, erythromycin ethyl succinate, erythromycin lactobionate, erythromycin stearate, flurithromycin, focusin, foromacidin, haterumalide, haterumalide, josamycin, josamycin ropionate, juvenimycin, juvenimycin, kitasamycin, ketotiacumicin, lankavacidin, lankavamycin, leucomycin, machecin, maridomycin, megalomicin, methylleucomycin, methymycin, midecamycin, miocamycin, mycaminosyltylactone, mycinomycin, neutramycin, niddamycin, nonactin, oleandomycin, phenylacetyideltamycin, pamamycin, picromycin, rokitamycin, rosaramicin, roxithromycin, sedecamycin, shincomycin, spiramycin, swalpamycin, tacrolimus, telithromycin, tiacumicin, tilmicosin, treponemycin, troleandomycin, tylosin, venturicidin and analogs, salts and derivatives thereof.

Antibiotic nucleosides include, but are not limited to, amicetin, angustmycin, azathymidine, blasticidin S, epiroprim, flucytosine, gougerotin, mildiomycin, nikkomycin, nucleocidin, oxanosine, oxanosine, puromycin, pyrazomycin, showdomycin, sinefungin, sparsogenin, spicamycin, tunicamycin, uracil polyoxin, vengicide and analogs, salts and derivatives thereof.

Antibiotic peptides include, but are not limited to, actinomycin, aculeacin, alazopeptin, amfomycin, amythiamycin, antifungal from Zalerion *arboricola*, antrimycin, apid, apidaecin, aspartocin, auromomycin, bacilcucin, bacillomycin, bacillopeptin, bacitracin, bagacidin, beminamycin, beta-alanyl-L-tyrosine, bottromycin, capreomycin, caspofungine, cepacidine, cerexin, cilofungin, circulin, colistin, cyclodepsipeptide, cytophagin, dactinomycin, daptomycin, decapeptide, desoxymulundocandin, echanomycin, echinocandin B, echinomycin, ecomycin, enniatin, etamycin, fabatin, ferrimycin, ferrimycin, ficellomycin, fluoronocathiacin, fusaricidin, gardimycin, gatavalin, globopeptin, glyphomycin, gramicidin, herbicolin, iomycin, iturin, iyomycin, izupeptin, janiemycin, janthinocin, jolipeptin, katanosin, killertoxin, lipopeptide antibiotic, lipopeptide from Zalerion sp., lysobactin, lysozyme, macromomycin, magainin, melittin, mersacidin, mikamycin, mureidomycin, mycoplanecin, mycosubtilin, neopeptifluorin, neoviridogriscin, netropsin, nisin, nocathiacin, nocathiacin 6-deoxyglycoside, nosiheptide, octapeptin, pacidamycin, pentadecapeptide, peptifluorin, permetin, phytoactin, phytostreptin, planothiocin, plusbacin, polcillin, polymyxin antibiotic complex, polymyxin B, polymyxin B1, polymyxin F, preneocarzinostatin, quinomycin, quinupristin-dalfopristin, safracin, salmycin, salmycin, salmycin, sandramycin, saramycetin, siomycin, sperabillin, sporamycin, a *Streptomyces* compound, subtilin, teicoplanin aglycone, telomycin, thermothiocin, thiopeptin, thiostrepton, tridecaptin, tsushimycin, tuberactinomycin, tuberactinomycin, tyrothricin, valinomycin, viomycin, virginiamycin, zervacin and analogs, salts and derivatives thereof.

In some embodiments, the antibiotic peptide is a naturally-occurring peptide that possesses an antibacterial and/or an antifungal activity. Such peptide can be obtained from an herbal or a vertebrate source.

Polyenes include, but are not limited to, amphotericin, amphotericin, aureofungin, ayfactin, azalomycin, blasticidin, candicidin, candicidin methyl ester, candimycin, candimycin methyl ester, chinopricin, filipin, flavofungin, fradicin, hamycin, hydropricin, levorin, lucensomycin, lucknomycin, mediocidin, mediocidin methyl ester, mepartricin, methylamphotericin, natamycin, niphimycin, nystatin, nystatin methyl ester, oxypricin, partricin, pentamycin, perimycin, pimaricin, primycin, proticin, rimocidin, sistomycosin, sorangicin, trichomycin and analogs, salts and derivatives thereof.

Polyethers include, but are not limited to, 20-deoxy-epinarasin, 20-deoxysalinomycin, carriomycin, dianemycin, dihydrolonomycin, etheromycin, ionomycin, iso-lasalocid, lasalocid, lenoremycin, lonomycin, lysocellin, monensin, narasin, oxolonomycin, a polycyclic ether antibiotic, salinomycin and analogs, salts and derivatives thereof.

Quinolones include, but are not limited to, an alkyl-methylendioxy-4 (1H)-oxocinnoline-3-carboxylic acid, alatrofloxacin, cinoxacin, ciprofloxacin, ciprofloxacin hydrochloride, danofloxacin, dermofongin A, enoxacin, enrofloxacin, fleroxacin, flumequine, gatifloxacin, gemifloxacin, grepafloxacin, levofloxacin, lomefloxacin, lomefloxacin, hydrochloride, miloxacin, moxifloxacin, nadifloxacin, nalidixic acid, nifuroquine, norfloxacin, ofloxacin, orbifloxacin, oxolinic acid, pazufloxacine, pefloxacin, pefloxacin mesylate, pipemidic acid, piromidic acid, premafloxacin, rosoxacin, rufloxacin, sparfloxacin, temafloxacin, tosufloxacin, trovafloxacin and analogs, salts and derivatives thereof.

Antibiotic steroids include, but are not limited to, aminosterol, ascosteroside, cladosporide A, dihydrofusidic acid, dehydro-dihydrofusidic acid, dehydrofusidic acid, fusidic acid, squalamine and analogs, salts and derivatives thereof.

Sulfonamides include, but are not limited to, chloramine, dapsone, mafenide, phthalylsulfathiazole, succinylsulfathiazole, sulfabenzamide, sulfacetamide, sulfachlorpyridazine, sulfadiazinc, sulfadiazine silver, sulfadicramide, sulfadimethoxine, sulfadoxine, sulfaguanidine, sulfalene, sulfamazone, sulfamerazine, sulfamethazine, sulfamethizole, sulfamethoxazole, sulfamethoxypyridazine, sulfamonomethoxine, sulfamoxol, sulfanilamide, sulfaperine, sulfaphenazol, sulfapyridine, sulfaquinoxaline, sulfasuccinamide, sulfathiazole, sulfathiourea, sulfatolamide, sulfatriazin, sulfisomidine, sulfisoxazole, sulfisoxazole acetyl, sulfacarbamide and analogs, salts and derivatives thereof.

Tetracyclines include, but are not limited to, dihydrosteffimycin, demethyltetracycline, aclacinomycin, akrobomycin, baumycin, bromotetracycline, cetocyclin, chlortetracycline, clomocycline, daunorubicin, demeclocycline, doxorubicin, doxorubicin hydrochloride, doxycycline, lymecyclin, marcellomycin, meclocycline, meclocycline sulfosalicylate, methacycline, minocycline, minocycline hydrochloride, musettamycin, oxytetracycline, rhodirubin, rolitetracycline, rubomycin, serirubicin, steffimycin, tetracycline and analogs, salts and derivatives thereof.

Dicarboxylic acids, having between about 6 and about 14 carbon atoms in their carbon atom skeleton are particularly useful in the treatment of disorders of the skin and mucosal membranes that involve microbial. Suitable dicarboxylic acid moieties include, but are not limited to, adipic acid, pimelic acid, suberic acid, azelaic acid, sebacic acid, 1,11-undecanedioic acid, 1,12-dodecancdioic acid, 1,13-tridecanedioic acid and 1,14-tetradecanedioic acid. Thus, in one or more embodiments of the present disclosure, dicarboxylic acids, having between about 6 and about 14 carbon atoms in their carbon atom skeleton, as well as their salts and derivatives (e.g., esters, amides, mercapto-derivatives, anhydraides), are useful immune modulators in the treatment of disorders of the skin and mucosal membranes that involve inflammation. Azelaic acid and its salts and derivatives are preferred. It has antibacterial effects on both aerobic and anaerobic organisms, particularly *Propionibacterium acnes* and *Staphylococcus epidermidis*, normalizes keratinization, and has a cytotoxic effect on malignant or hyperactive melanocytes. In a preferred embodiment, the dicarboxylic acid is azelaic acid in a concentration greater than 10%. Preferably, the concentration of azelaic acid is between about 10% and about 25%. In such concentrates, azelaic acid is suitable for the treatment of a variety of skin disorders, such as acne, rosacea and hyperpigmentation.

In some embodiments, the antibiotic agent is an antibiotic metal. A number of metals ions have been shown to possess antibiotic activity, including silver, copper, zinc, mercury, tin, lead, bismutin, cadmium, chromium and ions thereof. It has been theorized that these antibiotic metal ions exert their effects by disrupting respiration and electron transport systems upon absorption into bacterial or fungal cells. Antimicrobial metal ions of silver, copper, zinc, and gold, in particular, are considered safe for in vivo use. Anti-microbial silver and silver ions are particularly useful due to the fact that they are not substantially absorbed into the body. Thus, in one or more embodiment, the antibiotic metal consists of an elemental metal, selected from the group consisting of silver, copper, zinc, mercury, tin, lead, bismutin, cadmium, chromium and gold, which is suspended in the composition as particles, microparticles, nanoparticles or colloidal particles. The antibiotic metal can further be intercalated in a chelating substrate.

In further embodiments, the antibiotic metal is ionic. The ionic antibiotic metal can be presented as an inorganic or organic salt (coupled with a counterion), an organometallic complex or an intercalate. Non-binding examples of counter inorganic and organic ions are sulfadiazine, acetate, benzoate, carbonate, iodate, iodide, lactate, laurate, nitrate, oxide, and palmitate, a negatively charged protein. In preferred embodiments, the antibiotic metal salt is a silver salt, such as silver acetate, silver benzoate, silver carbonate, silver iodate, silver iodide, silver lactate, silver laurate, silver nitrate, silver oxide, silver palmitate, silver protein, and silver sulfadiazine.

In one or more embodiments, the antibiotic metal or metal ion is embedded into a substrate, such as a polymer, or a mineral (such as zeolite, clay and silica).

In one or more embodiments, the antibiotic agent includes strong oxidants and free radical liberating compounds, such as oxygen, hydrogen peroxide, benzoyl peroxide, elemental halogen species, as well as oxygenated halogen species, bleaching agents (e.g., sodium, calcium or magnesium hypochloride and the like), perchlorite species, iodine, iodate, and benzoyl peroxide. Organic oxidizing agents, such as quinones, are also included. Such agents possess a potent broad-spectrum activity.

In one or more embodiments, the antibiotic agent is a cationic antimicrobial agent. The outermost surface of bacterial cells universally carries a net negative charge, making them sensitive to cationic substances. Examples of cationic antibiotic agents include: quaternary ammonium compounds (QAC's)-QAC's are surfactants, generally containing one quaternary nitrogen associated with at least one major hydrophobic moiety; alkyltrimethyl ammonium bromides are mixtures of where the alkyl group is between 8 and 18 carbons long, such as cetrimide (tetradecyltrimethylammonium bromide); benzalkonium chloride, which is a mixture of n-alkyldimethylbenzyl ammonium chloride where the alkyl groups (the hydrophobic moiety) can be of variable length; dialkylmethyl ammonium halides; dialkylbenzyl ammonium halides; and QAC dimmers, which bear bi-polar positive charges in conjunction with interstitial hydrophobic regions.

In one or more embodiments, the cationic antimicrobial agent is a polymer. Cationic antimicrobial polymers include, for example, guanide polymers, biguanide polymers, or polymers having side chains containing biguanide moieties or other cationic functional groups, such as benzalkonium groups or quaternium groups (e.g., quaternary amine groups). It is understood that the term "polymer" as used herein includes any organic material including three or more repeating units, and includes oligomers, polymers, copolymers, block copolymers, terpolymers, etc. The polymer backbone may be, for example a polyethylene, polypropylene or polysilane polymer.

In one or more embodiments, the cationic antimicrobial polymer is a polymeric biguanide compound. When applied to a substrate, such a polymer is known to form a barrier film that can engage and disrupt a microorganism. An exemplary polymeric biguanide compound is polyhexamethylene biguanide (PHMB) salts. Other exemplary biguanide polymers include, but are not limited to poly(hexamethylenebiguanide), poly(hexamethylenebiguanide) hydrochloride, poly(hexamethylenebiguanide) gluconate, poly(hexamethylenebiguanide) stearate, or a derivative thereof. In one or more embodiments, the antimicrobial material is substantially water-insoluble.

In some embodiments, the antibiotic agent is selected from the group of biguanides, triguanides, bisbiguanides and analogs thereof.

Guanides, biguanides, biguanidines and triguanides are unsaturated nitrogen containing molecules that readily obtain one or more positive charges, which make them effective antimicrobial agents. The basic structures a guanide, a biguanide, a biguanidine and a triguanide are provided below.

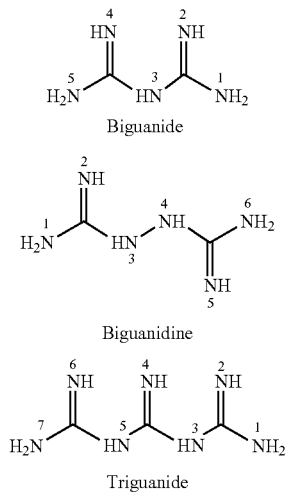

Biguanide

Biguanidine

Triguanide

In some embodiments, the guanide, biguanide, biguanidine or triguanide, provide bi-polar configurations of cationic and hydrophobic domains within a single molecule.

Examples of guanides, biguanides, biguanidines and triguanides that are currently been used as antibacterial agents include chlorhexidine and chlorohexidine salts, analogs and derivatives, such as chlorhexidine acetate, chlorhexidine gluconate and chlorhexidine hydrochloride, picloxydine, alexidine and polihexanide. Other examples of guanides, biguanides, biguanidines and triguanides that can conceivably be used according to the present disclosure are chlorproguanil hydrochloride, proguanil hydrochloride (currently used as antimalarial agents), mefformin hydrochloride, phenformin and buformin hydrochloride (currently used as antidiabetic agents).

Yet, in one or more embodiments, the antibiotic is a non-classified antibiotic agent, including, without limitation, aabomycin, acetomycin, acetoxycycloheximide, acetylnanaomycin, an Actinoplanes sp. compound, actinopyrone, aflastatin, albacarcin, albacarcin, albofungin, albofungin, alisamycin, alpha-R,S-methoxycarbonylbenzylmonate, altromycin, amicetin, amycin, amycin demanoyl compound, amycine, amycomycin, anandimycin, anisomycin, anthramycin, anti-syphilis immune substance, anti-tuberculosis immune substance, an antibiotic from *Escherichia coli*, an antibiotic from *Streptomyces* refuineus, anticapsin, antimycin, aplasmomycin, aranorosin, aranorosinol, arugomycin, ascofuranone, ascomycin, ascosin, *Aspergillus flavus* antibiotic, asukamycin, aurantinin, an Aureolic acid antibiotic substance, aurodox, avilamycin, azidamfenicol, azidimycin, bacillaene, a *Bacillus larvae* antibiotic, bactobolin, benanomycin, benzanthrin, benzylmonate, bicozamycin, bravomi-cin, brodimoprim, butalactin, calcimycin, calvatic acid, candiplanecin, carumonam, carzinophilin, celesticetin, cepacin, cerulenin, cervinomycin, chartreusin, chloramphenicol, chloramphenicol palmitate, chloramphenicol succinate sodium, chlorflavonin, chlorobiocin, chlorocarcin, chromomycin, ciclopirox, ciclopirox olamine, citreamicin, cladosporin, clazamycin, clecarmycin, clindamycin, coliformin, collinomycin, copiamycin, corallopyronin, corynecandin, coumermycin, culpin, cuprimyxin, cyclamidomycin, cycloheximide, dactylomycin, danomycin, danubomycin, delaminomycin, demethoxyrapamycin, demethylscytophycin, dermadin, desdamethine, dexylosylbenanomycin, pseudoaglycone, dihydromocimycin, dihydronancimycin, diumycin, dnacin, dorrigocin, dynemycin, dynemycin triacetate, ecteinascidin, efrotomycin, endomycin, ensanchomycin, equisetin, ericamycin, esperamicin, ethylmonate, everninomicin, feldamycin, flambamycin, flavensomycin, florfenicol, fluvomycin, fosfomycin, fosfonochlorin, fredericamycin, frenolicin, fumagillin, fumifungin, funginon, fusacandin, fusafungin, gelbecidine, glidobactin, grahamimycin, granaticin, griseofulvin, griseoviridin, grisonomycin, hayumicin, hayumicin, hazymicin, hedamycin, heneicomycin, heptelicid acid, holomycin, humidin, isohematinic acid, karnatakin, kazusamycin, kristenin, L-dihydrophenylalanine, a L-isoleucyl-L-2-amino-4-(4'-amino-2',5'-cyclohexadienyl) derivative, lanomycin, leinamycin, leptomycin, libanomycin, lincomycin, lomofungin, lysolipin, magnesidin, manumycin, melanomycin, methoxycarbonylmethylmonate, methoxycarbonylethylmonate, methoxycarbonylphenylmonate, methyl pseudomonate, methylmonate, microcin, mitomalcin, mocimycin, moenomycin, monoacetyl cladosporin, monomethyl cladosporin, mupirocin, mupirocin calcium, mycobacidin, myriocin, myxopyronin, pseudoaglycone, nanaomycin, nancimycin, nargenicin, neocarcinostatin, neoenactin, neothramycin, nifurtoinol, nocardicin, nogalamycin, novobiocin, octylmonate, olivomycin, orthosomycin, oudemansin, oxirapentyn, oxoglaucine methiodide, pactacin, pactamycin, papulacandin, paulomycin, phaeoramularia fungicide, phenelfamycin, phenyl, cerulenin, phenylmonate, pholipomycin, pirlimycin, pleuromutilin, a polylactone derivative, polynitroxin, polyoxin, porfiromycin, pradimicin, prenomycin, prop-2-enylmonate, protomycin, *Pseudomonas* antibiotic, pseudomonic acid, purpuromycin, pyrinodemin, pyrrolnitrin, pyrrolomycin, amino, chloro pentenedioic acid, rapamycin, rebeccamycin, resistomycin, reuterin, reveromycin, rhizocticin, roridin, rubiflavin, naphthyridinomycin, saframycin, saphenamycin, sarkomycin, sarkomycin, sclopularin, selenomycin, siccanin, spartanamicin, spectinomycin, spongistatin, stravidin, streptolydigin, *Streptomyces arenae* antibiotic complex, streptonigrin, streptothricins, streptovitacin, streptozotocine, a strobilurin derivative, stubomycin, sulfamethoxazol-trimethoprim, sakamycin, tejeramycin, terpentecin, tetrocarcin, thermorubin, thermozymocidin, thiamphenicol, thioaurin, thiolutin, thiomarinol, thiomarinol, tirandamycin, tolytoxin, trichodermin, trienomycin, trimethoprim, trioxacarcin, tyrissamycin, umbrinomycin, unphenelfamycin, urauchimycin, usnic acid, uredolysin, variotin, vermisporin, verrucarin and analogs, salts and derivatives thereof.

In one or more embodiments, the antibiotic agent is a naturally occurring antibiotic compound. As used herein, the term "naturally-occurring antibiotic agent" includes all antibiotics that are obtained, derived or extracted from plant or vertebrate sources. Non-limiting examples of families of naturally-occurring antibiotic agents include phenol, resorcinol, antibiotic aminoglycosides, anamycin, quinincs, anthraquinones, antibiotic glycopeptides, azoles, macrolides, avilamycin, agropyrene, cnicin, aucubin antibioticsaponin fractions, berberine (isoquinoline alkaloid), arctiopicrin (sesquiterpene lactone), lupulone, humulone (bitter acids), allicin, hyperforin, echinacoside, coniosetin, tetramic acid, imanine and novoimanine.

Ciclopirox and ciclopiroxolamine possess fungicidal, fungistatic and sporicidal activity. They are active against a broad spectrum of dermatophytes, yeasts, moulds and other fungi, such as *Trichophytons* species, *Microsporum* species, *Epidermophyton* species and yeasts (*Candida albicans, Candida glabrata*, other *candida* species and *Cryptococcus neoformans*). Some *Aspergillus* species are sensitive to ciclopirox as are some *Penicillium*. Likewise, ciclopirox is effective against many Gram-positive and Gram-negative bacteria (e.g., *Escherichia coli, Proteus mirabilis, Pseudomonas aeruginosa, Staphylococcus* and *Streptococcus* species), as well as *Mycoplasma* species, *Trichomonas vaginalis* and *Actinomyces*.

Plant oils and extracts which contain antibiotic agents are also useful. Non-limiting examples of plants that contain agents include thyme, *Perilla*, lavender, tea tree, *Terfezia clayeryi, Micromonospora, Putterlickia verrucosa, Putterlickia pyracantha, Putterlickia retrospinosa, Maytenus ilicifolia, Maytenus evonymoides, Maytenus aquifolia, Faenia interjecta, Cordyceps sinensis*, couchgrass, holy thistle, plantain, burdock, hops, *echinacea*, buchu, chaparral, myrrh, red clover and yellow dock, garlic, and St. John's wort. Mixtures of the antibiotic agents as described herein may also be employed.

Combination Detection:

Any combination of the analytes disclosed herein can be detected using any of the methods described herein. In particular, any combination disclosed herein can be detected using any of the methods described herein.

A "photosensitizer" as used herein refers to a sensitizer for generation of singlet oxygen usually by excitation with light. Exemplary photosensitizers suitable for use include those described in U.S. Pat. Nos. 6,251,581, 5,516,636, 8,907,081, 6,545,012, 6,331,530, 8,247,180, 5,763,602, 5,705,622, 5,516,636, 7,217,531, and U.S. Patent Publication No. 2007/0059316, all of which are herein expressly incorporated by reference in their entireties. The photosensitizer can be photoactivatable (e.g., dyes and aromatic compounds) or chemiactivated (e.g., enzymes and metal salts). When excited by light the photosensitizer is usually a compound comprised of covalently bonded atoms, usually with multiple conjugated double or triple bonds. The compound should absorb light in the wavelength range of 200-1100 nm, usually 300-1000 nm, e.g., 450-950 nm, with an extinction coefficient at its absorbance maximum greater than 500 $M^{-1}$ $cm^{-1}$, e.g., at least 5000 $M^{-1}cm^{-1}$, or at least 50,000 $M^{-1}cm^{-1}$ at the excitation wavelength. The lifetime of an excited state produced following absorption of light in the absence of oxygen will usually be at least 100 nsec, e.g., at least 1 usec. In general, the lifetime must be sufficiently long to permit energy transfer to oxygen, which will normally be present at concentrations in the range of $10^{-5}$ to $10^{-3}$ M depending on the medium. The sensitizer excited state will usually have a different spin quantum number(s) than its ground state and will usually be a triplet ($s=1$) when, as is usually the case, the ground state is a singlet ($s=0$). In some embodiments, the sensitizer will have a high intersystem crossing yield. That is, photoexcitation of a sensitizer will produce the long lived state (usually triplet) with an efficiency of at least 10%, at least 40%, e.g., greater than 80%. The photosensitizer will usually be at most weakly fluorescent under the assay conditions (quantum yield usually less that 0.5, or less that 0.1).

Photosensitizers that are to be excited by light will be relatively photostable and will not react efficiently with singlet oxygen. Several structural features are present in most useful sensitizers. Most sensitizers have at least one and frequently three or more conjugated double or triple bonds held in a rigid, frequently aromatic structure. They will frequently contain at least one group that accelerates intersystem crossing such as a carbonyl or imine group or a heavy atom selected from rows 3-6 of the periodic table, especially iodine or bromine, or they may have extended aromatic structures. Typical sensitizers include acetone, benzophenone, 9-thioxanthone, eosin, 9,10-dibromoanthracene, methylene blue, metallo-porphyrins, such as hematoporphyrin, phthalocyanines, chlorophylls, rose bengal, buckminsterfullerene, etc., and derivatives of these compounds having substituents of 1 to 50 atoms for rendering such compounds more lipophilic or more hydrophilic and/or as attaching groups for attachment. Examples of other photosensitizers that may be utilized are those that have the above properties and are enumerated in N. J. Turro, "Molecular Photochemistry," page 132, W. A. Benjamin Inc., N.Y. 1965.

In some embodiments, the photosensitizers are relatively non-polar to assure dissolution into a lipophilic member when the photosensitizer is incorporated in an oil droplet, liposome, latex particle, etc.

In some embodiments, the photosensitizers suitable for use herein include other substances and compositions that can produce singlet oxygen with or without activation by an external light source. Thus, for example, molybdate ($MoO_4^-$) salts and chloroperoxidase and myeloperoxidase plus bromide or chloride ion (Kanofsky, *J. Biol. Chem.* (1983) 259 5596) have been shown to catalyze the conversion of hydrogen peroxide to singlet oxygen and water. Either of these compositions can, for example, be included in particles and used in the assay method wherein hydrogen peroxide is included as an ancillary reagebly, chloroperoxidase is bound to a surface and molybdate is incorporated in the aqueous phase of a liposome. Also included within the scope of the disclosure as photosensitizers are compounds that are not true sensitizers but which on excitation by heat, light, or chemical activation will release a molecule of singlet oxygen. The best known members of this class of compounds includes the endoperoxides such as 1,4-biscarboxyethyl-1,4-naphthalene endoperoxide, 9,10-diphenylanthracene-9,10-endoperoxide and 5,6,11,12-tetraphenyl naphthalene 5,12-endoperoxide. Heating or direct absorption of light by these compounds releases singlet oxygen.

A "chemiluminescent compound" as used herein refers to a substance that undergoes a chemical reaction with singlet oxygen to form a metastable intermediate that can decompose with the simultaneous or subsequent emission of light within the wavelength range of 250 to 1200 nm. Exemplary chemiluminescent compounds suitable for use include those described in U.S. Pat. Nos. 6,251,581 and 7,709,273, and Patent Cooperatio Treaty (PCT) International Application Publication No. WO1999/042838. Examplery chemiluminescent compound includes the following:

| Chemiluminescent | Half-Life | Emission Max |
|---|---|---|
| Thioxene + Diphenyl anthracene: | 0.6 seconds | 430 nm |
| Thioxene + Umbelliferone derivative | 0.6 seconds | 500 nm |
| Thioxene + Europium chelate | 0.6 seconds | 615 nm |

-continued

| Chemiluminescent | Half-Life | Emission Max |
|---|---|---|
| Thioxene + Samarium Chelate | 0.6 seconds | 648 nm |
| Thioxene + terbium Chelate | 0.6 seconds | 540 nm |
| N-Phenyl Oxazine + Umbelliferone derivative | 30 seconds | 500 nm |
| N-Phenyl Oxazine + Europium chelate | 30 seconds | 613 nm |
| N-phenyl Oxazine + Samarium Chelate | 30 seconds | 648 nm |
| N-phenyl Oxazine + terbium Chelate | 30 seconds | 540 nm |
| Dioxene + Umbelliferone derivative | 300 seconds | 500 nm |
| Dioxene + Europium chelate | 300 seconds | 613 nm |
| Dioxene + Samarium Chelate | 300 seconds | 648 nm |
| N-phenyl Oxazine + terbium Chelate | 300 seconds | 540 nm |

All of the above mentioned applications are hereby expressly incorporated by reference herein in their entireties. Emission will usually occur without the presence of an energy acceptor or catalyst to cause decomposition and light emission. In some embodiments, the intermediate decomposes spontaneously without heating or addition of ancillary reagents following its formation. However, addition of a reagent after formation of the intermediate or the use of elevated temperature to accelerate decomposition will be required for some chemiluminescent compounds. The chemiluminescent compounds are usually electron rich compounds that react with singlet oxygen, frequently with formation of dioxetanes or dioxetanones. Exemplary of such compounds are enol ethers, enamines, 9-alkylidenexanthans, 9-alkylidene-N-alkylacridans, aryl vinyl ethers, dioxenes, arylimidazoles and lucigenin. Other chemiluminescent compounds give intermediates upon reaction with singlet oxygen, which subsequently react with another reagent with light emission. Exemplary compounds are hydrazides such as luminol and oxalate esters.

The chemiluminescent compounds of interest will generally emit at wavelengths above 300 nanometers and usually above 400 nm. Compounds that alone or together with a fluorescent molecule emit light at wavelengths beyond the region where serum components absorb light will be of particular use. The fluorescence of serum drops off rapidly above 500 nm and becomes relatively unimportant above 550 nm. Therefore, when the analyte is in serum, chemiluminescent compounds that emit light above 550 nm, e.g., above 600 nm may be suitable for use. In order to avoid autosensitization of the chemiluminescent compound, in some embodiments, the chemiluminescent compounds do not absorb light used to excite the photosensitizer. In some embodiments, the sensitizer is excited with light wavelengths longer than 500 nm, it will therefore be desirable that light absorption by the chemiluminescent compound be very low above 500 nm.

Where long wave length emission from the chemiluminescent compound is desired, a long wavelength emitter such as a pyrene, bound to the chemiluminescent compound can be used. Alternatively, a fluorescent molecule can be included in the medium containing the chemiluminescent compound. In some embodiments, fluorescent molecules will be excited by the activated chemiluminescent compound and emit at a wavelength longer than the emission wavelength of the chemiluminescent compound, usually greater that 550 nm. It is usually also desirable that the fluorescent molecules do not absorb at the wavelengths of light used to activate the photosensitizer. Examples of useful dyes include rhodamine, ethidium, dansyl, $Eu(fod)_3$, $Eu(TTA)_3$, $Ru(bpy)_3^{++}$ (wherein bpy=2,2'-dipyridyl, etc. In general these dyes act as acceptors in energy transfer processes and in some embodiments, have high fluorescent quantum yields and do not react rapidly with singlet oxygen. They can be incorporated into particles simultaneously with the incorporation of the chemiluminescent compound into the particles.

In some embodiments, the disclosure provides diffractive optics detection technology that can be used with, for example, ingestible device technology. In certain embodiments, an ingestible device includes the diffractive optics technology (e.g., diffractive optics detection system). In certain embodiments, the disclosure provides diffractive optics technology (e.g., diffractive optics detection systems) that are used outside the body of subject. As an example, an ingestible device can be used to obtain one more samples in the body (e.g., in the gastrointestinal tract) of a subject, and the diffractive optics technology can be used to analyze the sample(s). Such analysis can be performed in vivo (e.g., when the ingestible device contains the diffractive optics).

Diffraction is a phenomenon that occurs due to the wave nature of light. When light hits an edge or passes through a small aperture, it is scattered in different directions. But light waves can interfere to add (constructively) and subtract (destructively) from each other, so that if light hits a non-random pattern of obstacles, the subsequent constructive and destructive interference will result in a clear and distinct diffraction pattern. A specific example is that of a diffraction grating, which is of uniformly spaced lines, typically prepared by ruling straight, parallel grooves on a surface. Light incident on such a surface produces a pattern of evenly spaced spots of high light intensity. This is called Bragg scattering, and the distance between spots (or 'Bragg scattering peaks') is a unique function of the diffraction pattern and the wavelength of the light source. Diffraction gratings, like focusing optics, can be operated in both transmission and reflection modes.

In general, the light used in the diffractive optics can be of any appropriate wavelength. Exemplary wavelengths include visible light, infrared red (IR) and ultraviolet (UV). Optionally, the light can be monochromatic or polychromatic. The light can be coherent or incoherent. The light can be collimated or non-collimated. In some embodiments, the light is coherent and collimated. Generally, any appropriate light source may be used, such as, for example, a laser (e.g., a laser diode) or a light emitting diode. In some embodiments, the light source is a laser diode operating at 670 nm wavelength, e.g., at 3 m Watts power. Optionally, an operating wavelength of a laser diode can be 780 nm, e.g., when larger grating periods are used. In certain embodiments, the light source is a laser, such as, for example, a He-Ne laser, a Nd:YVO4 laser, or an argon-ion laser. In some embodiments, the light source is a low power, continuous waver laser.

The diffracted light can be detected using any appropriate light detector(s). Examples of light detectors include photodetectors, such as, for example, position sensitive photodiodes, photomultiplier tubes (PMTs), photodiodes (PDs), avalanche photodiodes (APDs), charged-coupled device (CCD) arrays, and CMOS detectors. In some embodiments, the diffracted light is detected via one or more individual photodiodes.

In general, the diffraction grating is made of a material that is transparent in the wavelength of the radiation used to illuminate the sensor. Any appropriate material may be used for the diffraction grating substrate, such as glass or a polymer. Exemplary polymers include polystyrene polymers (PSEs), cyclo-olefin polymers (COPs), polycarbonate polymers, polymethyl methacrylates, and methyl methacrylate styrene copolymers. Exemplary COPs include Zeonex (e.g., Zeonex E48R, Zeonex F52R).

The light may be incident on the diffraction grating any appropriate angle. In some embodiments, the light is incident on the diffraction grating with an angle of incidence of from 30° to 80° (e.g., from 40° to 80°, from 50° to 70°, from 55° to 65°,) 60°. Optionally, the system is configured so that that diffractive grating and light source can move relative to each other In general, the light detector can be positioned with respect to the diffractive grating so that the diffraction grating can be illuminated at a desired angle of incidence and/or so that diffracted light can be detected at a desired angle and/or so that diffracted light of a desired order can be detected.

The period P of the diffraction grating can be selected as desired. In some embodiments, the period P is from 0.5 microns to 50 microns (e.g., from one micron to 15 microns, from one micron to five microns). In some embodiments, the grating is a repeating patter of 1.5 micron and 4.5 micron lines with a period of 15 microns.

The height h of the diffraction grating can be selected as desired. In certain embodiments, the height h is from one nanometer to about 1000 nanometers (e.g., from about five nanometers to about 250 nanometers, from five nanometers to 100 nanometers).

In general, the diffractive optics can be prepared using any appropriate method, such as, for example, surface ablation, photolithograph (e.g., UV photolithography), laser etching, electron beam etching, nano-imprint molding, or microcontact printing.

Optionally, the diffractive optics system can include one or more additional optical elements, such as, for example, one or more mirrors, filters and/or lenses. Such optical elements can, for example, be arranged between the light source and the diffractive grating and/or between the diffractive grating and the detector.

In some of the embodiments of the devices described herein, a primary binding partner specifically binds to a secondary binding partner through non-covalent interactions (e.g., electrostatic, van der Waals, hydrophobic effect). In some embodiments, a primary binding partner specifically binds to a secondary binding partner via a covalent bond (e.g., a polar covalent bond or a non-polar covalent bond). In some embodiments of any of the devices described herein, the primary and the secondary binding partner can be interchanged. For example, the primary binding partner can be biotin, or a derivative thereof, and the secondary binding partner is avidin, or a derivative thereof. In other examples, the primary binding partner can be avidin, or a derivative thereof, and the secondary binding partner is biotin.

In some embodiments, the binding of the primary and the secondary binding partner is essentially irreversible. In some embodiments, the binding of the primary and the secondary binding partner is reversible. In some embodiments, the primary binding partner is CaptAvidin™ biotin-binding protein and the secondary binding partner is biotin, or vice versa. In some embodiments, the primary binding partner is DSB-X™ biotin and the secondary binding partner is avidin, or vice versa. In some embodiments, the primary binding partner is desthiobiotin and the secondary binding partner is avidin, or vice versa (Hirsch et al., *Anal Biochem.* 308 (2): 343-357, 2002). In some embodiments, the primary binding partner is glutathione (GSH) or a derivative thereof, and the secondary binding partner is glutathione-S-transferase (GST).

In some embodiments, the primary binding partner can bind to a target analyte that is a nucleic acid (e.g., a DNA molecule, a RNA molecule). In some embodiments, the primary binding partner comprises a portion of a nucleic acid that is complementary to the nucleic acid sequence of the target analyte.

In some embodiments of any of the devices described herein, the device can include a label that binds to the target analyte and does not prevent binding of the target analyte to the primary binding partner. In some embodiments, the label can amplify the diffraction signal of the target analyte.

In some embodiments, the label is from about 1 nm to 200 nm (e.g., about 50 nm to about 200 nm).

In some embodiments, the label (e.g., any of the labels described herein) includes one or more antibodies (e.g., any of the antibodies and/or antibody fragments described herein).

In some embodiments, the label is a nanoparticle (e.g., a gold nanoparticle) that includes the primary binding partner that has a nucleic acid sequence that is complementary to the target analyte, and is covalently linked to the nanoparticle.

One or more additional steps can be performed in any of the methods described herein. In some embodiments, the one or more additional steps are performed: prior to the binding of the primary binding partner to the secondary binding partner, after the binding of the primary binding partner to the secondary binding partner, prior to the binding of the primary binding partner to the target analyte, or after the binding of the primary binding partner to the target analyte.

In some embodiments of any of the methods described herein, the determining step (during which the primary binding partner binds to the target analyte is detected) can occur in at least 15 seconds. In some embodiments, the binding of the primary binding partner to the target analyte can occur during a period of time of, for example, five at least seconds.

In some embodiments, the one or more additional steps can include: a blocking of the sensors step, at least one wash step, a capturing step, and/or a filtering step. In some embodiments, the blocking step can include blocking a sensor within the ingestible device with a solution comprising at least 1% bovine serum albumin (BSA) in a buffered solution (e.g., phosphate buffered saline (PBS), Tris buffered saline (TBS)). In some embodiments, the at least one wash step can include washing with a buffered solution (e.g., phosphate buffered saline (PBS), Tris buffered saline (TBS)). In general, blocking is performed during capsule manufacture, rather than in vivo.

In some embodiments, the capturing step includes enriching the target analyte. In some embodiments, the capturing step includes physically separating the target analyte from the remaining sample using a filter, a pore, or a magnetic bead. In some embodiments, the target analyte is captured by size exclusion.

In some embodiments, the disclosure provides methods of obtaining, culturing, and/or detecting target cells and/or target analytes in vivo within the gastrointestinal (GI) tract or reproductive tract of a subject. Associated devices are also disclosed. The methods and devices described provide a number of advantages for obtaining and/or analyzing fluid samples from a subject. In some embodiments, diluting the fluid sample increases the dynamic range of analyte detection and/or reduces background signals or interference within the sample. For example, interference may be caused by the presence of non-target analytes or non-specific binding of a dye or label within the sample. In some embodiments, culturing the sample increases the concentration of target cells and/or target analytes produced by the target cells thereby facilitating their detection and/or characterization.

In certain embodiments, the methods and devices described herein may be used to obtain information regarding bacteria populations in the GI tract of a subject. This has a number of advantages and is less invasive than surgical procedures such as intubation or endoscopy to obtain fluid samples from the GI tract. The use of an ingestible device as described herein also allows for fluid samples to be obtained and data to be generated on bacterial populations from specific regions of the GI tract.

In some embodiments, the methods and devices described herein may be used to generate data such as by analyzing the fluid sample, dilutions thereof or cultured samples for one or more target cells and/or target analytes. The data may include, but is not limited to, the types of bacteria present in the fluid sample or the concentration of bacteria in specific regions of the GI tract. Such data may be used to determine whether a subject has an infection, such as Small Intestinal Bacterial Overgrowth (SIBO), or to characterize bacterial populations within the GI tract for diagnostic or other purposes. Thus, in some embodiments, analytes disclosed herein are indicative of disorders of the gastrointestinal tract associated with anomalous bacterial populations.

For example, in one aspect, the data may include, but is not limited to, the concentration of bacteria in a specific region of the GI tract that is one or more of the duodenum, jejunum, ileum, ascending colon, transverse colon or descending colon. In one aspect, the specific region of the GI tract is the duodenum. In one aspect, the specific region of the GI tract is the jejunum. In one aspect, the specific region of the GI tract is the ileum. In one aspect, the specific region of the GI tract is the ascending colon. In one aspect, the specific region of the GI tract is the transverse colon. In one aspect, the specific region of the GI tract is the descending colon. In a related embodiment, the data may be generated every one or more days to monitor disease flare-ups, or response to the therapeutic agents disclosed herein.

Data may be generated after the device has exited the subject, or the data may be generated in vivo and stored on the device and recovered ex vivo. Alternatively, the data can be transmitted wirelessly from the device while the device is passing through the GI tract of the subject or in place within the reproductive tract of the subject.

In some embodiments, a method comprises: providing a device comprising one or more dilution chambers and dilution fluid; transferring all or part of a fluid sample obtained from the GI tract or reproductive tract of the subject into the one or more dilution chambers in vivo; and combining the fluid sample and the dilution fluid to produce one or more diluted samples in the one or more dilution chambers.

In certain embodiments, a method comprises: providing an ingestible device comprising one or more dilution chambers; transferring all or part of a fluid sample obtained from the GI tract into the one or more dilution chambers comprising sterile media; culturing the sample in vivo within the one or more dilution chambers to produce one or more cultured samples; and detecting bacteria in the one or more cultured samples.

In some embodiments, a method comprises: providing a device comprising one or more dilution chambers; transferring all or part of a fluid sample obtained from the GI tract or reproductive tract into the one or more dilution chambers; combining all or part of the fluid sample with a dilution fluid in the one or more dilution chambers; and detecting the target analyte in the one or more diluted samples.

In certain embodiments, a device comprises: one or more dilution chambers for diluting a fluid sample obtained from the GI tract or reproductive tract; and dilution fluid for diluting the sample within the one or more dilution chambers.

In some embodiments, the device comprises: one or more dilution chambers for culturing a fluid sample obtained from the GI tract; sterile media for culturing the sample within the one or more dilution chambers; and a detection system for detecting bacteria.

In certain embodiments, a device comprises: one or more dilution chambers for culturing a fluid sample obtained from the GI tract; sterile media for culturing the sample within the one or more dilution chambers; and a detection system for detecting bacteria.

Also provided is the use of a device as described herein for diluting one or more samples obtained from the GI tract or reproductive tract of a subject. In one embodiment, there is provided the use of an ingestible device as described herein for detecting target cells and/or target analytes in vivo within the gastrointestinal (GI) tract of a subject.

Further provided is a system comprising a device as described herein and a base station. In one embodiment, the device transmits data to the base station, such as data indicative of the concentration and/or types of bacteria in the GI tract of the subject. In one embodiment, the device receives operating parameters from the base station. Some embodiments described herein provide an ingestible device for obtaining one or more samples from the GI tract or reproductive tract of a subject and diluting and/or culturing all or part of the one or more samples. The ingestible device includes a cylindrical rotatable element having a port on the wall of the cylindrical rotatable element. The ingestible device further includes a shell element wrapping around the cylindrical rotatable element to form a first dilution chamber between the cylindrical rotatable element and the shell element. The shell element has an aperture that exposes a portion of the wall of the cylindrical rotatable element to an exterior of the ingestible device.

In certain embodiments, the medical device comprises one or more dilution chambers for receiving a fluid sample from the GI tract or reproductive tract of a subject or a dilution thereof. In some embodiments, one or more dilutions of the fluid sample are cultured in one or more dilution chambers. In certain embodiments, the dilution chambers each define a known volume, optionally the same volume or different volumes. In some embodiments, the dilution chambers define a fluid volume ranging from about 10 µL to about 1 mL. The dilution chambers may define a fluid volume less than or equal to about 500 µL, less than or equal to about 250 µL, less than or equal to about 100 µL, or less than or equal to about 50 µL. In certain embodiments, the dilution chambers define a fluid volume of greater than or equal to about 10 µL, greater than or equal to about 20 µL, greater than or equal to about 30 µL, or greater than or equal to about 50 µL. In some embodiments, the dilution chambers define a fluid volume between about 10 µL and 500 µL, between about 20 µL and 250 µL, between about 30 µL and 100 µL or about 50 µL.

In some embodiments, dilution fluid in the device is combined with all or part of the fluid sample, or dilution thereof, to produce one or more dilutions. In certain embodiments, the dilution fluid is sterile media suitable for culturing one or more target cells within the dilution chambers.

In certain embodiments, the one or more dilution chambers may be filled with the dilution fluid prior to a patient ingesting the ingestible device. In some embodiments, the dilution fluid may be added into the one or more dilution chambers in vivo from a reservoir of the ingestible device. Sampling and dilution of the GI fluid sample may take place in vivo. For example, an actuator of the ingestible device may pump the dilution fluid from the reservoir into a dilution chamber when it is determined that the ingestible device is located at a predetermined location within the GI tract. In some embodiments, the dilution chambers each contain a volume of sterile media suitable for culturing a fluid sample from the GI tract or reproductive tract. In certain embodiments, the dilution chambers are at least 95%, at least 97%, at least 98%, or at least 99% full of sterile media. In some embodiments, the dilution chambers each contain oxygen to facilitate aerobic bacteria growth. In certain embodiments, a non-dilution chamber comprises oxygen and is added to one or more of the dilution chambers to facilitate aerobic bacteria growth.

In some embodiments, the culturing may take place in vivo immediately after the GI fluid sample has been diluted. Or alternatively, the culturing may take place ex vivo, e.g., when the ingestible device has been evacuated and recovered such that the dilution chamber containing the diluted GI fluid sample may be extracted and the culturing may be performed in a laboratory. The recovery of the ingestible device may be performed in a similar manner as embodiments described in U.S. Provisional Application No. 62/434,188, filed on Dec. 14, 2016, which is herein expressly incorporated by reference in its entirety.

As used herein "culturing" refers to maintaining target cells in an environment that allows a population of one or more target cells to increase in number through cell division. For example, in some embodiments, "culturing" may include combining the cells with media in an dilution chamber at a temperature that permits cell growth, optionally a temperature found in vivo within the GI tract or reproductive tract of a subject. In certain embodiments, the cells are cultured at a temperature between about 35° C. and 42° C.

As used herein "dilution fluid" refers to a fluid within the device for diluting a fluid sample from the GI tract or reproductive tract. In some embodiments, the dilution fluid is an aqueous solution. In certain embodiments, the dilution fluid comprises one or more agents that promote or inhibit the growth of an organism, such as a fungus or bacteria. In some embodiments, the dilution fluid comprises one or more agents that facilitate the detection of a target analyte, such as dyes or binding agents for target analytes.

In some embodiments, the dilution fluid is a sterile media. As used herein, "sterile media" refers to media that does not contain any viable bacteria or other cells that would grow and increase in number through cell division. Media may be rendered sterile by various techniques known in the art such as, but not limited to, autoclaving and/or preparing the media using asceptic techniques. In certain embodiments, the media is a liquid media. Examples of media suitable for culturing bacteria include nutrient broth, Lysogeny Broth (LB) (also known as Luria Broth), Wilkins chalgren, and Tryptic Soy Broth (TSB), Other growth or culture media known in the art may also be used in the methods and devices described herein. In some embodiments, the media has a carbon source, such as glucose or glycerol, a nitrogen source such as ammonium salts or nitrates or amino acids, as well as salts and/or trace elements and vitamins required for microbial growth. In certain embodiments, the media is suitable for maintaining eukaryotic cells. In some embodiments, the media comprises one or more agents that promote or inhibit the growth of bacteria, optionally agents that promote or inhibit the growth of specific types of bacteria.

In certain embodiments, the media is a selective media. As used herein, "selective media" refers to a media that allows certain types of target cells to grow and inhibits the growth of other organisms. Accordingly, the growth of cells in a selective media indicates the presence of certain types of cells within the cultured sample. For example, in some embodiments, the media is selective for gram-positive or gram-negative bacteria. In certain embodiments, the media contains crystal violet and bile salts (such as found in MacConkey agar) that inhibit the growth of gram-positive organisms and allows for the selection and isolation of gram-negative bacteria. In some embodiments, the media contains a high concentration of salt (NaCl) (such as found in Mannitol salt agar) and is selective for Gram-positive bacteria. In some embodiments, the media selectively kills eukaryotic cells or only grows prokaryotic cells, for example, using a media comprising Triton™ X-100. In certain embodiments, the media selectively kills prokaryotic cells (or alternatively only grows eukaryotic cells), for example, using a media that comprises antibiotics.

In some embodiments, the media is an indicator media. As used herein, "indicator media" refers to a media that contains specific nutrients or indicators (such as, but not limited to neutral red, phenol red, eosin y, or methylene blue) that produce a detectable signal when a certain type of cells are cultured in the indicator media.

In some embodiments, the disclosure provides a composition comprising a dye and optionally a reagent for selective lysis of eukaryotic cells. In certain embodiments, the composition comprises both a dye and a reagent for selective lysis of eukaryotic cells. In some embodiments, the composition further comprises one or more reagents independently selected from the group consisting of: a second reagent for selective lysis of eukaryotic cells (e.g., Triton X-100), an electrolyte (e.g., $MgCl_2$), an anti-fungi reagent (e.g., amphotericin-B), and an antibiotic. In some embodiments, the composition comprises water and is in the form of an aqueous solution. In some embodiments, the composition is a solid or semi-solid. In some embodiments, the compositions described here are suitable for use in a kit or device for detecting or quantifying viable bacterial cells in a sample. In some embodiments, such a device is an ingestible device for detecting or quantifying viable bacterial cells in vivo (e.g., in the GI tract). In some embodiments, viable bacterial cells in a sample are detected or quantified in the presence of one or more antibiotics to determine antibiotic resistance of the bacteria in the sample. In some embodiments, anomalous bacterial populations in a sample may be detected or quantified, for example through the use of one a composition comprising a dye as disclosed herein, to determine whether a subject has an infection, such as Small Intestinal Bacterial Overgrowth (SIBO), or to characterize bacterial populations within the GI tract for diagnostic or other purposes.

In some embodiments, a method comprises: (a) contacting the sample with a composition as described herein; and (b) measuring total fluorescence or rate of change of fluorescence as a function of time of said sample, thereby detecting viable bacterial cells in said sample. In some embodiments, a control as described herein may be employed in the method. In some embodiments, the total fluorescence or the rate of change of fluorescence as a function of time of the sample is measured over multiple time points for an extended period of time in step (b), thereby detecting viable bacterial cells in said sample. In some embodiments, the method further comprises correlating the total fluorescence or the rate of change of fluorescence as a function of time determined in step (b) to the number of viable bacterial cells in the sample. In some embodiments, the rate of change of fluorescence as a function of time of the sample measured over multiple time points is determined and compared to the rate of change of fluorescence as a function of time of a control measured over the same time points to determine the number of viable bacterial cells in the sample. In some embodiments, the method does not require ex vivo plating or culturing. In some embodiments, the method does not require aspiration. In some embodiments, the method is performed in vivo (e.g., in an ingestible device in vivo). In some embodiments, the method comprises communicating the results of the onboard assay(s) to an ex vivo receiver.

In certain embodiments, a kit comprises a composition as described herein and instructions, e.g., for detecting or quantifying viable bacterial cells in a sample. In some embodiments, a device comprises a composition as described herein, e.g., for detecting or quantifying viable bacterial cells in a sample. The detection of live cells, as opposed to the detection of bacterial components (such as endotoxins) which can be present in the sample environment and lead to conflicting results, is the gold standard of viable plate counting and represents one of the advantages of the compositions and methods described herein.

The systems employ methods, compositions and detection systems found to accurately and reliably correlate fluorescence to total bacteria count (TBC) in an autonomous, ingestible device, or other similarly-sized device. The compositions include novel combinations of dyes, buffers and detergents that allow for the selective staining of viable bacterial cells in samples that comprise non-bacterial cells and other components that otherwise make detecting or quantifying live bacterial cells challenging. In some embodiments, the systems allow for bacteria to be quantified in near real-time and the results to be shared telemetrically outside of the device.

In certain embodiments, the disclosure provides a method of assessing or monitoring the need to treat a subject suffering from or at risk of overgrowth of bacterial cells in the gastrointestinal tract, which comprises: (a) obtaining a sample from the gastrointestinal tract of said subject; (b) contacting the sample with a composition as described herein; (c) measuring total fluorescence or rate of change of fluorescence as a function of time of said sample; and (d) correlating the total fluorescence or the rate of change of fluorescence as a function of time measured in step (c) to the number of viable bacterial cells in the sample, wherein the number of the viable bacterial cells determined in step (c) greater than about 105 CFU/mL, indicates a need for treatment, e.g., with an antibiotic agent as described herein. In some embodiments, a control as described herein may be employed in the method. In some embodiments, the total fluorescence or the rate of change of fluorescence as a function of time of the sample is measured over multiple time points for an extended period of time in step (c). In some embodiments, the rate of change of fluorescence as a function of time of the sample measured over multiple time points is determined and compared to the rate of change of fluorescence as a function of time of a control measured over the same time points to determine the number of viable bacterial cells in the sample. In some embodiments, the method does not require ex vivo plating or culturing. In some embodiments, the method does not require aspiration. In some embodiments, the method is performed in vivo (e.g., in an ingestible device in vivo). In some embodiments, the method comprises communicating the results of the onboard assay(s) to an ex vivo receiver. In some embodiments, the method may be further used to monitor the subject after the treatment (e.g., with an antibiotic). In some embodiments, the method may be used to assess the efficacy of the treatment. For example, efficacious treatment may be indicated by the decrease of the number of viable bacterial cells in a sample from the GI tract of the subject post-treatment. Efficacy of the treatment may be evaluated by the rate of decrease of the number of viable bacterial cells in a sample from the GI tract of the subject post-treatment. In some embodiments, the method may be used to detect infection with antibiotic-resistant strains of bacteria in a subject. For instance, such infection may be indicated where the number of viable bacterial cells in a sample from the GI tract of the subject does not substantially decrease after antibiotic treatment.

In some embodiments, the disclosure provides an absorbable material, (e.g., absorbable sponge), having absorbed therein a composition as described herein. In some embodiments, the absorbable sponge is Ahlstrom Grade 6613H (Lot 150191) or Porex PSU-567, having absorbed therein a composition as described herein. In some embodiments, the absorbable sponge may be prepared by injecting into the absorbable sponge an aqueous solution comprising a composition as described herein, and optionally further comprising a step of drying the resulting absorbable sponge.

In certain embodiments, the disclosure provides a method for detecting the presence of viable bacterial cells in a sample, which comprises: (a) fully or partially saturating an absorbable sponge as described herein, or an absorbable sponge prepared as described herein, with the sample; and (b) measuring total fluorescence or rate of change of fluorescence as a function of time of the fully or partially saturated sponge prepared in step (a), thereby detecting viable bacterial cells. In some embodiments, a control as described herein may be employed in the method. In some embodiments, the total fluorescence or the rate of change of fluorescence as a function of time of the fully or partially saturated sponge is measured over multiple time points for an extended period of time in step (b), thereby detecting viable bacterial cells in said sample. In some embodiments, the method further comprises correlating the total fluorescence or the rate of change of fluorescence as a function of time measured in step (b) to the number of viable bacterial cells in the sample. In some embodiments, the rate of change of fluorescence as a function of time of the fully or partially saturated sponge measured over multiple time points is determined and compared to the rate of change of fluorescence as a function of time of a control measured over the same time points to determine the number of viable bacterial cells in the sample. In some embodiments, the method does not require ex vivo plating or culturing. In some embodiments, the method does not require aspiration. In some embodiments, the method is performed in vivo (e.g., in an ingestible device in vivo). In some embodiments, the method comprises communicating the results of the onboard assay(s) to an ex vivo receiver.

In one aspect, provided herein is a kit comprising an absorbable sponge as described herein and instructions, e.g., for detecting or quantifying viable bacterial cells in a sample. In another aspect, provided herein is a device comprising an absorbable sponge as described herein, e.g., for detecting or quantifying viable bacterial cells in a sample.

In certain embodiments, the disclosure provides a method of assessing or monitoring the need to treat a subject suffering from or at risk of overgrowth of bacterial cells in the gastrointestinal tract, which comprises: (a) obtaining a sample from the gastrointestinal tract of said subject; (b) fully or partially saturating an absorbable sponge described herein, or an absorbable sponge prepared as described herein, with the sample; (c) measuring total fluorescence or rate of change of fluorescence as a function of time of the fully or partially saturated sponge prepared in step (b); (d) correlating the total fluorescence or the rate of change of fluorescence as a function of time measured in step (c) to the number of viable bacterial cells in the sample, wherein the number of the viable bacterial cells as determined in step (e) greater than about $10^5$ CFU/mL indicates a need for treatment, e.g., with an antibiotic agent as described herein. In some embodiments, a control as described herein may be employed in the method. In some embodiments, the total fluorescence or the rate of change of fluorescence as a function of time of the fully or partially saturated sponge is measured over multiple time points for an extended period of time in step (c). In some embodiments, the rate of change of fluorescence as a function of time of the fully or partially saturated sponge measured over multiple time points is determined and compared to the rate of change of fluorescence as a function of time of a control measured over the same time points to determine the number of viable bacterial cells in the sample. In some embodiments, the method does not require ex vivo plating or culturing. In some embodiments, the method does not require aspiration. In some embodiments, the method is performed in vivo (e.g., in an ingestible device in vivo). In some embodiments, the method comprises communicating the results of the onboard assay(s) to an ex vivo receiver. In some embodiments, the method may be further used to monitor the subject after the treatment (e.g., with an antibiotic). In some embodiments, the method may be used to assess the efficacy of the treatment. For example, efficacious treatment may be indicated by the decrease of the number of viable bacterial cells in a sample from the GI tract of the subject post-treatment. Efficacy of the treatment may be evaluated by the rate of decrease of the number of viable bacterial cells in a sample from the GI tract of the subject post-treatment. In some embodiments, the method may be used to detect infection with antibiotic-resistant strains of bacteria in a subject. For instance, such infection may be indicated where the number of viable bacterial cells in a sample from the GI tract of the subject does not substantially decrease after antibiotic treatment In certain embodiments, the disclosure provides and ingestible device comprising a housing; a first opening in the wall of the housing; a second opening in the first end of the housing; and a chamber connecting the first opening and the second opening, wherein at least a portion of the chamber forms a sampling chamber within the ingestible device. In some embodiments, the sampling chamber is configured to hold an absorbable sponge described herein. In some embodiments, the sampling chamber is configured to hold a sample obtained from a gastrointestinal (GI) tract of a body. In some embodiments, the ingestible device is individually calibrated (for example, by comparing to a positive or negative control as described herein), wherein the fluorescent properties of the absorbable sponge held in the sampling chamber of the device are determined prior to the introduction of the sample. The ingestible device as described herein is useful for detecting or quantifying viable bacterial cells in vivo. In some embodiments, provided herein is a method for detecting or quantifying viable bacterial cells in a GI tract sample in vivo using an ingestible device as described herein. In some embodiments, provided herein is a method of assessing or monitoring the need to treat a subject suffering from or at risk of overgrowth of bacterial cells in the GI tract in vivo using an ingestible device as described herein. In some embodiments, provided herein is a method of altering the treatment regimen of a subject suffering from or at risk of overgrowth of bacterial cells in the GI tract in vivo using an ingestible device as described herein. In one aspect, the subject is a subject suffering from or at risk of overgrowth of bacterial cells in the duodenum. In one aspect, the subject is a subject suffering from or at risk of overgrowth of bacterial cells in the jejunum. In one aspect, the subject is a subject suffering from or at risk of overgrowth of bacterial cells in the ileum. In one aspect, the subject is a subject suffering from or at risk of overgrowth of bacterial cells in the ascending colon. In one aspect, the subject is a subject suffering from or at risk of overgrowth of bacterial cells in the transverse colon. In one aspect, the subject is a subject suffering from or at risk of overgrowth of bacterial cells in the descending colon. In some embodiments, the method may be further used to monitor the subject after the treatment (e.g., with an antibiotic). In some embodiments, the method may be used to assess the efficacy of the treatment. For example, efficacious treatment may be indicated by the decrease of the number of viable bacterial cells in a sample from the GI tract of the subject post-treatment. Efficacy of the treatment may be evaluated by the rate of decrease of the number of viable bacterial cells in a sample from the GI tract of the subject post-treatment. In some embodiments, the method may be used to detect infection with antibiotic-resistant strains of bacteria in a subject. For instance, such infection may be indicated where the number of viable bacterial cells in a sample from the GI tract of the subject does not substantially decrease after antibiotic treatment. In some embodiments, the method is performed autonomously and does not require instructions, triggers or other inputs from outside the body after the device has been ingested.

"Eukaryotic" as recited herein relates to any type of eukaryotic organism excluding fungi, such as animals, in particular animals containing blood, and comprises invertebrate animals such as crustaceans and vertebrates. Vertebrates comprise both cold-blooded (fish, reptiles, amphibians) and warm blooded animal (birds and mammals). Mammals comprise in particular primates and more particularly humans "Selective lysis" as used herein is obtained in a sample when the percentage of bacterial cells in that sample that remain intact is significantly higher (e.g. 2, 5, 10, 20, 50, 100, 250, 500, or 1,000 times more) than the percentage of the eukaryotic cells in that sample that remain intact, upon treatment of or contact with a composition or device as described herein.

In some embodiments, the dye suitable for use herein is a dye that is capable of being internalized by a viable cell, binding to or reacting with a target component of the viable cell, and having fluorescence properties that are measurably altered when the dye is bound to or reacted with the target component of the viable cell. In some embodiments, the dye herein is actively internalized by penetrating viable cells through a process other than passible diffusion across cell membranes. Such internalization includes, but is not limited to, internalization through cell receptors on cell surfaces or through channels in cell membranes. In some embodiments, the target component of a viable cell to which the dye is bound to or reacted with is selected from the group consisting of: nucleic acids, actin, tubulin, enzymes, nucleotide-binding proteins, ion-transport proteins, mitochondria, cytoplasmic components, and membrane components. In some embodiments, the dye suitable for use herein is a fluorogenic dye that is capable of being internalized and metabolized by a viable cell, and wherein said dye fluoresces when metabolized by the viable cell. In some embodiments, the dye is a chemiluminescent dye that is capable of being internalized and metabolized by a viable cell, and wherein said dye becomes chemiluminescent when metabolized by the viable cell.

In some embodiments, the composition comprises a dye that fluoresces when bond to nucleic acids. Examples of such dyes include, but are not limited to, acridine orange (U.S. Pat. No. 4,190,328); calcein-AM (U.S. Pat. No. 5,314,805); DAPI; Hoechst 33342; Hoechst 33258; PicoGreen™; SYTO® 16; SYBR® Green I; Texas Red®; Redmond Red™; Bodipy® Dyes; Oregon Green™; ethidium bromide; and propidium iodide.

In some embodiments, the composition comprises a lipophilic dye that fluoresces when metabolized by a cell. In some embodiments, the dye fluoresces when reduced by a cell or a cell component. Examples of dyes that fluoresce when reduced include, but are not limited to, resazurin; C12-resazurin; 7-hydroxy-9H-(1,3 dichloro-9,9-dimethyl-acridin-2-ol) N-oxide; 6-chloro-9-nitro-5-oxo-5H-benzo[a]phenoxazine; and tetrazolium salts. In some embodiment, the dye fluoresces when oxidized by a cell or a cell component. Examples of such dyes include, but are not limited to, dihydrocalcein AM; dihydrorhodamine 123; dihydroethidium; 2,3,4,5,6-pentafluorotetramethyldihydrorosamine; and 3'-(p-aminophenyl) fluorescein.

In some embodiments, the composition comprises a dye that becomes chemiluminescent when oxidized by a cell or a cell component, such as luminol.

In some embodiments, the composition comprises a dye that fluoresces when de-acetylated and/or oxidized by a cell or a cell component. Examples of such dyes include, but are not limited to, dihydrorhodamines; dihydrofluoresceins; 2',7'-dichlorodihydrofluorescein diacetate; 5-(and 6-) carboxy-2',7'-dichlorodihydrofluorescein diacetate; and chloromethyl-2',7'-dichlorodihydrofluorescein diacetate acetyl ester.

In some embodiments, the composition comprises a dye that fluoresces when reacted with a peptidase. Examples of such dyes include, but are not limited to, (CBZ-Ala-Ala-Ala-Ala) 2-R110 elastase 2; (CBZ-Ala-Ala-Asp) 2-R110 granzyme B; and 7-amino-4-methylcoumarin, N-CBZ-L-aspartyl-L-glutamyl-L-valyl-L-aspartic acid amide.

In some embodiments, the composition comprises a dye selected from the group consisting of resazurin, FDA, Calcein AM, and SYTO® 9. In some embodiments, the dye is FDA or SYTO® 9.

SYTO® 9, when used alone, labels the nucleic acid of bacteria cells. The excitation/emission wavelengths for SYTO® 9 is 480/500 nm, with the background remaining non-fluorescent. See, e.g., J. Appl. Bacteriol. 72, 410 (1992); Lett. Appl. Microbiol. 13, 58 (1991); Curr. Microbiol. 4, 321 (1980); J. Microbiol. Methods 13, 87 (1991); and Microbiol. Rev. 51, 365 (1987); and J. Med. Microbiol. 39, 147 (1993).

FDA is a non-polar, non-fluorescent compound that can cross the membranes of mammalian and bacterial cells. The acetyl esterases (present only within viable cells) hydrolyze the FDA into the fluorescent compound fluorescein. Fluorescein is a fluorescent polar compound that is retained within these cells. Living cells can be visualized in a photospectrometer when assayed with an excitation wavelength of 494 nm and an emission wavelength of 518 nm. See, e.g., Brunius, G. (1980). *Technical aspects of the use of 3',6'—Diacetyl fluorescein for vital fluorescent staining of bacteria*. Current Microbiol. 4:321-323; Jones, K. H. and Senft, J. A. (1985). *An improved method to determine cellviability by simultaneous staining with fluorescein diacetate—propidium iodide*. J. Histochem. Cytochem. 33:77-79; Ross, R. D., Joncckis, C. C., Ordonez, J. V., Sisk, A. M., Wu, R. K., Hamburger, A. W., and Nora, R. E. (1989). *Estimation of cell survival by flow cytometric quantification of fluorescein diacetate/propidium iodide viable cell number*. Cancer Research. 49:3776-3782.

Calcein-AM, which is an acetoxylmethyl ester of calcein, is highly lipophilic and cell permeable. Calcein-AM in itself is not fluorescent, but the calcein generated by esterase in a viable cell emits a green fluorescence with an excitation wavelength of 490 nm and an emission of 515 nm. Therefore, Calcein-AM can only stain viable cells. See, e.g., Kimura, K., et al., *Neurosci. Lett.*, 208, 53 (1998); Shimokawa, I., et al., *J. Geronto.*, 51a, b49 (1998); Yoshida, S., et al., *Clin. Nephrol.*, 49, 273 (1998); and Tominaga, H., et al., *Anal. Commun.*, 36, 47 (1999).

Resazuirn (also known as Alamar Blue) is a blue compound that can be reduced to pink resorufin which is fluorescent. This dye is mainly used in viability assays for mammalian cells. $C^{12}$-resazurin has better cell permeability than resazurin. When lipohilic $C^{12}$-resazurin crosses the cell membranes, it is subsequently reduced by living cells to make a red fluorescent resorufin. The adsorption/emission of C12-resazurin is 563/587 nm. See, e.g., Appl Environ Microbiol 56, 3785 (1990); J Dairy Res 57, 239 (1990); J Neurosci Methods 70, 195 (1996); J Immunol Methods 210, 25 (1997); J Immunol Methods 213, 157 (1998); Antimicrob Agents Chemother 41, 1004 (1997).

In some embodiments, the composition optionally further comprises a reagent for selective lysis of eukaryotic cells. In some embodiments, the composition comprises a dye as described herein and a reagent for selective lysis of eukaryotic cells. In some embodiments, the reagent for selective lysis of eukaryotic cells is a detergent, such as a non-ionic or an ionic detergent. Examples of the reagent for selective lysis of eukaryotic cells include, but are not limited to, alkylglycosides, Brij 35 (C12E23 Polyoxyethyleneglycol dodecyl ether), Brij 58 (C16E20 Polyoxyethyleneglycol dodecyl ether), Genapol, glucanids such as MEGA-8,-9,-10, octylglucoside, Pluronic F127, Triton X-100 ($C_{14}H_{22}O$ ($C_2H_4O)_n$), Triton X-114 ($C_{24}H_{42}O_6$), Tween 20 (Polysorbate 20) and Tween 80 (Polysorbate 80), Nonidet P40, deoxycholate, reduced Triton X-100 and/or Igepal CA 630. In some embodiments, the composition comprises a dye as described herein and deoxycholate (e.g., sodium deoxycholate) as a reagent for selective lysis of eukaryotic cells. In some embodiments, the composition comprises deoxycholate at a concentration selected from 0.0001% to 1 wt %. In some embodiments, the composition comprises deoxycholate at a concentration of 0.005 wt %. In some embodiments, the composition may comprise more than one reagent for selective lysis of eukaryotic cells.

In some embodiments, the composition may comprise two different reagents for selective lysis of eukaryotic cells. In some instances, when more than one selective lysis reagents are used, more effective and/or complete selective lysis of eukaryotic cells in a sample may be achieved. For example, the composition may comprise deoxycholate (e.g., sodium deoxycholate) and Triton X-100 as two different reagents for selective lysis of eukaryotic cells. In some embodiments, the composition comprises deoxycholate (e.g., sodium deoxycholate) at a concentration selected from 0.0001% to 1 wt % (e.g., 0.005 wt %) and Triton X-100 at a concentration selected from 0.1 to 0.05 wt %.

In some embodiments, after a sample (e.g., a biological sample) is treated or contacted with a composition comprising a dye and one or more reagents for selective lysis of eukaryotic cells as described herein, the eukaryotic cells (e.g., animal cells) in the sample are selectively lysed whereby a substantial percentage (e.g., more than 20%, 40%, 60%, 80%, 90% or even more that 95%) of the bacterial cells in the same sample remains intact or alive.

In some embodiments, the composition does not comprise a reagent for selective lysis of eukaryotic cells, and such a composition is useful for detecting or quantifying viable bacterial cells in a sample (e.g., an environmental sample such as a water sample) that does not contain any eukaryotic cells.

In some embodiments, the composition further comprises an electrolyte, such as a divalent electrolyte (e.g., $MgCl_2$). In some embodiments, the composition comprises $MgCl_2$ at a concentration selected from 0.1 mM to 100 mM (e.g., a concentration selected from 0.5 mM to 50 mM).

In some embodiments, the composition further comprises water and is in a form of an aqueous solution. In some embodiments, the composition has a pH selected from 5-8 (e.g., a pH selected from 6-7.8, such as pH being 6.0). In some embodiments, the composition is a solid or a semi-solid.

In some embodiments, the composition further comprises an anti-fungal agent. Suitable anti-fungal agents for use herein include, but are not limited to, fungicidal and fungistatic agents including terbinafine, itraconazole, micronazole nitrate, thiapendazole, tolnaftate, clotrimazole and griseofulvin. In some embodiments, the anti-fungal agent is a polyene anti-fungal agent, such as amphotericin-B, nystatin, and pimaricin.

In some embodiments, the composition does not contain any anti-fungal agent. In some embodiments, the composition contains broad spectrum antibiotics but not any anti-fungal agent. Such compositions that do not contain anti-fungal agents but contain broad spectrum antibiotics may be useful in detecting or quantifying fungi (e.g., yeast) in a sample.

In some embodiments, the composition does not contain any anti-fungal agent, any antibiotics or any anti-mammalian agent. Such compositions that do not selectively lyse mammalian cells may be useful in detecting or quantifying mammalian cells (e.g., cells from the GI tract) in a sample since many dyes have a higher affinity for mammalian as compared to bacteria or fungi cells. In some embodiments, the composition contains broad spectrum antibiotics and one or more anti-fungal agents. Such compositions that contain anti-fungal agents and broad spectrum antibiotics may be useful in detecting or quantifying mammalian cells (e.g., cells from the GI tract) in a sample. The detection or quantification of mammalian cells may be useful for determining cell turnover in a subject. High cell turnover is sometimes associated with a GI injury (e.g., lesion), the presence of a tumor(s), or radiation-induced colitis or radiation enteropathy.

In some embodiments, the composition further comprises an antibiotic agent as described herein. Such a composition may be useful in detecting or quantifying antibiotic-resistant strains of bacteria in a sample.

In certain embodiments, the composition comprises Triton X-100, deoxycholate, resazurin, and $MgCl_2$. In some embodiments, the composition comprises Triton X-100, deoxycholate, resazurin, amphotericin-B and $MgCl_2$. In some embodiments, the composition comprises 0.1 wt % or 0.05 wt % Triton X-100; 0.005 wt % deoxycholate; 10 mM resazurin; 2.5 mg/L amphotericin-B and 50 mM $MgCl_2$. In some embodiments, the composition has a pH of 6.0.

In certain embodiments, the compositions are suitable for use in a kit or device, e.g., for detecting or quantifying viable bacterial cells in a sample. In some embodiments, such a device is an ingestible device for detecting or quantifying viable bacterial cells in vivo (e.g., in the GI tract).

Figure 62:
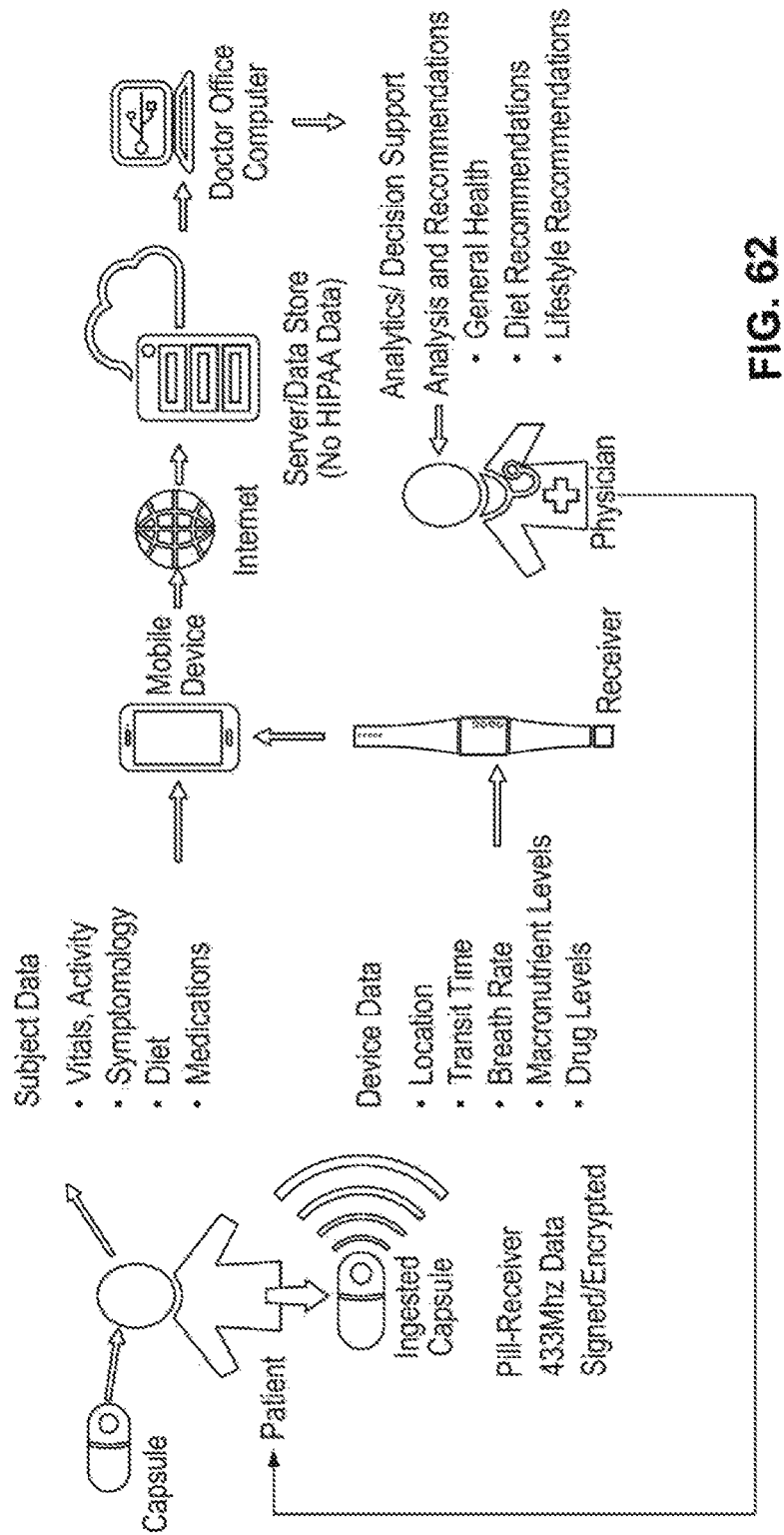
FIG. 62 illustrates a nonlimiting example of a system for collecting, communicating and/or analyzing data about a subject, using an ingestible device.
Figure 63A:
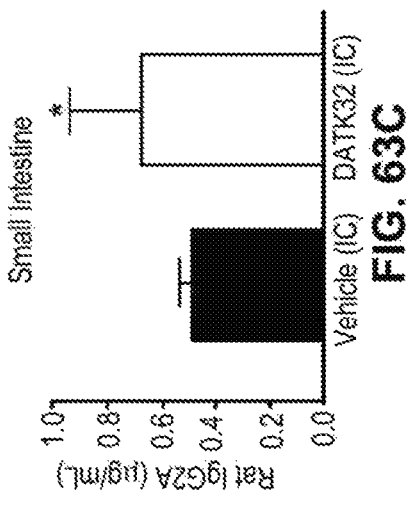
FIGS. 63A-63F are graphs showing rat IgG2A concentration as measured in (A) colon homogenate, (B) mLN homogenate, (C) small intestine homogenate, (D) cecum contents, (E) colon contents, and (F) plasma by ELISA. Standards were prepared with plasma matrix. Samples were diluted 1:50 before analysis. Sample 20 was removed from cecum contents analysis graph (outlier). *p<0.05; p<0.01; **p<0.001 were determined using the unpaired t test.
Figure 63B:
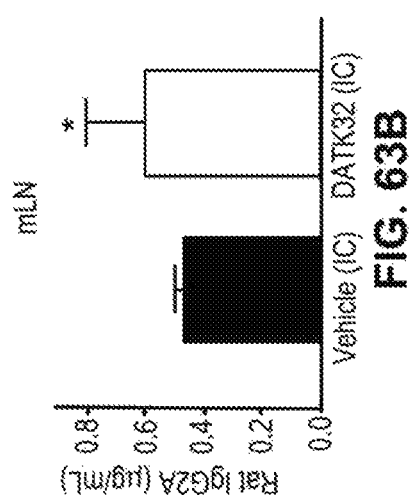
Figure 63C:
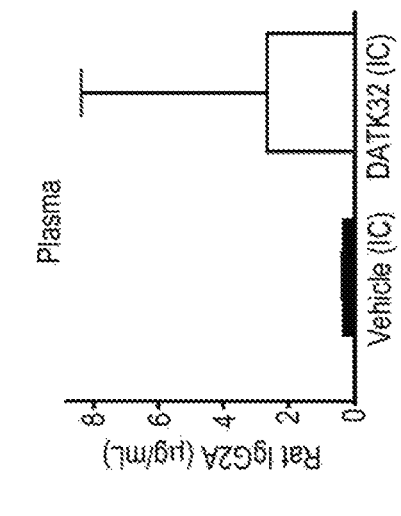
Figure 63D:
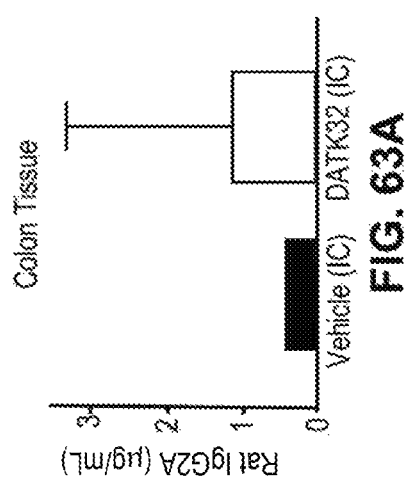
Figure 63E:
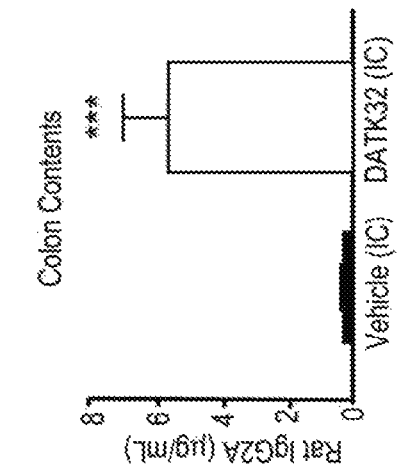
Figure 63F:
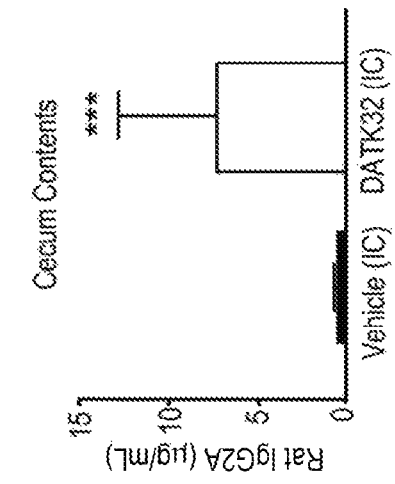

FIG. 62 illustrates a nonlimiting example of a system for collecting, communicating and/or analyzing data about a subject, using an ingestible device as disclosed herein. For example, an ingestible device may be configured to communicate with an external base station. As an example, an ingestible device can have a communications unit that communicates with an external base station which itself has a communications unit. FIG. 62 illustrates exemplary implementation of such an ingestible device. As shown in FIG. 62, a subject ingests an ingestible device as disclosed herein. Certain data about the subject (e.g., based on a collected sample) and/or the location of the ingestible device in the GI tract of the subject is collected or otherwise available and provided to a mobile device, which then forwards the data via the internet and a server/data store to a physician's office computer. The information collected by the ingestible device is communicated to a receiver, such as, for example, a watch or other object worn by the subject. The information is then communicated from the receiver to the mobile device which then forwards the data via the internet and a server/data store to a physician's office computer. The physician is then able to analyze some or all of the data about the subject to provide recommendations, such as, for example, delivery a therapeutic agent. While FIG. 62 shows a particular approach to collecting and transferring data about a subject, the disclosure is not limited. As an example, one or more of the receiver, mobile device, internet, and/or server/data store can be excluded from the data communication channel. For example, a mobile device can be used as the receiver of the device data, e.g., by using a dongle. In such embodiments, the item worn by the subject need not be part of the communication chain. As another example, one or more of the items in the data communication channel can be replaced with an alternative item. For example, rather than be provided to a physician's office computer, data may be provided to a service provider network, such as a hospital network, an HMO network, or the like. In some embodiments, subject data may be collected and/or stored in one location (e.g., a server/data store) while device data may be collected and/or stored in a different location (e.g., a different server/data store).

Locations of Release

In some embodiments the method comprises releasing at least 80% of the immune modulator at a location proximate to an intended site of release in the GI tract. In some embodiments the method comprise releasing at least 90% of the immune modulator at a location proximate to an intended site of release in the GI tract. In some embodiments the method comprises releasing at least 95% of the immune modulator at a location proximate to an intended site of release in the GI tract. In some embodiments the method comprises releasing at least 96% of the immune modulator at a location proximate to an intended site of release in the GI tract. In some embodiments the method comprises releasing at least 97% of the immune modulator at a location proximate to an intended site of release in the GI tract. In some embodiments the method comprises releasing at least 98% of the immune modulator at a location proximate to an intended site of release in the GI tract. In some embodiments, the at least 80%, at least 90%, at least 95%, at least 96%, at least 97%, or at least 98% of the immune modulator is delivered 150 cm or less from the one or more intended sites of release in the GI tract. In some embodiments, the at least 80%, at least 90%, at least 95%, at least 96%, at least 97%, or at least 98% of the immune modulator is delivered 125 cm or less from the one or more intended sites of release in the GI tract. In some embodiments, the at least 80%, at least 90%, at least 95%, at least 96%, at least 97%, or at least 98% of the immune modulator is delivered 100 cm or less from the one or more intended sites of release in the GI tract. In some embodiments, the at least 80%, at least 90%, at least 95%, at least 96%, at least 97%, or at least 98% of the immune modulator is delivered 50 cm or less from the one or more intended sites of release in the GI tract. In some embodiments, the at least 80%, at least 90%, at least 95%, at least 96%, at least 97%, or at least 98% of the immune modulator is delivered 40 cm or less from the one or more intended sites of release in the GI tract. In some embodiments, the at least 80%, at least 90%, at least 95%, at least 96%, at least 97%, or at least 98% of the immune modulator is delivered 30 cm or less from the one or more intended sites of release in the GI tract. In some embodiments, the at least 80%, at least 90%, at least 95%, at least 96%, at least 97%, or at least 98% of the immune modulator is delivered 20 cm or less from the one or more intended sites of release in the GI tract. In some embodiments, the at least 80%, at least 90%, at least 95%, at least 96%, at least 97%, or at least 98% of the immune modulator is delivered 10 cm or less from the one or more intended sites of release in the GI tract. In some embodiments, the at least 80%, at least 90%, at least 95%, at least 96%, at least 97%, or at least 98% of the immune modulator is delivered 5 cm or less from the one or more intended sites of release in the GI tract. In some embodiments, the at least 80%, at least 90%, at least 95%, at least 96%, at least 97%, or at least 98% of the immune modulator is delivered 2 cm or less from the one or more intended sites of release in the GI tract. In some embodiments, the method further comprises using an ingestible device to deliver the immune modulator and using localization methods disclosed herein (e.g., such as discussed in Example 14 below) to determine the location of the ingestible device within the GI tract (e.g., relative to the intended sites of release). In some embodiments, the method further comprises using an ingestible device to deliver the immune modulator and determining the period of time since the ingestible device was ingested to determine the location of the ingestible device within the GI tract (e.g., relative to the intended sites of release in the GI tract).

In some embodiments, the amount of the immune modulator that is administered to the human is in a range from 2 mg to 200 mg. In some embodiments, the amount of the immune modulator that is administered to the human is in a range from 3 mg to 100 mg. In some embodiments, the amount of the immune modulator that is administered to the human is in a range from 4 mg to 80 mg. In some embodiments, the amount of the immune modulator that is administered to the human is in a range from 4 mg to 70 mg. In some embodiments, the amount of the immune modulator that is administered to the human is in a range from 4 mg to 60 mg. In some embodiments, the amount of the immune modulator that is administered to the human is in a range from 4 mg to 50 mg. In some embodiments, the amount of the immune modulator that is administered to the human is in a range from 2 mg to 20 mg. In some embodiments, the amount of the immune modulator that is administered to the human is in a range from 3 mg to 10 mg. In some embodiments, the amount of the immune modulator that is administered to the human is in a range from 4 mg to 8 mg. In some embodiments, the amount of the immune modulator that is administered to the human is in a range from 4 mg to 7 mg. In some embodiments, the amount of the immune modulator that is administered to the human is in a range from 4 mg to 6 mg. In some embodiments, the amount of the immune modulator that is administered to the human is in a range from 4 mg to 5 mg. In some embodiments, the amount of the immune modulator that is administered to the human is in a range from 20 mg to 200 mg. In some embodiments, the amount of the immune modulator that is administered to the human is in a range from 30 mg to 100 mg. In some embodiments, the amount of the immune modulator that is administered to the human is in a range from 40 mg to 80 mg. In some embodiments, the amount of the immune modulator that is administered to the human is in a range from 40 mg to 70 mg. In some embodiments, the amount of the immune modulator that is administered to the human is in a range from 40 mg to 60 mg. In some embodiments, the amount of the immune modulator that is administered to the human is in a range from 40 mg to 50 mg.

In some embodiments the method comprises releasing the immune modulator at a location that is proximate to an intended site of release, wherein the immune modulator and, if applicable, any carriers, excipients or stabilizers admixed with the immune modulator, are substantially unchanged, at the time of release of the immune modulator at the location, relatively to the time of administration of the composition to the subject.

In some embodiments the method comprises releasing the immune modulator at a location that is proximate to an intended site of release, wherein the immune modulator and, if applicable, any carriers, excipients or stabilizers admixed with the immune modulator, are substantially unchanged by any physiological process (such as, but not limited to, degradation in the stomach), at the time of release of the immune modulator at the location, relatively to the time of administration of the composition to the subject.

In some embodiments, the immune modulator is delivered to the location by mucosal contact.

In some examples, a method of treatment disclosed herein includes determining the level of inflammation at a site of disease (e.g., in a tissue originating from the endoderm) at a time point following administration of the device that is elevated as compared to a level of the immune modulator at the same site of disease or location at substantially the same time point in a subject following systemic (e.g., subcutaneous or intravenous) administration of an equal amount of the immune modulator.

In some examples where the immune modulator is administered to a subject using any of the compositions or devices described herein, the immune modulator can penetrate the GI tissue of the subject. As used herein, "GI tissue" refers to tissue in the gastrointestinal (GI) tract, such as tissue in one or more of duodenum, jejunum, ileum, cecum, ascending colon, transverse colon, descending colon, sigmoid colon, and rectum. In one particular embodiment, GI tissue refers to tissue in the proximal portion of one or more of duodenum, jejunum, ileum, cecum, ascending colon, transverse colon, descending colon, and sigmoid colon. In one particular embodiment, GI tissue refers to tissue in the distal portion of one or more of duodenum, jejunum, ileum, cecum, ascending colon, transverse colon, descending colon, and sigmoid colon. The GI tissue may be, for example, GI tissue proximate to one or more sites of disease. Accordingly, in some embodiments the immune modulator can penetrate the duodenum tissue proximate to one or more intended sites of release. In some embodiments the immune modulator can penetrate the jejunum tissue proximate to one or more intended sites of release. In some embodiments the immune modulator can penetrate the ileum tissue proximate to one or more intended sites of release. In some embodiments the immune modulator can penetrate the cecum tissue proximate to one or more intended sites of release. In some embodiments the immune modulator can penetrate the ascending colon tissue proximate to one or more intended sites of release. In some embodiments the immune modulator can penetrate the transverse colon tissue proximate to one or more intended sites of release. In some embodiments the immune modulator can penetrate the descending colon tissue proximate to one or more intended sites of release. In some embodiments the immune modulator can penetrate the sigmoid colon tissue proximate to one or more intended sites of release. For example, an immune modulator can penetrate one or more (e.g., two, three, or four) of the lumen/superficial mucosa, the lamina propria, the submucosa, and the tunica muscularis/serosa.

In some examples, administration of an immune modulator using any of the compositions or devices described herein results in penetration (e.g., a detectable level of penetration) of GI tissue (e.g., one or more (e.g., two, three, or four) of the lumen/superficial mucosa, the lamina propria, the submucosa, and the tunica muscularis/serosa) within a time period of about 10 minutes to about 10 hours, about 10 minutes to about 9 hours, about 10 minutes to about 8 hours, about 10 minutes to about 7 hours, about 10 minutes to about 6 hours, about 10 minutes to about 5 hours, about 10 minutes to about 4.5 hours, about 10 minutes to about 4 hours, about 10 minutes to about 3.5 hours, about 10 minutes to about 3 hours, about 10 minutes to about 2.5 hours, about 10 minutes to about 2 hours, about 10 minutes to about 1.5 hours, about 10 minutes to about 1 hour, about 10 minutes to about 55 minutes, about 10 minutes to about 50 minutes, about 10 minutes to about 45 minutes, about 10 minutes to about 40 minutes, about 10 minutes to about 35 minutes, about 10 minutes to about 30 minutes, about 10 minutes to about 25 minutes, about 10 minutes to about 20 minutes, about 10 minutes to about 15 minutes, about 15 minutes to about 10 hours, about 15 minutes to about 9 hours, about 15 minutes to about 8 hours, about 15 minutes to about 7 hours, about 15 minutes to about 6 hours, about 15 minutes to about 5 hours, about 15 minutes to about 4.5 hours, about 15 minutes to about 4 hours, about 15 minutes to about 3.5 hours, about 15 minutes to about 3 hours, about 15 minutes to about 2.5 hours, about 15 minutes to about 2 hours, about 15 minutes to about 1.5 hours, about 15 minutes to about 1 hour, about 15 minutes to about 55 minutes, about 15 minutes to about 50 minutes, about 15 minutes to about 45 minutes, about 15 minutes to about 40 minutes, about 15 minutes to about 35 minutes, about 15 minutes to about 30 minutes, about 15 minutes to about 25 minutes, about 15 minutes to about 20 minutes, about 20 minutes to about 10 hours, about 20 minutes to about 9 hours, about 20 minutes to about 8 hours, about 20 minutes to about 7 hours, about 20 minutes to about 6 hours, about 20 minutes to about 5 hours, about 20 minutes to about 4.5 hours, about 20 minutes to about 4 hours, about 20 minutes to about 3.5 hours, about 20 minutes to about 3 hours, about 20 minutes to about 2.5 hours, about 20 minutes to about 2 hours, about 20 minutes to about 1.5 hours, about 20 minutes to about 1 hour, about 20 minutes to about 55 minutes, about 20 minutes to about 50 minutes, about 20 minutes to about 45 minutes, about 20 minutes to about 40 minutes, about 20 minutes to about 35 minutes, about 20 minutes to about 30 minutes, about 20 minutes to about 25 minutes, about 25 minutes to about 10 hours, about 25 minutes to about 9 hours, about 25 minutes to about 8 hours, about 25 minutes to about 7 hours, about 25 minutes to about 6 hours, about 25 minutes to about 5 hours, about 25 minutes to about 4.5 hours, about 25 minutes to about 4 hours, about 25 minutes to about 3.5 hours, about 25 minutes to about 3 hours, about 25 minutes to about 2.5 hours, about 25 minutes to about 2 hours, about 25 minutes to about 1.5 hours, about 25 minutes to about 1 hour, about 25 minutes to about 55 minutes, about 25 minutes to about 50 minutes, about 25 minutes to about 45 minutes, about 25 minutes to about 40 minutes, about 25 minutes to about 35 minutes, about 25 minutes to about 30 minutes, about 30 minutes to about 10 hours, about 30 minutes to about 9 hours, about 30 minutes to about 8 hours, about 30 minutes to about 7 hours, about 30 minutes to about 6 hours, about 30 minutes to about 5 hours, about 30 minutes to about 4.5 hours, about 30 minutes to about 4 hours, about 30 minutes to about 3.5 hours, about 30 minutes to about 3 hours, about 30 minutes to about 2.5 hours, about 30 minutes to about 2 hours, about 30 minutes to about 1.5 hours, about 30 minutes to about 1 hour, about 30 minutes to about 55 minutes, about 30 minutes to about 50 minutes, about 30 minutes to about 45 minutes, about 30 minutes to about 40 minutes, about 30 minutes to about 35 minutes, about 35 minutes to about 10 hours, about 35 minutes to about 9 hours, about 35 minutes to about 8 hours, about 35 minutes to about 7 hours, about 35 minutes to about 6 hours, about 35 minutes to about 5 hours, about 35 minutes to about 4.5 hours, about 35 minutes to about 4 hours, about 35 minutes to about 3.5 hours, about 35 minutes to about 3 hours, about 35 minutes to about 2.5 hours, about 35 minutes to about 2 hours, about 35 minutes to about 1.5 hours, about 35 minutes to about 1 hour, about 35 minutes to about 55 minutes, about 35 minutes to about 50 minutes, about 35 minutes to about 45 minutes, about 35 minutes to about 40 minutes, about 40 minutes to about 10 hours, about 40 minutes to about 9 hours, about 40 minutes to about 8 hours, about 40 minutes to about 7 hours, about 40 minutes to about 6 hours, about 40 minutes to about 5 hours, about 40 minutes to about 4.5 hours, about 40 minutes to about 4 hours, about 40 minutes to about 3.5 hours, about 40 minutes to about 3 hours, about 40 minutes to about 2.5 hours, about 40 minutes to about 2 hours, about 40 minutes to about 1.5 hours, about 40 minutes to about 1 hour, about 40 minutes to about 55 minutes, about 40 minutes to about 50 minutes, about 40 minutes to about 45 minutes, about 45 minutes to about 10 hours, about 45 minutes to about 9 hours, about 45 minutes to about 8 hours, about 45 minutes to about 7 hours, about 45 minutes to about 6 hours, about 45 minutes to about 5 hours, about 45 minutes to about 4.5 hours, about 45 minutes to about 4 hours, about 45 minutes to about 3.5 hours, about 45 minutes to about 3 hours, about 45 minutes to about 2.5 hours, about 45 minutes to about 2 hours, about 45 minutes to about 1.5 hours, about 45 minutes to about 1 hour, about 45 minutes to about 55 minutes, about 45 minutes to about 50 minutes, about 50 minutes to about 10 hours, about 50 minutes to about 9 hours, about 50 minutes to about 8 hours, about 50 minutes to about 7 hours, about 50 minutes to about 6 hours, about 50 minutes to about 5 hours, about 50 minutes to about 4.5 hours, about 50 minutes to about 4 hours, about 50 minutes to about 3.5 hours, about 50 minutes to about 3 hours, about 50 minutes to about 2.5 hours, about 50 minutes to about 2 hours, about 50 minutes to about 1.5 hours, about 50 minutes to about 1 hour, about 50 minutes to about 55 minutes, about 55 minutes to about 10 hours, about 55 minutes to about 9 hours, about 55 minutes to about 8 hours, about 55 minutes to about 7 hours, about 55 minutes to about 6 hours, about 55 minutes to about 5 hours, about 55 minutes to about 4.5 hours, about 55 minutes to about 4 hours, about 55 minutes to about 3.5 hours, about 55 minutes to about 3 hours, about 55 minutes to about 2.5 hours, about 55 minutes to about 2 hours, about 55 minutes to about 1.5 hours, about 55 minutes to about 1 hour, about 1 hour to about 10 hours, about 1 hour to about 9 hours, about 1 hour to about 8 hours, about 1 hour to about 7 hours, about 1 hour to about 6 hours, about 1 hour to about 5 hours, about 1 hour to about 4.5 hours, about 1 hour to about 4 hours, about 1 hour to about 3.5 hours, about 1 hour to about 3 hours, about 1 hour to about 2.5 hours, about 1 hour to about 2 hours, about 1 hour to about 1.5 hours, about 1.5 hours to about 10 hours, about 1.5 hours to about 9 hours, about 1.5 hours to about 8 hours, about 1.5 hours to about 7 hours, about 1.5 hours to about 6 hours, about 1.5 hours to about 5 hours, about 1.5 hours to about 4.5 hours, about 1.5 hours to about 4 hours, about 1.5 hours to about 3.5 hours, about 1.5 hours to about 3 hours, about 1.5 hours to about 2.5 hours, about 1.5 hours to about 2 hours, about 2 hours to about 10 hours, about 2 hours to about 9 hours, about 2 hours to about 8 hours, about 2 hours to about 7 hours, about 2 hours to about 6 hours, about 2 hours to about 5 hours, about 2 hours to about 4.5 hours, about 2 hours to about 4 hours, about 2 hours to about 3.5 hours, about 2 hours to about 3 hours, about 2 hours to about 2.5 hours, about 2.5 hours to about 10 hours, about 2.5 hours to about 9 hours, about 2.5 hours to about 8 hours, about 2.5 hours to about 7 hours, about 2.5 hours to about 6 hours, about 2.5 hours to about 5 hours, about 2.5 hours to about 4.5 hours, about 2.5 hours to about 4 hours, about 2.5 hours to about 3.5 hours, about 2.5 hours to about 3 hours, about 3 hours to about 10 hours, about 3 hours to about 9 hours, about 3 hours to about 8 hours, about 3 hours to about 7 hours, about 3 hours to about 6 hours, about 3 hours to about 5 hours, about 3 hours to about 4.5 hours, about 3 hours to about 4 hours, about 3 hours to about 3.5 hours, about 3.5 hours to about 10 hours, about 3.5 hours to about 9 hours, about 3.5 hours to about 8 hours, about 3.5 hours to about 7 hours, about 3.5 hours to about 6 hours, about 3.5 hours to about 5 hours, about 3.5 hours to about 4.5 hours, about 3.5 hours to about 4 hours, about 4 hours to about 10 hours, about 4 hours to about 9 hours, about 4 hours to about 8 hours, about 4 hours to about 7 hours, about 4 hours to about 6 hours, about 4 hours to about 5 hours, about 4 hours to about 4.5 hours, about 4.5 hours to about 10 hours, about 4.5 hours to about 9 hours, about 4.5 hours to about 8 hours, about 4.5 hours to about 7 hours, about 4.5 hours to about 6 hours, about 4.5 hours to about 5 hours, about 5 hours to about 10 hours, about 5 hours to about 9 hours, about 5 hours to about 8 hours, about 5 hours to about 7 hours, about 5 hours to about 6 hours, about 6 hours to about 10 hours, about 6 hours to about 9 hours, about 6 hours to about 8 hours, about 6 hours to about 7 hours, about 7 hours to about 10 hours, about 7 hours to about 9 hours, about 7 hours to about 8 hours, about 8 hours to about 10 hours, about 8 hours to about 9 hours, or about 9 hours to about 10 hours. Penetration of GI tissue by an immune modulator can be detected by administering a labeled antibody or labeled antigen-binding antibody fragment, and performing imaging on the subject (e.g., ultrasound, computed tomography, or magnetic resonance imaging). For example, the label can be a radioisotope, a heavy metal, a fluorophore, or a luminescent agent (e.g., any suitable radioisotopes, heavy metals, fluorophores, or luminescent agents used for imaging known in the art).

In some embodiments, administration of an immune modulator can provide for treatment (e.g., a reduction in the number, severity, and/or duration of one or more symptoms of any of the disorders described herein in a subject) for a time period of between about 1 hour to about 30 days, about 1 hour to about 28 days, about 1 hour to about 26 days, about 1 hour to about 24 days, about 1 hour to about 22 days, about 1 hour to about 20 days, about 1 hour to about 18 days, about 1 hour to about 16 days, about 1 hour to about 14 days, about 1 hour to about 12 days, about 1 hour to about 10 days, about 1 hour to about 8 days, about 1 hour to about 6 days, about 1 hour to about 5 days, about 1 hour to about 4 days, about 1 hour to about 3 days, about 1 hour to about 2 days, about 1 hour to about 1 day, about 1 hour to about 12 hours, about 1 hour to about 6 hours, about 1 hour to about 3 hours, about 3 hours to about 30 days, about 3 hours to about 28 days, about 3 hours to about 26 days, about 3 hours to about 24 days, about 3 hours to about 22 days, about 3 hours to about 20 days, about 3 hours to about 18 days, about 3 hours to about 16 days, about 3 hours to about 14 days, about 3 hours to about 12 days, about 3 hours to about 10 days, about 3 hours to about 8 days, about 3 hours to about 6 days, about 3 hours to about 5 days, about 3 hours to about 4 days, about 3 hours to about 3 days, about 3 hours to about 2 days, about 3 hours to about 1 day, about 3 hours to about 12 hours, about 3 hours to about 6 hours, about 6 hours to about 30 days, about 6 hours to about 28 days, about 6 hours to about 26 days, about 6 hours to about 24 days, about 6 hours to about 22 days, about 6 hours to about 20 days, about 6 hours to about 18 days, about 6 hours to about 16 days, about 6 hours to about 14 days, about 6 hours to about 12 days, about 6 hours to about 10 days, about 6 hours to about 8 days, about 6 hours to about 6 days, about 6 hours to about 5 days, about 6 hours to about 4 days, about 6 hours to about 3 days, about 6 hours to about 2 days, about 6 hours to about 1 day, about 6 hours to about 12 hours, about 12 hours to about 30 days, about 12 hours to about 28 days, about 12 hours to about 26 days, about 12 hours to about 24 days, about 12 hours to about 22 days, about 12 hours to about 20 days, about 12 hours to about 18 days, about 12 hours to about 16 days, about 12 hours to about 14 days, about 12 hours to about 12 days, about 12 hours to about 10 days, about 12 hours to about 8 days, about 12 hours to about 6 days, about 12 hours to about 5 days, about 12 hours to about 4 days, about 12 hours to about 3 days, about 12 hours to about 2 days, about 12 hours to about 1 day, about 1 day to about 30 days, about 1 day to about 28 days, about 1 day to about 26 days, about 1 day to about 24 days, about 1 day to about 22 days, about 1 day to about 20 days, about 1 day to about 18 days, about 1 day to about 16 days, about 1 day to about 14 days, about 1 day to about 12 days, about 1 day to about 10 days, about 1 day to about 8 days, about 1 day to about 6 days, about 1 day to about 5 days, about 1 day to about 4 days, about 1 day to about 3 days, about 1 day to about 2 days, about 2 days to about 30 days, about 2 days to about 28 days, about 2 days to about 26 days, about 2 days to about 24 days, about 2 days to about 22 days, about 2 days to about 20 days, about 2 days to about 18 days, about 2 days to about 16 days, about 2 days to about 14 days, about 2 days to about 12 days, about 2 days to about 10 days, about 2 days to about 8 days, about 2 days to about 6 days, about 2 days to about 5 days, about 2 days to about 4 days, about 2 days to about 3 days, about 3 days to about 30 days, about 3 days to about 28 days, about 3 days to about 26 days, about 3 days to about 24 days, about 3 days to about 22 days, about 3 days to about 20 days, about 3 days to about 18 days, about 3 days to about 16 days, about 3 days to about 14 days, about 3 days to about 12 days, about 3 days to about 10 days, about 3 days to about 8 days, about 3 days to about 6 days, about 3 days to about 5 days, about 3 days to about 4 days, about 4 days to about 30 days, about 4 days to about 28 days, about 4 days to about 26 days, about 4 days to about 24 days, about 4 days to about 22 days, about 4 days to about 20 days, about 4 days to about 18 days, about 4 days to about 16 days, about 4 days to about 14 days, about 4 days to about 12 days, about 4 days to about 10 days, about 4 days to about 8 days, about 4 days to about 6 days, about 4 days to about 5 days, about 5 days to about 30 days, about 5 days to about 28 days, about 5 days to about 26 days, about 5 days to about 24 days, about 5 days to about 22 days, about 5 days to about 20 days, about 5 days to about 18 days, about 5 days to about 16 days, about 5 days to about 14 days, about 5 days to about 12 days, about 5 days to about 10 days, about 5 days to about 8 days, about 5 days to about 6 days, about 6 days to about 30 days, about 6 days to about 28 days, about 6 days to about 26 days, about 6 days to about 24 days, about 6 days to about 22 days, about 6 days to about 20 days, about 6 days to about 18 days, about 6 days to about 16 days, about 6 days to about 14 days, about 6 days to about 12 days, about 6 days to about 10 days, about 6 days to about 8 days, about 8 days to about 30 days, about 8 days to about 28 days, about 8 days to about 26 days, about 8 days to about 24 days, about 8 days to about 22 days, about 8 days to about 20 days, about 8 days to about 18 days, about 8 days to about 16 days, about 8 days to about 14 days, about 8 days to about 12 days, about 8 days to about 10 days, about 10 days to about 30 days, about 10 days to about 28 days, about 10 days to about 26 days, about 10 days to about 24 days, about 10 days to about 22 days, about 10 days to about 20 days, about 10 days to about 18 days, about 10 days to about 16 days, about 10 days to about 14 days, about 10 days to about 12 days, about 12 days to about 30 days, about 12 days to about 28 days, about 12 days to about 26 days, about 12 days to about 24 days, about 12 days to about 22 days, about 12 days to about 20 days, about 12 days to about 18 days, about 12 days to about 16 days, about 12 days to about 14 days, about 14 days to about 30 days, about 14 days to about 28 days, about 14 days to about 26 days, about 14 days to about 24 days, about 14 days to about 22 days, about 14 days to about 20 days, about 14 days to about 18 days, about 14 days to about 16 days, about 16 days to about 30 days, about 16 days to about 28 days, about 16 days to about 26 days, about 16 days to about 24 days, about 16 days to about 22 days, about 16 days to about 20 days, about 16 days to about 18 days, about 18 days to about 30 days, about 18 days to about 28 days, about 18 days to about 26 days, about 18 days to about 24 days, about 18 days to about 22 days, about 18 days to about 20 days, about 20 days to about 30 days, about 20 days to about 28 days, about 20 days to about 26 days, about 20 days to about 24 days, about 20 days to about 22 days, about 22 days to about 30 days, about 22 days to about 28 days, about 22 days to about 26 days, about 22 days to about 24 days, about 24 days to about 30 days, about 24 days to about 28 days, about 24 days to about 26 days, about 26 days to about 30 days, about 26 days to about 28 days, or about 28 days to about 30 days in a subject following first administration of an immune modulator using any of the compositions or devices described herein. Non-limiting examples of symptoms of a disease described herein are described below.

For example, treatment can result in a decrease (e.g., about 1% to about 99% decrease, about 1% to about 95% decrease, about 1% to about 90% decrease, about 1% to about 85% decrease, about 1% to about 80% decrease, about 1% to about 75% decrease, about 1% to about 70% decrease, about 1% to about 65% decrease, about 1% to about 60% decrease, about 1% to about 55% decrease, about 1% to about 50% decrease, about 1% to about 45% decrease, about 1% to about 40% decrease, about 1% to about 35% decrease, about 1% to about 30% decrease, about 1% to about 25% decrease, about 1% to about 20% decrease, about 1% to about 15% decrease, about 1% to about 10% decrease, about 1% to about 5% decrease, about 5% to about 99% decrease, about 5% to about 95% decrease, about 5% to about 90% decrease, about 5% to about 85% decrease, about 5% to about 80% decrease, about 5% to about 75% decrease, about 5% to about 70% decrease, about 5% to about 65% decrease, about 5% to about 60% decrease, about 5% to about 55% decrease, about 5% to about 50% decrease, about 5% to about 45% decrease, about 5% to about 40% decrease, about 5% to about 35% decrease, about 5% to about 30% decrease, about 5% to about 25% decrease, about 5% to about 20% decrease, about 5% to about 15% decrease, about 5% to about 10% decrease, about 10% to about 99% decrease, about 10% to about 95% decrease, about 10% to about 90% decrease, about 10% to about 85% decrease, about 10% to about 80% decrease, about 10% to about 75% decrease, about 10% to about 70% decrease, about 10% to about 65% decrease, about 10% to about 60% decrease, about 10% to about 55% decrease, about 10% to about 50% decrease, about 10% to about 45% decrease, about 10% to about 40% decrease, about 10% to about 35% decrease, about 10% to about 30% decrease, about 10% to about 25% decrease, about 10% to about 20% decrease, about 10% to about 15% decrease, about 15% to about 99% decrease, about 15% to about 95% decrease, about 15% to about 90% decrease, about 15% to about 85% decrease, about 15% to about 80% decrease, about 15% to about 75% decrease, about 15% to about 70% decrease, about 15% to about 65% decrease, about 15% to about 60% decrease, about 15% to about 55% decrease, about 15% to about 50% decrease, about 15% to about 45% decrease, about 15% to about 40% decrease, about 15% to about 35% decrease, about 15% to about 30% decrease, about 15% to about 25% decrease, about 15% to about 20% decrease, about 20% to about 99% decrease, about 20% to about 95% decrease, about 20% to about 90% decrease, about 20% to about 85% decrease, about 20% to about 80% decrease, about 20% to about 75% decrease, about 20% to about 70% decrease, about 20% to about 65% decrease, about 20% to about 60% decrease, about 20% to about 55% decrease, about 20% to about 50% decrease, about 20% to about 45% decrease, about 20% to about 40% decrease, about 20% to about 35% decrease, about 20% to about 30% decrease, about 20% to about 25% decrease, about 25% to about 99% decrease, about 25% to about 95% decrease, about 25% to about 90% decrease, about 25% to about 85% decrease, about 25% to about 80% decrease, about 25% to about 75% decrease, about 25% to about 70% decrease, about 25% to about 65% decrease, about 25% to about 60% decrease, about 25% to about 55% decrease, about 25% to about 50% decrease, about 25% to about 45% decrease, about 25% to about 40% decrease, about 25% to about 35% decrease, about 25% to about 30% decrease, about 30% to about 99% decrease, about 30% to about 95% decrease, about 30% to about 90% decrease, about 30% to about 85% decrease, about 30% to about 80% decrease, about 30% to about 75% decrease, about 30% to about 70% decrease, about 30% to about 65% decrease, about 30% to about 60% decrease, about 30% to about 55% decrease, about 30% to about 50% decrease, about 30% to about 45% decrease, about 30% to about 40% decrease, about 30% to about 35% decrease, about 35% to about 99% decrease, about 35% to about 95% decrease, about 35% to about 90% decrease, about 35% to about 85% decrease, about 35% to about 80% decrease, about 35% to about 75% decrease, about 35% to about 70% decrease, about 35% to about 65% decrease, about 35% to about 60% decrease, about 35% to about 55% decrease, about 35% to about 50% decrease, about 35% to about 45% decrease, about 35% to about 40% decrease, about 40% to about 99% decrease, about 40% to about 95% decrease, about 40% to about 90% decrease, about 40% to about 85% decrease, about 40% to about 80% decrease, about 40% to about 75% decrease, about 40% to about 70% decrease, about 40% to about 65% decrease, about 40% to about 60% decrease, about 40% to about 55% decrease, about 40% to about 50% decrease, about 40% to about 45% decrease, about 45% to about 99% decrease, about 45% to about 95% decrease, about 45% to about 90% decrease, about 45% to about 85% decrease, about 45% to about 80% decrease, about 45% to about 75% decrease, about 45% to about 70% decrease, about 45% to about 65% decrease, about 45% to about 60% decrease, about 45% to about 55% decrease, about 45% to about 50% decrease, about 50% to about 99% decrease, about 50% to about 95% decrease, about 50% to about 90% decrease, about 50% to about 85% decrease, about 50% to about 80% decrease, about 50% to about 75% decrease, about 50% to about 70% decrease, about 50% to about 65% decrease, about 50% to about 60% decrease, about 50% to about 55% decrease, about 55% to about 99% decrease, about 55% to about 95% decrease, about 55% to about 90% decrease, about 55% to about 85% decrease, about 55% to about 80% decrease, about 55% to about 75% decrease, about 55% to about 70% decrease, about 55% to about 65% decrease, about 55% to about 60% decrease, about 60% to about 99% decrease, about 60% to about 95% decrease, about 60% to about 90% decrease, about 60% to about 85% decrease, about 60% to about 80% decrease, about 60% to about 75% decrease, about 60% to about 70% decrease, about 60% to about 65% decrease, about 65% to about 99% decrease, about 65% to about 95% decrease, about 65% to about 90% decrease, about 65% to about 85% decrease, about 65% to about 80% decrease, about 65% to about 75% decrease, about 65% to about 70% decrease, about 70% to about 99% decrease, about 70% to about 95% decrease, about 70% to about 90% decrease, about 70% to about 85% decrease, about 70% to about 80% decrease, about 70% to about 75% decrease, about 75% to about 99% decrease, about 75% to about 95% decrease, about 75% to about 90% decrease, about 75% to about 85% decrease, about 75% to about 80% decrease, about 80% to about 99% decrease, about 80% to about 95% decrease, about 80% to about 90% decrease, about 80% to about 85% decrease, about 85% to about 99% decrease, about 85% to about 95% decrease, about 85% to about 90% decrease, about 90% to about 99% decrease, about 90% to about 95% decrease, or about 95% to about 99% decrease) in one or more (e.g., two, three, four, five, six, seven, eight, or nine) of: the level of interferon-K in GI tissue, the level of IL-IB in GI tissue, the level of IL-6 in GI tissue, the level of IL-22 in GI tissue, the level of IL-17A in the GI tissue, the level of TNFI in GI tissue, the level of IL-2 in GI tissue, the number of Th memory cells in Peyer's patches, and the number of Th memory cells in mesentery lymph nodes, in a subject (e.g., as compared to the level in the subject prior to treatment or compared to a subject or population of subjects having a similar disease but receiving a placebo or a different treatment) (e.g., for a time period of between about 1 hour to about 30 days (e.g., or any of the subranges herein) following the first administration of an immune modulator using any of the compositions or devices described herein. Exemplary methods for determining the endoscopy score are described herein and other methods for determining the endoscopy score are known in the art. Exemplary methods for determining the levels of interferon-K, IL-1β, IL-6, IL-22, IL-17A, TNFI, and IL-2 are described herein. Additional methods for determining the levels of these cytokines are known in the art. Exemplary methods for determining the number of Th memory cells in Peyer's patches and mesentery lymph nodes are described herein. Additional methods for determining the number of Th memory cells in Peyer's patches and mesentery lymph nodes are known in the art.

In some examples, treatment can result in an increase (e.g., about 1% to about 500% increase, about 1% to about 400% increase, about 1% to about 300% increase, about 1% to about 200% increase, about 1% to about 150% increase, about 1% to about 100% increase, about 1% to about 90% increase, about 1% to about 80% increase, about 1% to about 70% increase, about 1% to about 60% increase, about 1% to about 50% increase, about 1% to about 40% increase, about 1% to about 30% increase, about 1% to about 20% increase, about 1% to about 10% increase, a 10% to about 500% increase, about 10% to about 400% increase, about 10% to about 300% increase, about 10% to about 200% increase, about 10% to about 150% increase, about 10% to about 100% increase, about 10% to about 90% increase, about 10% to about 80% increase, about 10% to about 70% increase, about 10% to about 60% increase, about 10% to about 50% increase, about 10% to about 40% increase, about 10% to about 30% increase, about 10% to about 20% increase, about 20% to about 500% increase, about 20% to about 400% increase, about 20% to about 300% increase, about 20% to about 200% increase, about 20% to about 150% increase, about 20% to about 100% increase, about 20% to about 90% increase, about 20% to about 80% increase, about 20% to about 70% increase, about 20% to about 60% increase, about 20% to about 50% increase, about 20% to about 40% increase, about 20% to about 30% increase, about 30% to about 500% increase, about 30% to about 400% increase, about 30% to about 300% increase, about 30% to about 200% increase, about 30% to about 150% increase, about 30% to about 100% increase, about 30% to about 90% increase, about 30% to about 80% increase, about 30% to about 70% increase, about 30% to about 60% increase, about 30% to about 50% increase, about 30% to about 40% increase, about 40% to about 500% increase, about 40% to about 400% increase, about 40% to about 300% increase, about 40% to about 200% increase, about 40% to about 150% increase, about 40% to about 100% increase, about 40% to about 90% increase, about 40% to about 80% increase, about 40% to about 70% increase, about 40% to about 60% increase, about 40% to about 50% increase, about 50% to about 500% increase, about 50% to about 400% increase, about 50% to about 300% increase, about 50% to about 200% increase, about 50% to about 150% increase, about 50% to about 100% increase, about 50% to about 90% increase, about 50% to about 80% increase, about 50% to about 70% increase, about 50% to about 60% increase, about 60% to about 500% increase, about 60% to about 400% increase, about 60% to about 300% increase, about 60% to about 200% increase, about 60% to about 150% increase, about 60% to about 100% increase, about 60% to about 90% increase, about 60% to about 80% increase, about 60% to about 70% increase, about 70% to about 500% increase, about 70% to about 400% increase, about 70% to about 300% increase, about 70% to about 200% increase, about 70% to about 150% increase, about 70% to about 100% increase, about 70% to about 90% increase, about 70% to about 80% increase, about 80% to about 500% increase, about 80% to about 400% increase, about 80% to about 300% increase, about 80% to about 200% increase, about 80% to about 150% increase, about 80% to about 100% increase, about 80% to about 90% increase, about 90% to about 500% increase, about 90% to about 400% increase, about 90% to about 300% increase, about 90% to about 200% increase, about 90% to about 150% increase, about 90% to about 100% increase, about 100% to about 500% increase, about 100% to about 400% increase, about 100% to about 300% increase, about 100% to about 200% increase, about 100% to about 150% increase, about 150% to about 500% increase, about 150% to about 400% increase, about 150% to about 300% increase, about 150% to about 200% increase, about 200% to about 500% increase, about 200% to about 400% increase, about 200% to about 300% increase, about 300% to about 500% increase, about 300% to about 400% increase, or about 400% to about 500% increase) in one or both of stool consistency score and weight of a subject (e.g., as compared to the level in the subject prior to treatment or compared to a subject or population of subjects having a similar disease but receiving a placebo or a different treatment) (e.g., for a time period of between about 1 hour to about 30 days (e.g., or any of the subranges herein) following the first administration of an immune modulator using any of the compositions or devices described herein. Exemplary methods for determining stool consistency score are described herein. Additional methods for determining a stool consistency score are known in the art.

In some embodiments, administration of an immune modulator using any of the devices or compositions described herein can result in a ratio of GI tissue concentration of the immune modulator to the blood, serum, or plasma concentration of the immune modulator that is higher than the same ratio when the immune modulator is administered by traditional means (e.g., systemically or orally). Examples of a ratio of GI tissue concentration of the immune modulator to the blood, serum, or plasma concentration of the immune modulator include about 2 to about 600, about 2 to about 580, about 2 to about 560, about 2 to about 540, about 2 to about 520, about 2 to about 500, about 2 to about 480, about 2 to about 460, about 4 to about 440, about 2 to about 420, about 2 to about 400, about 2 to about 380, about 2 to about 360, about 2 to about 340, about 2 to about 320, about 2 to about 300, about 2 to about 280, about 2 to about 260, about 2 to about 240, about 2 to about 220, about 2 to about 200, about 2 to about 190, about 2 to about 180, about 2 to about 170, about 2 to about 160, about 2 to about 150, about 2 to about 140, about 2 to about 130, about 2 to about 120, about 2 to about 110, about 2 to about 100, about 2 to about 90, about 2 to about 80, about 2 to about 70, about 2 to about 60, about 2 to about 50, about 2 to about 40, about 2 to about 30, about 2 to about 20, about 2 to about 15, about 2 to about 10, about 2 to about 5, about 5 to about 600, about 5 to about 580, about 5 to about 560, about 5 to about 540, about 5 to about 520, about 5 to about 500, about 5 to about 480, about 5 to about 460, about 5 to about 440, about 5 to about 420, about 5 to about 400, about 5 to about 380, about 5 to about 360, about 5 to about 340, about 5 to about 320, about 5 to about 300, about 5 to about 280, about 5 to about 260, about 5 to about 240, about 5 to about 220, about 5 to about 200, about 5 to about 190, about 5 to about 180, about 5 to about 170, about 5 to about 160, about 5 to about 150, about 5 to about 140, about 5 to about 130, about 5 to about 120, about 5 to about 110, about 5 to about 100, about 5 to about 90, about 5 to about 80, about 5 to about 70, about 5 to about 60, about 5 to about 50, about 5 to about 40, about 5 to about 30, about 5 to about 20, about 5 to about 15, about 5 to about 10, about 10 to about 600, about 10 to about 580, about 10 to about 560, about 10 to about 540, about 10 to about 520, about 10 to about 500, about 10 to about 480, about 10 to about 460, about 10 to about 440, about 10 to about 420, about 10 to about 400, about 10 to about 380, about 10 to about 360, about 10 to about 340, about 10 to about 320, about 10 to about 300, about 10 to about 280, about 10 to about 260, about 10 to about 240, about 10 to about 220, about 10 to about 200, about 10 to about 190, about 10 to about 180, about 10 to about 170, about 10 to about 160, about 10 to about 150, about 10 to about 140, about 10 to about 130, about 10 to about 120, about 10 to about 110, about 10 to about 100, about 10 to about 90, about 10 to about 80, about 10 to about 70, about 10 to about 60, about 10 to about 50, about 10 to about 40, about 10 to about 30, about 10 to about 20, about 10 to about 15, about 15 to about 600, about 15 to about 580, about 15 to about 560, about 15 to about 540, about 15 to about 520, about 15 to about 500, about 15 to about 480, about 15 to about 460, about 15 to about 440, about 15 to about 420, about 15 to about 400, about 15 to about 380, about 15 to about 360, about 15 to about 340, about 15 to about 320, about 15 to about 300, about 15 to about 280, about 15 to about 260, about 15 to about 240, about 15 to about 220, about 15 to about 200, about 15 to about 190, about 15 to about 180, about 15 to about 170, about 15 to about 160, about 15 to about 150, about 15 to about 140, about 15 to about 130, about 15 to about 120, about 15 to about 110, about 15 to about 100, about 15 to about 90, about 15 to about 80, about 15 to about 70, about 15 to about 60, about 15 to about 50, about 15 to about 40, about 15 to about 30, about 15 to about 20, about 20 to about 600, about 20 to about 580, about 20 to about 560, about 20 to about 540, about 20 to about 520, about 20 to about 500, about 20 to about 480, about 20 to about 460, about 20 to about 440, about 20 to about 420, about 20 to about 400, about 20 to about 380, about 20 to about 360, about 20 to about 340, about 20 to about 320, about 20 to about 300, about 20 to about 280, about 20 to about 260, about 20 to about 240, about 20 to about 220, about 20 to about 200, about 20 to about 190, about 20 to about 180, about 20 to about 170, about 20 to about 160, about 20 to about 150, about 20 to about 140, about 20 to about 130, about 20 to about 120, about 20 to about 110, about 20 to about 100, about 20 to about 90, about 20 to about 80, about 20 to about 70, about 20 to about 60, about 20 to about 50, about 20 to about 40, about 20 to about 30, about 30 to about 600, about 30 to about 580, about 30 to about 560, about 30 to about 540, about 30 to about 520, about 30 to about 500, about 30 to about 480, about 30 to about 460, about 30 to about 440, about 30 to about 420, about 30 to about 400, about 30 to about 380, about 30 to about 360, about 30 to about 340, about 30 to about 320, about 30 to about 300, about 30 to about 280, about 30 to about 260, about 30 to about 240, about 30 to about 220, about 30 to about 200, about 30 to about 190, about 30 to about 180, about 30 to about 170, about 30 to about 160, about 30 to about 150, about 30 to about 140, about 30 to about 130, about 30 to about 120, about 30 to about 110, about 30 to about 100, about 30 to about 90, about 30 to about 80, about 30 to about 70, about 30 to about 60, about 30 to about 50, about 30 to about 40, about 40 to about 600, about 40 to about 580, about 40 to about 560, about 40 to about 540, about 40 to about 520, about 40 to about 500, about 40 to about 480, about 40 to about 460, about 40 to about 440, about 40 to about 420, about 40 to about 400, about 40 to about 380, about 40 to about 360, about 40 to about 340, about 40 to about 320, about 40 to about 300, about 40 to about 280, about 40 to about 260, about 40 to about 240, about 40 to about 220, about 40 to about 200, about 40 to about 190, about 40 to about 180, about 40 to about 170, about 40 to about 160, about 40 to about 150, about 40 to about 140, about 40 to about 130, about 40 to about 120, about 40 to about 110, about 40 to about 100, about 40 to about 90, about 40 to about 80, about 40 to about 70, about 40 to about 60, about 40 to about 50, about 50 to about 600, about 50 to about 580, about 50 to about 560, about 50 to about 540, about 50 to about 520, about 50 to about 500, about 50 to about 480, about 50 to about 460, about 50 to about 440, about 50 to about 420, about 50 to about 400, about 50 to about 380, about 50 to about 360, about 50 to about 340, about 50 to about 320, about 50 to about 300, about 50 to about 280, about 50 to about 260, about 50 to about 240, about 50 to about 220, about 50 to about 200, about 50 to about 190, about 50 to about 180, about 50 to about 170, about 50 to about 160, about 50 to about 150, about 50 to about 140, about 50 to about 130, about 50 to about 120, about 50 to about 110, about 50 to about 100, about 50 to about 90, about 50 to about 80, about 50 to about 70, about 50 to about 60, about 60 to about 600, about 60 to about 580, about 60 to about 560, about 60 to about 540, about 60 to about 520, about 60 to about 500, about 60 to about 480, about 60 to about 460, about 60 to about 440, about 60 to about 420, about 60 to about 400, about 60 to about 380, about 60 to about 360, about 60 to about 340, about 60 to about 320, about 60 to about 300, about 60 to about 280, about 60 to about 260, about 60 to about 240, about 60 to about 220, about 60 to about 200, about 60 to about 190, about 60 to about 180, about 60 to about 170, about 60 to about 160, about 60 to about 150, about 60 to about 140, about 60 to about 130, about 60 to about 120, about 60 to about 110, about 60 to about 100, about 60 to about 90, about 60 to about 80, about 60 to about 70, about 70 to about 600, about 70 to about 580, about 70 to about 560, about 70 to about 540, about 70 to about 520, about 70 to about 500, about 70 to about 480, about 70 to about 460, about 70 to about 440, about 70 to about 420, about 70 to about 400, about 70 to about 380, about 70 to about 360, about 70 to about 340, about 70 to about 320, about 70 to about 300, about 70 to about 280, about 70 to about 260, about 70 to about 240, about 70 to about 220, about 70 to about 200, about 70 to about 190, about 70 to about 180, about 70 to about 170, about 70 to about 160, about 70 to about 150, about 70 to about 140, about 70 to about 130, about 70 to about 120, about 70 to about 110, about 70 to about 100, about 70 to about 90, about 70 to about 80, about 80 to about 600, about 80 to about 580, about 80 to about 560, about 80 to about 540, about 80 to about 520, about 80 to about 500, about 80 to about 480, about 80 to about 460, about 80 to about 440, about 80 to about 420, about 80 to about 400, about 80 to about 380, about 80 to about 360, about 80 to about 340, about 80 to about 320, about 80 to about 300, about 80 to about 280, about 80 to about 260, about 80 to about 240, about 80 to about 220, about 80 to about 200, about 80 to about 190, about 80 to about 180, about 80 to about 170, about 80 to about 160, about 80 to about 150, about 80 to about 140, about 80 to about 130, about 80 to about 120, about 80 to about 110, about 80 to about 100, about 80 to about 90, about 90 to about 600, about 90 to about 580, about 90 to about 560, about 90 to about 540, about 90 to about 520, about 90 to about 500, about 90 to about 480, about 90 to about 460, about 90 to about 440, about 90 to about 420, about 90 to about 400, about 90 to about 380, about 90 to about 360, about 90 to about 340, about 90 to about 320, about 90 to about 300, about 90 to about 280, about 90 to about 260, about 90 to about 240, about 90 to about 220, about 90 to about 200, about 90 to about 190, about 90 to about 180, about 90 to about 170, about 90 to about 160, about 90 to about 150, about 90 to about 140, about 90 to about 130, about 90 to about 120, about 90 to about 110, about 90 to about 100, about 100 to about 600, about 100 to about 580, about 100 to about 560, about 100 to about 540, about 100 to about 520, about 100 to about 500, about 100 to about 480, about 100 to about 460, about 100 to about 440, about 100 to about 420, about 100 to about 400, about 100 to about 380, about 100 to about 360, about 100 to about 340, about 100 to about 320, about 100 to about 300, about 100 to about 280, about 100 to about 260, about 100 to about 240, about 100 to about 220, about 100 to about 200, about 100 to about 190, about 100 to about 180, about 100 to about 170, about 100 to about 160, about 100 to about 150, about 100 to about 140, about 100 to about 130, about 100 to about 120, about 100 to about 110, about 110 to about 600, about 110 to about 580, about 110 to about 560, about 110 to about 540, about 110 to about 520, about 110 to about 500, about 110 to about 480, about 110 to about 460, about 110 to about 440, about 110 to about 420, about 110 to about 400, about 110 to about 380, about 110 to about 360, about 110 to about 340, about 110 to about 320, about 110 to about 300, about 110 to about 280, about 110 to about 260, about 110 to about 240, about 110 to about 220, about 110 to about 200, about 110 to about 190, about 110 to about 180, about 110 to about 170, about 110 to about 160, about 110 to about 150, about 110 to about 140, about 110 to about 130, about 110 to about 120, about 120 to about 600, about 120 to about 580, about 120 to about 560, about 120 to about 540, about 120 to about 520, about 120 to about 500, about 120 to about 480, about 120 to about 460, about 120 to about 440, about 120 to about 420, about 120 to about 400, about 120 to about 380, about 120 to about 360, about 120 to about 340, about 120 to about 320, about 120 to about 300, about 120 to about 280, about 120 to about 260, about 120 to about 240, about 120 to about 220, about 120 to about 200, about 120 to about 190, about 120 to about 180, about 120 to about 170, about 120 to about 160, about 120 to about 150, about 120 to about 140, about 120 to about 130, about 130 to about 600, about 130 to about 580, about 130 to about 560, about 130 to about 540, about 130 to about 520, about 130 to about 500, about 130 to about 480, about 130 to about 460, about 130 to about 440, about 130 to about 420, about 130 to about 400, about 130 to about 380, about 130 to about 360, about 130 to about 340, about 130 to about 320, about 130 to about 300, about 130 to about 280, about 130 to about 260, about 130 to about 240, about 130 to about 220, about 130 to about 200, about 130 to about 190, about 130 to about 180, about 130 to about 170, about 130 to about 160, about 130 to about 150, about 130 to about 140, about 140 to about 600, about 140 to about 580, about 140 to about 560, about 140 to about 540, about 140 to about 520, about 140 to about 500, about 140 to about 480, about 140 to about 460, about 140 to about 440, about 140 to about 420, about 140 to about 400, about 140 to about 380, about 140 to about 360, about 140 to about 340, about 140 to about 320, about 140 to about 300, about 140 to about 280, about 140 to about 260, about 140 to about 240, about 140 to about 220, about 140 to about 200, about 140 to about 190, about 140 to about 180, about 140 to about 170, about 140 to about 160, about 140 to about 150, about 150 to about 600, about 150 to about 580, about 150 to about 560, about 150 to about 540, about 150 to about 520, about 150 to about 500, about 150 to about 480, about 150 to about 460, about 150 to about 440, about 150 to about 420, about 150 to about 400, about 150 to about 380, about 150 to about 360, about 150 to about 340, about 150 to about 320, about 150 to about 300, about 150 to about 280, about 150 to about 260, about 150 to about 240, about 150 to about 220, about 150 to about 200, about 150 to about 190, about 150 to about 180, about 150 to about 170, about 150 to about 160, about 160 to about 600, about 160 to about 580, about 160 to about 560, about 160 to about 540, about 160 to about 520, about 160 to about 500, about 160 to about 480, about 160 to about 460, about 160 to about 440, about 160 to about 420, about 160 to about 400, about 160 to about 380, about 160 to about 360, about 160 to about 340, about 160 to about 320, about 160 to about 300, about 160 to about 280, about 160 to about 260, about 160 to about 240, about 160 to about 220, about 160 to about 200, about 160 to about 190, about 160 to about 180, about 160 to about 170, about 170 to about 600, about 170 to about 580, about 170 to about 560, about 170 to about 540, about 170 to about 520, about 170 to about 500, about 170 to about 480, about 170 to about 460, about 170 to about 440, about 170 to about 420, about 170 to about 400, about 170 to about 380, about 170 to about 360, about 170 to about 340, about 170 to about 320, about 170 to about 300, about 170 to about 280, about 170 to about 260, about 170 to about 240, about 170 to about 220, about 170 to about 200, about 170 to about 190, about 170 to about 180, about 180 to about 600, about 180 to about 580, about 180 to about 560, about 180 to about 540, about 180 to about 520, about 180 to about 500, about 180 to about 480, about 180 to about 460, about 180 to about 440, about 180 to about 420, about 180 to about 400, about 180 to about 380, about 180 to about 360, about 180 to about 340, about 180 to about 320, about 180 to about 300, about 180 to about 280, about 180 to about 260, about 180 to about 240, about 180 to about 220, about 180 to about 200, about 180 to about 190, about 190 to about 600, about 190 to about 580, about 190 to about 560, about 190 to about 540, about 190 to about 520, about 190 to about 500, about 190 to about 480, about 190 to about 460, about 190 to about 440, about 190 to about 420, about 190 to about 400, about 190 to about 380, about 190 to about 360, about 190 to about 340, about 190 to about 320, about 190 to about 300, about 190 to about 280, about 190 to about 260, about 190 to about 240, about 190 to about 220, about 190 to about 200, about 200 to about 600, about 200 to about 580, about 200 to about 560, about 200 to about 540, about 200 to about 520, about 200 to about 500, about 200 to about 480, about 200 to about 460, about 200 to about 440, about 200 to about 420, about 200 to about 400, about 200 to about 380, about 200 to about 360, about 200 to about 340, about 200 to about 320, about 200 to about 300, about 200 to about 280, about 200 to about 260, about 200 to about 240, about 200 to about 220, about 220 to about 600, about 220 to about 580, about 220 to about 560, about 220 to about 540, about 220 to about 520, about 220 to about 500, about 220 to about 480, about 220 to about 460, about 220 to about 440, about 220 to about 420, about 220 to about 400, about 220 to about 380, about 220 to about 360, about 220 to about 340, about 220 to about 320, about 220 to about 300, about 220 to about 280, about 220 to about 260, about 220 to about 240, about 240 to about 600, about 240 to about 580, about 240 to about 560, about 240 to about 540, about 240 to about 520, about 240 to about 500, about 240 to about 480, about 240 to about 460, about 240 to about 440, about 240 to about 420, about 240 to about 400, about 240 to about 380, about 240 to about 360, about 240 to about 340, about 240 to about 320, about 240 to about 300, about 240 to about 280, about 240 to about 260, about 260 to about 600, about 260 to about 580, about 260 to about 560, about 260 to about 540, about 260 to about 520, about 260 to about 500, about 260 to about 480, about 260 to about 460, about 260 to about 440, about 260 to about 420, about 260 to about 400, about 260 to about 380, about 260 to about 360, about 260 to about 340, about 260 to about 320, about 260 to about 300, about 260 to about 280, about 280 to about 600, about 280 to about 580, about 280 to about 560, about 280 to about 540, about 280 to about 520, about 280 to about 500, about 280 to about 480, about 280 to about 460, about 280 to about 440, about 280 to about 420, about 280 to about 400, about 280 to about 380, about 280 to about 360, about 280 to about 340, about 280 to about 320, about 280 to about 300, about 300 to about 600, about 300 to about 580, about 300 to about 560, about 300 to about 540, about 300 to about 520, about 300 to about 500, about 300 to about 480, about 300 to about 460, about 300 to about 440, about 300 to about 420, about 300 to about 400, about 300 to about 380, about 300 to about 360, about 300 to about 340, about 300 to about 320, about 320 to about 600, about 320 to about 580, about 320 to about 560, about 320 to about 540, about 320 to about 520, about 320 to about 500, about 320 to about 480, about 320 to about 460, about 320 to about 440, about 320 to about 420, about 320 to about 400, about 320 to about 380, about 320 to about 360, about 320 to about 340, about 340 to about 600, about 340 to about 580, about 340 to about 560, about 340 to about 540, about 340 to about 520, about 340 to about 500, about 340 to about 480, about 340 to about 460, about 340 to about 440, about 340 to about 420, about 340 to about 400, about 340 to about 380, about 340 to about 360, about 360 to about 600, about 360 to about 580, about 360 to about 560, about 360 to about 540, about 360 to about 520, about 360 to about 500, about 360 to about 480, about 360 to about 460, about 360 to about 440, about 360 to about 420, about 360 to about 400, about 360 to about 380, about 380 to about 600, about 380 to about 580, about 380 to about 560, about 380 to about 540, about 380 to about 520, about 380 to about 500, about 380 to about 480, about 380 to about 460, about 380 to about 440, about 380 to about 420, about 380 to about 400, about 400 to about 600, about 400 to about 580, about 400 to about 560, about 400 to about 540, about 400 to about 520, about 400 to about 500, about 400 to about 480, about 400 to about 460, about 400 to about 440, about 400 to about 420, about 420 to about 600, about 420 to about 580, about 420 to about 560, about 420 to about 540, about 420 to about 520, about 420 to about 500, about 420 to about 480, about 420 to about 460, about 420 to about 440, about 440 to about 600, about 440 to about 580, about 440 to about 560, about 440 to about 540, about 440 to about 520, about 440 to about 500, about 440 to about 480, about 440 to about 460, about 460 to about 600, about 460 to about 580, about 460 to about 560, about 460 to about 540, about 460 to about 520, about 460 to about 500, about 460 to about 480, about 480 to about 600, about 480 to about 580, about 480 to about 560, about 480 to about 540, about 480 to about 520, about 480 to about 500, about 500 to about 600, about 500 to about 580, about 500 to about 560, about 500 to about 540, about 500 to about 520, about 520 to about 600, about 520 to about 580, about 520 to about 560, about 520 to about 540, about 540 to about 600, about 540 to about 580, about 540 to about 560, about 560 to about 600, about 560 to about 580, or about 580 to about 600.

Additional examples of a ratio of GI tissue concentration of the immune modulator to the blood, serum, or plasma concentration of the immune modulator include to 1.1 to 600, 1.2 to 600, 1.3 to 600, 1.4 to 600, 1.5 to 600, 1.6 to 600, 1.7 to 600, 1.8 to 600, or 1.9 to 600, such as 1.1, 1.2, 1.3, 1.4, 1.5, 1.6, 1.7, 1.8, or 1.9.

In some examples, administration of an immune modulator using any of the devices or compositions described herein can result in a ratio of GI tissue concentration of the immune modulator to the blood, serum, or plasma concentration of the immune modulator of, e.g., about 2.8 to about 6.0, about 2.8 to about 5.8, about 2.8 to about 5.6, about 2.8 to about 5.4, about 2.8 to about 5.2, about 2.8 to about 5.0, about 2.8 to about 4.8, about 2.8 to about 4.6, about 2.8 to about 4.4, about 2.8 to about 4.2, about 2.8 to about 4.0, about 2.8 to about 3.8, about 2.8 to about 3.6, about 2.8 to about 3.4, about 2.8 to about 3.2, about 2.8 to about 3.0, about 3.0 to about 6.0, about 3.0 to about 5.8, about 3.0 to about 5.6, about 3.0 to about 5.4, about 3.0 to about 5.2, about 3.0 to about 5.0, about 3.0 to about 4.8, about 3.0 to about 4.6, about 3.0 to about 4.4, about 3.0 to about 4.2, about 3.0 to about 4.0, about 3.0 to about 3.8, about 3.0 to about 3.6, about 3.0 to about 3.4, about 3.0 to about 3.2, about 3.2 to about 6.0, about 3.2 to about 5.8, about 3.2 to about 5.6, about 3.2 to about 5.4, about 3.2 to about 5.2, about 3.2 to about 5.0, about 3.2 to about 4.8, about 3.2 to about 4.6, about 3.2 to about 4.4, about 3.2 to about 4.2, about 3.2 to about 4.0, about 3.2 to about 3.8, about 3.2 to about 3.6, about 3.2 to about 3.4, about 3.4 to about 6.0, about 3.4 to about 5.8, about 3.4 to about 5.6, about 3.4 to about 5.4, about 3.4 to about 5.2, about 3.4 to about 5.0, about 3.4 to about 4.8, about 3.4 to about 4.6, about 3.4 to about 4.4, about 3.4 to about 4.2, about 3.4 to about 4.0, about 3.4 to about 3.8, about 3.4 to about 3.6, about 3.6 to about 6.0, about 3.6 to about 5.8, about 3.6 to about 5.6, about 3.6 to about 5.4, about 3.6 to about 5.2, about 3.6 to about 5.0, about 3.6 to about 4.8, about 3.6 to about 4.6, about 3.6 to about 4.4, about 3.6 to about 4.2, about 3.6 to about 4.0, about 3.6 to about 3.8, about 3.8 to about 6.0, about 3.8 to about 5.8, about 3.8 to about 5.6, about 3.8 to about 5.4, about 3.8 to about 5.2, about 3.8 to about 5.0, about 3.8 to about 4.8, about 3.8 to about 4.6, about 3.8 to about 4.4, about 3.8 to about 4.2, about 3.8 to about 4.0, about 4.0 to about 6.0, about 4.0 to about 5.8, about 4.0 to about 5.6, about 4.0 to about 5.4, about 4.0 to about 5.2, about 4.0 to about 5.0, about 4.0 to about 4.8, about 4.0 to about 4.6, about 4.0 to about 4.4, about 4.0 to about 4.2, about 4.2 to about 6.0, about 4.2 to about 5.8, about 4.2 to about 5.6, about 4.2 to about 5.4, about 4.2 to about 5.2, about 4.2 to about 5.0, about 4.2 to about 4.8, about 4.2 to about 4.6, about 4.2 to about 4.4, about 4.4 to about 6.0, about 4.4 to about 5.8, about 4.4 to about 5.6, about 4.4 to about 5.4, about 4.4 to about 5.2, about 4.4 to about 5.0, about 4.4 to about 4.8, about 4.4 to about 4.6, about 4.6 to about 6.0, about 4.6 to about 5.8, about 4.6 to about 5.6, about 4.6 to about 5.4, about 4.6 to about 5.2, about 4.6 to about 5.0, about 4.6 to about 4.8, about 4.8 to about 6.0, about 4.8 to about 5.8, about 4.8 to about 5.6, about 4.8 to about 5.4, about 4.8 to about 5.2, about 4.8 to about 5.0, about 5.0 to about 6.0, about 5.0 to about 5.8, about 5.0 to about 5.6, about 5.0 to about 5.4, about 5.0 to about 5.2, about 5.2 to about 6.0, about 5.2 to about 5.8, about 5.2 to about 5.6, about 5.2 to about 5.4, about 5.4 to about 6.0, about 5.4 to about 5.8, about 5.4 to about 5.6, about 5.6 to about 6.0, about 5.6 to about 5.8, or about 5.8 to about 6.0. Accordingly, in some embodiments, a method of treatment disclosed herein can include determining the ratio of the level of the immune modulator in the GI tissue to the level of the immune modulator inhibitor in the blood, serum, or plasma of a subject at substantially the same time point following administration of the device is about 2.8 to about 6.0. Exemplary methods for measuring the concentration of an immune modulator in the plasma or the GI tissue of a subject are described herein. Additional methods for measuring the concentration of an immune modulator in the plasma or the GI tissue of a subject are known in the art.

Accordingly, in some embodiments, a method of treatment disclosed herein includes determining the level of the immune modulator in the GI tissue (e.g., one or more of any of the exemplary GI tissues described herein). In some embodiments, a method of treatment disclosed herein can include determining the level of immune modulator in one or more (e.g., two, three, or four) of the lumen/superficial mucosa, the lamina propria, the submucosa, and the tunica muscularis/serosa.

In some embodiments, a method of treatment disclosed herein includes determining that the level of the immune modulator in the GI tissue (e.g., one or more of any of the exemplary types of GI tissues described herein) at a time point following administration of the device is higher than the level of the immune modulator in the GI tissue at substantially the same time point following systemic administration of an equal amount of the immune modulator. In some embodiments, a method of treatment disclosed herein can include determining that the level of the immune modulator in one or more (e.g., two, three, or four) of the lumen/superficial mucosa, the lamina propria, the submucosa, and the tunica muscularis/serosa at a time point following administration of the device is higher than the level of the immune modulator in one or more (e.g., two, three, or four) of the lumen/superficial mucosa, the lamina propria, the submucosa, and the tunica muscularis/serosa at substantially the same time point following systemic administration of an equal amount of the immune modulator.

In some embodiments, a method of treatment disclosed herein includes determining the level of immune modulator in the feces of the subject. In some embodiments, a method of treatment disclosed herein includes determining the level of immune modulator in the GI tissue, e.g., in one or more (e.g., two, three, or four) of the lumen/superficial mucosa, the lamina propria, the submucosa, and the tunica muscularis/serosa within a time period of about 10 minutes to about 10 hours following administration of the device.

In some embodiments, a method of treatment as disclosed herein comprises determining the level of the immune modulator at the location of disease following administration of the device.

In some embodiments, a method of treatment as disclosed herein comprises determining that the level of immune modulator at the location of disease at a time point following administration of the device is higher than the level of the immune modulator at the same location of disease at substantially the same time point following systemic administration of an equal amount of the immune modulator.

In some embodiments, a method of treatment as disclosed herein comprises determining that the level of immune modulator in plasma in a subject at a time point following administration of the device is lower than the level of the immune modulator in plasma in a subject at substantially the same time point following systemic administration of an equal amount of the immune modulator.

In some embodiments, a method of treatment as disclosed herein comprises determining the level of the immune modulator in the tissue of the subject within a time period of about 10 minutes to 10 hours following administration of the device.

Some examples of any of the methods described herein can, e.g., result in a selective suppression of a local inflammatory response (e.g., an inflammatory response in local GI tissue), while maintaining the systemic immune response (e.g., blood). The GI tissue may be, for example, GI tissue proximate to one or more sites of disease. As used herein, "GI content" refers to the content of the gastrointestinal (GI) tract, such as the content of one or more of duodenum, jejunum, ileum, cecum, ascending colon, transverse colon, descending colon, sigmoid colon, and rectum, more particularly of the proximal portion of one or more of duodenum, jejunum, ileum, cecum, ascending colon, transverse colon, descending colon, and sigmoid colon, or of the distal portion of one or more of duodenum, jejunum, ileum, cecum, ascending colon, transverse colon, descending colon, and sigmoid colon. Accordingly, in some embodiments, the methods described herein can result in a selective suppression of the inflammatory response in the duodenum tissue proximate to one or more sites of disease, while maintaining the systemic immune response. In some embodiments, the methods described herein can result in a selective suppression of the inflammatory response in the jejunum tissue proximate to one or more sites of disease, while maintaining the systemic immune response. In some embodiments, the methods described herein can result in a selective suppression of the inflammatory response in the ileum tissue proximate to one or more sites of disease, while maintaining the systemic immune response. In some embodiments, the methods described herein can result in a selective suppression of the inflammatory response in the cecum tissue proximate to one or more sites of disease, while maintaining the systemic immune response. In some embodiments, the methods described herein can result in a selective suppression of the inflammatory response in the ascending colon tissue proximate to one or more sites of disease, while maintaining the systemic immune response. In some embodiments, the methods described herein can result in a selective suppression of the inflammatory response in the transverse colon tissue proximate to one or more sites of disease, while maintaining the systemic immune response. In some embodiments, the methods described herein can result in a selective suppression of the inflammatory response in the descending colon tissue proximate to one or more sites of disease, while maintaining the systemic immune response. In some embodiments, the methods described herein can result in a selective suppression of the inflammatory response in the sigmoid colon tissue proximate to one or more sites of disease, while maintaining the systemic immune response. In some examples, the methods described herein can result in a 1% increase to 500% increase (e.g., a 1% increase to 450% increase, a 1% increase to 400% increase, a 1% increase to 350% increase, a 1% increase to 300% increase, a 1% increase to 250% increase, a 1% increase to 200% increase, a 1% increase to 190% increase, a 1% increase to 180% increase, a 1% increase to 170% increase, a 1% increase to 160% increase, a 1% increase to 150% increase, a 1% increase to 140% increase, a 1% increase to 130% increase, a 1% increase to 120% increase, a 1% increase to 110% increase, a 1% increase to 100% increase, a 1% increase to 90% increase, a 1% increase to 80% increase, a 1% increase to 70% increase, a 1% increase to 60% increase, a 1% increase to 50% increase, a 1% increase to 40% increase, a 1% increase to 30% increase, a 1% increase to 25% increase, a 1% increase to 20% increase, a 1% increase to 15% increase, a 1% increase to 10% increase, a 1% increase to 5% increase, a 5% increase to 500% increase, a 5% increase to 450% increase, a 5% increase to 400% increase, a 5% increase to 350% increase, a 5% increase to 300% increase, a 5% increase to 250% increase, a 5% increase to 200% increase, a 5% increase to 190% increase, a 5% increase to 180% increase, a 5% increase to 170% increase, a 5% increase to 160% increase, a 5% increase to 150% increase, a 5% increase to 140% increase, a 5% increase to 130% increase, a 5% increase to 120% increase, a 5% increase to 110% increase, a 5% increase to 100% increase, a 5% increase to 90% increase, a 5% increase to 80% increase, a 5% increase to 70% increase, a 5% increase to 60% increase, a 5% increase to 50% increase, a 5% increase to 40% increase, a 5% increase to 30% increase, a 5% increase to 25% increase, a 5% increase to 20% increase, a 5% increase to 15% increase, a 5% increase to 10% increase, a 10% increase to 500% increase, a 10% increase to 450% increase, a 10% increase to 400% increase, a 10% increase to 350% increase, a 10% increase to 300% increase, a 10% increase to 250% increase, a 10% increase to 200% increase, a 10% increase to 190% increase, a 10% increase to 180% increase, a 10% increase to 170% increase, a 10% increase to 160% increase, a 10% increase to 150% increase, a 10% increase to 140% increase, a 10% increase to 130% increase, a 10% increase to 120% increase, a 10% increase to 110% increase, a 10% increase to 100% increase, a 10% increase to 90% increase, a 10% increase to 80% increase, a 10% increase to 70% increase, a 10% increase to 60% increase, a 10% increase to 50% increase, a 10% increase to 40% increase, a 10% increase to 30% increase, a 10% increase to 25% increase, a 10% increase to 20% increase, a 10% increase to 15% increase, a 15% increase to 500% increase, a 15% increase to 450% increase, a 15% increase to 400% increase, a 15% increase to 350% increase, a 15% increase to 300% increase, a 15% increase to 250% increase, a 15% increase to 200% increase, a 15% increase to 190% increase, a 15% increase to 180% increase, a 15% increase to 170% increase, a 15% increase to 160% increase, a 15% increase to 150% increase, a 15% increase to 140% increase, a 15% increase to 130% increase, a 15% increase to 120% increase, a 15% increase to 110% increase, a 15% increase to 100% increase, a 15% increase to 90% increase, a 15% increase to 80% increase, a 15% increase to 70% increase, a 15% increase to 60% increase, a 15% increase to 50% increase, a 15% increase to 40% increase, a 15% increase to 30% increase, a 15% increase to 25% increase, a 15% increase to 20% increase, a 20% increase to 500% increase, a 20% increase to 450% increase, a 20% increase to 400% increase, a 20% increase to 350% increase, a 20% increase to 300% increase, a 20% increase to 250% increase, a 20% increase to 200% increase, a 20% increase to 190% increase, a 20% increase to 180% increase, a 20% increase to 170% increase, a 20% increase to 160% increase, a 20% increase to 150% increase, a 20% increase to 140% increase, a 20% increase to 130% increase, a 20% increase to 120% increase, a 20% increase to 110% increase, a 20% increase to 100% increase, a 20% increase to 90% increase, a 20% increase to 80% increase, a 20% increase to 70% increase, a 20% increase to 60% increase, a 20% increase to 50% increase, a 20% increase to 40% increase, a 20% increase to 30% increase, a 20% increase to 25% increase, a 25% increase to 500% increase, a 25% increase to 450% increase, a 25% increase to 400% increase, a 25% increase to 350% increase, a 25% increase to 300% increase, a 25% increase to 250% increase, a 25% increase to 200% increase, a 25% increase to 190% increase, a 25% increase to 180% increase, a 25% increase to 170% increase, a 25% increase to 160% increase, a 25% increase to 150% increase, a 25% increase to 140% increase, a 25% increase to 130% increase, a 25% increase to 120% increase, a 25% increase to 110% increase, a 25% increase to 100% increase, a 25% increase to 90% increase, a 25% increase to 80% increase, a 25% increase to 70% increase, a 25% increase to 60% increase, a 25% increase to 50% increase, a 25% increase to 40% increase, a 25% increase to 30% increase, a 30% increase to 500% increase, a 30% increase to 450% increase, a 30% increase to 400% increase, a 30% increase to 350% increase, a 30% increase to 300% increase, a 30% increase to 250% increase, a 30% increase to 200% increase, a 30% increase to 190% increase, a 30% increase to 180% increase, a 30% increase to 170% increase, a 30% increase to 160% increase, a 30% increase to 150% increase, a 30% increase to 140% increase, a 30% increase to 130% increase, a 30% increase to 120% increase, a 30% increase to 110% increase, a 30% increase to 100% increase, a 30% increase to 90% increase, a 30% increase to 80% increase, a 30% increase to 70% increase, a 30% increase to 60% increase, a 30% increase to 50% increase, a 30% increase to 40% increase, a 40% increase to 500% increase, a 40% increase to 450% increase, a 40% increase to 400% increase, a 40% increase to 350% increase, a 40% increase to 300% increase, a 40% increase to 250% increase, a 40% increase to 200% increase, a 40% increase to 190% increase, a 40% increase to 180% increase, a 40% increase to 170% increase, a 40% increase to 160% increase, a 40% increase to 150% increase, a 40% increase to 140% increase, a 40% increase to 130% increase, a 40% increase to 120% increase, a 40% increase to 110% increase, a 40% increase to 100% increase, a 40% increase to 90% increase, a 40% increase to 80% increase, a 40% increase to 70% increase, a 40% increase to 60% increase, a 40% increase to 50% increase, a 50% increase to 500% increase, a 50% increase to 450% increase, a 50% increase to 400% increase, a 50% increase to 350% increase, a 50% increase to 300% increase, a 50% increase to 250% increase, a 50% increase to 200% increase, a 50% increase to 190% increase, a 50% increase to 180% increase, a 50% increase to 170% increase, a 50% increase to 160% increase, a 50% increase to 150% increase, a 50% increase to 140% increase, a 50% increase to 130% increase, a 50% increase to 120% increase, a 50% increase to 110% increase, a 50% increase to 100% increase, a 50% increase to 90% increase, a 50% increase to 80% increase, a 50% increase to 70% increase, a 50% increase to 60% increase, a 60% increase to 500% increase, a 60% increase to 450% increase, a 60% increase to 400% increase, a 60% increase to 350% increase, a 60% increase to 300% increase, a 60% increase to 250% increase, a 60% increase to 200% increase, a 60% increase to 190% increase, a 60% increase to 180% increase, a 60% increase to 170% increase, a 60% increase to 160% increase, a 60% increase to 150% increase, a 60% increase to 140% increase, a 60% increase to 130% increase, a 60% increase to 120% increase, a 60% increase to 110% increase, a 60% increase to 100% increase, a 60% increase to 90% increase, a 60% increase to 80% increase, a 60% increase to 70% increase, a 70% increase to 500% increase, a 70% increase to 450% increase, a 70% increase to 400% increase, a 70% increase to 350% increase, a 70% increase to 300% increase, a 70% increase to 250% increase, a 70% increase to 200% increase, a 70% increase to 190% increase, a 70% increase to 180% increase, a 70% increase to 170% increase, a 70% increase to 160% increase, a 70% increase to 150% increase, a 70% increase to 140% increase, a 70% increase to 130% increase, a 70% increase to 120% increase, a 70% increase to 110% increase, a 70% increase to 100% increase, a 70% increase to 90% increase, a 70% increase to 80% increase, a 80% increase to 500% increase, a 80% increase to 450% increase, a 80% increase to 400% increase, a 80% increase to 350% increase, a 80% increase to 300% increase, a 80% increase to 250% increase, a 80% increase to 200% increase, a 80% increase to 190% increase, a 80% increase to 180% increase, a 80% increase to 170% increase, a 80% increase to 160% increase, a 80% increase to 150% increase, a 80% increase to 140% increase, a 80% increase to 130% increase, a 80% increase to 120% increase, a 80% increase to 110% increase, a 80% increase to 100% increase, a 80% increase to 90% increase, a 90% increase to 500% increase, a 90% increase to 450% increase, a 90% increase to 400% increase, a 90% increase to 350% increase, a 90% increase to 300% increase, a 90% increase to 250% increase, a 90% increase to 200% increase, a 90% increase to 190% increase, a 90% increase to 180% increase, a 90% increase to 170% increase, a 90% increase to 160% increase, a 90% increase to 150% increase, a 90% increase to 140% increase, a 90% increase to 130% increase, a 90% increase to 120% increase, a 90% increase to 110% increase, a 90% increase to 100% increase, a 100% increase to 500% increase, a 100% increase to 450% increase, a 100% increase to 400% increase, a 100% increase to 350% increase, a 100% increase to 300% increase, a 100% increase to 250% increase, a 100% increase to 200% increase, a 100% increase to 190% increase, a 100% increase to 180% increase, a 100% increase to 170% increase, a 100% increase to 160% increase, a 100% increase to 150% increase, a 100% increase to 140% increase, a 100% increase to 130% increase, a 100% increase to 120% increase, a 100% increase to 110% increase, a 110% increase to 500% increase, a 110% increase to 450% increase, a 110% increase to 400% increase, a 110% increase to 350% increase, a 110% increase to 300% increase, a 110% increase to 250% increase, a 110% increase to 200% increase, a 110% increase to 190% increase, a 110% increase to 180% increase, a 110% increase to 170% increase, a 110% increase to 160% increase, a 110% increase to 150% increase, a 110% increase to 140% increase, a 110% increase to 130% increase, a 110% increase to 120% increase, a 120% increase to 500% increase, a 120% increase to 450% increase, a 120% increase to 400% increase, a 120% increase to 350% increase, a 120% increase to 300% increase, a 120% increase to 250% increase, a 120% increase to 200% increase, a 120% increase to 190% increase, a 120% increase to 180% increase, a 120% increase to 170% increase, a 120% increase to 160% increase, a 120% increase to 150% increase, a 120% increase to 140% increase, a 120% increase to 130% increase, a 130% increase to 500% increase, a 130% increase to 450% increase, a 130% increase to 400% increase, a 130% increase to 350% increase, a 130% increase to 300% increase, a 130% increase to 250% increase, a 130% increase to 200% increase, a 130% increase to 190% increase, a 130% increase to 180% increase, a 130% increase to 170% increase, a 130% increase to 160% increase, a 130% increase to 150% increase, a 130% increase to 140% increase, a 140% increase to 500% increase, a 140% increase to 450% increase, a 140% increase to 400% increase, a 140% increase to 350% increase, a 140% increase to 300% increase, a 140% increase to 250% increase, a 140% increase to 200% increase, a 140% increase to 190% increase, a 140% increase to 180% increase, a 140% increase to 170% increase, a 140% increase to 160% increase, a 140% increase to 150% increase, a 150% increase to 500% increase, a 150% increase to 450% increase, a 150% increase to 400% increase, a 150% increase to 350% increase, a 150% increase to 300% increase, a 150% increase to 250% increase, a 150% increase to 200% increase, a 150% increase to 190% increase, a 150% increase to 180% increase, a 150% increase to 170% increase, a 150% increase to 160% increase, a 160% increase to 500% increase, a 160% increase to 450% increase, a 160% increase to 400% increase, a 160% increase to 350% increase, a 160% increase to 300% increase, a 160% increase to 250% increase, a 160% increase to 200% increase, a 160% increase to 190% increase, a 160% increase to 180% increase, a 160% increase to 170% increase, a 170% increase to 500% increase, a 170% increase to 450% increase, a 170% increase to 400% increase, a 170% increase to 350% increase, a 170% increase to 300% increase, a 170% increase to 250% increase, a 170% increase to 200% increase, a 170% increase to 190% increase, a 180% increase to 500% increase, a 180% increase to 450% increase, a 180% increase to 400% increase, a 180% increase to 350% increase, a 180% increase to 300% increase, a 180% increase to 250% increase, a 180% increase to 200% increase, a 180% increase to 190% increase, a 190% increase to 500% increase, a 190% increase to 450% increase, a 190% increase to 400% increase, a 190% increase to 350% increase, a 190% increase to 300% increase, a 190% increase to 250% increase, a 200% increase to 500% increase, a 200% increase to 450% increase, a 200% increase to 400% increase, a 200% increase to 350% increase, a 200% increase to 300% increase, a 250% increase to 500% increase, a 250% increase to 450% increase, a 250% increase to 400% increase, a 250% increase to 350% increase, a 250% increase to 300% increase, a 300% increase to 500% increase, a 300% increase to 450% increase, a 300% increase to 400% increase, a 350% increase to 500% increase, a 350% increase to 450% increase, a 350% increase to 400% increase, a 400% increase to 500% increase, a 400% increase to 450% increase, or a 450% increase to 500% increase) in one or more (e.g., two, three, four, five, six, seven, eight, nine, or ten) of: the plasma, serum, or blood level of IL-6; the plasma, serum, or blood level of IL-2; the plasma, serum, or blood level of IL-1β; the plasma, serum, or blood level of TNFα; the plasma, serum, or blood level of IL-17A; the plasma, serum, or blood level of IL-22; the plasma, serum, or blood level of interferon-K; the level of blood Th memory cells (CD44$^+$CD45RB$^-$CD4$^+$ cells); the level of α4β7 expression in blood cells, and the level of α4β7 expression in Th memory cells (CD44 CD45RB CD4' cells) in mesenteric lymph nodes, e.g., each as compared to the corresponding level in a subject systemically administered the same dose of the same immune modulator. Methods for determining the plasma, serum, or blood level of IL-6; the plasma, serum, or blood level of IL-2; the plasma, serum, or blood level of IL-1β; the plasma, serum, or blood level of TNFα; the plasma, serum, or blood level of IL-17A; the plasma, serum, or blood level of IL-22; the plasma, serum, or blood level of interferon-K; the level of blood Th memory cells (CD44$^+$CD45RB$^-$CD4$^+$ cells);

and the level of α4β7 expression in blood cells; and the level of α4β7 expression in blood cells are known in the art.

In some examples, the methods described herein can result in a 1% decrease to 99% decrease (e.g., a 1% decrease to 95% decrease, a 1% decrease to 90% decrease, a 1% decrease to 85% decrease, a 1% decrease to 80% decrease, a 1% decrease to 75% decrease, a 1% decrease to 70% decrease, a 1% decrease to 65% decrease, a 1% decrease to 60% decrease, a 1% decrease to 55% decrease, a 1% decrease to 50% decrease, a 1% decrease to 45% decrease, a 1% decrease to 40% decrease, a 1% decrease to 35% decrease, a 1% decrease to 30% decrease, a 1% decrease to 25% decrease, a 1% decrease to 20% decrease, a 1% decrease to 15% decrease, a 1% decrease to 10% decrease, a 1% decrease to 5% decrease, a 5% decrease to 99% decrease, a 5% decrease to 95% decrease, a 5% decrease to 90% decrease, a 5% decrease to 85% decrease, a 5% decrease to 80% decrease, a 5% decrease to 75% decrease, a 5% decrease to 70% decrease, a 5% decrease to 65% decrease, a 5% decrease to 60% decrease, a 5% decrease to 55% decrease, a 5% decrease to 50% decrease, a 5% decrease to 45% decrease, a 5% decrease to 40% decrease, a 5% decrease to 35% decrease, a 5% decrease to 30% decrease, a 5% decrease to 25% decrease, a 5% decrease to 20% decrease, a 5% decrease to 15% decrease, a 5% decrease to 10% decrease, a 10% decrease to 99% decrease, a 10% decrease to 95% decrease, a 10% decrease to 90% decrease, a 10% decrease to 85% decrease, a 10% decrease to 80% decrease, a 10% decrease to 75% decrease, a 10% decrease to 70% decrease, a 10% decrease to 65% decrease, a 10% decrease to 60% decrease, a 10% decrease to 55% decrease, a 10% decrease to 50% decrease, a 10% decrease to 45% decrease, a 10% decrease to 40% decrease, a 10% decrease to 35% decrease, a 10% decrease to 30% decrease, a 10% decrease to 25% decrease, a 10% decrease to 20% decrease, a 10% decrease to 15% decrease, a 15% decrease to 99% decrease, a 15% decrease to 95% decrease, a 15% decrease to 90% decrease, a 15% decrease to 85% decrease, a 15% decrease to 80% decrease, a 15% decrease to 75% decrease, a 15% decrease to 70% decrease, a 15% decrease to 65% decrease, a 15% decrease to 60% decrease, a 15% decrease to 55% decrease, a 15% decrease to 50% decrease, a 15% decrease to 45% decrease, a 15% decrease to 40% decrease, a 15% decrease to 35% decrease, a 15% decrease to 30% decrease, a 15% decrease to 25% decrease, a 15% decrease to 20% decrease, a 20% decrease to 99% decrease, a 20% decrease to 95% decrease, a 20% decrease to 90% decrease, a 20% decrease to 85% decrease, a 20% decrease to 80% decrease, a 20% decrease to 75% decrease, a 20% decrease to 70% decrease, a 20% decrease to 65% decrease, a 20% decrease to 60% decrease, a 20% decrease to 55% decrease, a 20% decrease to 50% decrease, a 20% decrease to 45% decrease, a 20% decrease to 40% decrease, a 20% decrease to 35% decrease, a 20% decrease to 30% decrease, a 20% decrease to 25% decrease, a 25% decrease to 99% decrease, a 25% decrease to 95% decrease, a 25% decrease to 90% decrease, a 25% decrease to 85% decrease, a 25% decrease to 80% decrease, a 25% decrease to 75% decrease, a 25% decrease to 70% decrease, a 25% decrease to 65% decrease, a 25% decrease to 60% decrease, a 25% decrease to 55% decrease, a 25% decrease to 50% decrease, a 25% decrease to 45% decrease, a 25% decrease to 40% decrease, a 25% decrease to 35% decrease, a 25% decrease to 30% decrease, a 30% decrease to 99% decrease, a 30% decrease to 95% decrease, a 30% decrease to 90% decrease, a 30% decrease to 85% decrease, a 30% decrease to 80% decrease, a 30% decrease to 75% decrease, a 30% decrease to 70% decrease, a 30% decrease to 65% decrease, a 30% decrease to 60% decrease, a 30% decrease to 55% decrease, a 30% decrease to 50% decrease, a 30% decrease to 45% decrease, a 30% decrease to 40% decrease, a 30% decrease to 35% decrease, a 35% decrease to 99% decrease, a 35% decrease to 95% decrease, a 35% decrease to 90% decrease, a 35% decrease to 85% decrease, a 35% decrease to 80% decrease, a 35% decrease to 75% decrease, a 35% decrease to 70% decrease, a 35% decrease to 65% decrease, a 35% decrease to 60% decrease, a 35% decrease to 55% decrease, a 35% decrease to 50% decrease, a 35% decrease to 45% decrease, a 35% decrease to 40% decrease, a 40% decrease to 99% decrease, a 40% decrease to 95% decrease, a 40% decrease to 90% decrease, a 40% decrease to 85% decrease, a 40% decrease to 80% decrease, a 40% decrease to 75% decrease, a 40% decrease to 70% decrease, a 40% decrease to 65% decrease, a 40% decrease to 60% decrease, a 40% decrease to 55% decrease, a 40% decrease to 50% decrease, a 40% decrease to 45% decrease, a 45% decrease to 99% decrease, a 45% decrease to 95% decrease, a 45% decrease to 90% decrease, a 45% decrease to 85% decrease, a 45% decrease to 80% decrease, a 45% decrease to 75% decrease, a 45% decrease to 70% decrease, a 45% decrease to 65% decrease, a 45% decrease to 60% decrease, a 45% decrease to 55% decrease, a 45% decrease to 50% decrease, a 50% decrease to 99% decrease, a 50% decrease to 95% decrease, a 50% decrease to 90% decrease, a 50% decrease to 85% decrease, a 50% decrease to 80% decrease, a 50% decrease to 75% decrease, a 50% decrease to 70% decrease, a 50% decrease to 65% decrease, a 50% decrease to 60% decrease, a 50% decrease to 55% decrease, a 55% decrease to 99% decrease, a 55% decrease to 95% decrease, a 55% decrease to 90% decrease, a 55% decrease to 85% decrease, a 55% decrease to 80% decrease, a 55% decrease to 75% decrease, a 55% decrease to 70% decrease, a 55% decrease to 65% decrease, a 55% decrease to 60% decrease, a 60% decrease to 99% decrease, a 60% decrease to 95% decrease, a 60% decrease to 90% decrease, a 60% decrease to 85% decrease, a 60% decrease to 80% decrease, a 60% decrease to 75% decrease, a 60% decrease to 70% decrease, a 60% decrease to 65% decrease, a 65% decrease to 99% decrease, a 65% decrease to 95% decrease, a 65% decrease to 90% decrease, a 65% decrease to 85% decrease, a 65% decrease to 80% decrease, a 65% decrease to 75% decrease, a 65% decrease to 70% decrease, a 70% decrease to 99% decrease, a 70% decrease to 95% decrease, a 70% decrease to 90% decrease, a 70% decrease to 85% decrease, a 70% decrease to 80% decrease, a 70% decrease to 75% decrease, a 75% decrease to 99% decrease, a 75% decrease to 95% decrease, a 75% decrease to 90% decrease, a 75% decrease to 85% decrease, a 75% decrease to 80% decrease, a 80% decrease to 99% decrease, a 80% decrease to 95% decrease, a 80% decrease to 90% decrease, a 80% decrease to 85% decrease, a 85% decrease to 99% decrease, a 85% decrease to 95% decrease, a 85% decrease to 90% decrease, a 90% decrease to 99% decrease, a 90% decrease to 95% decrease, or a 95% decrease to 99% decrease) in the the level of Th memory cells (CD44$^+$CD45RB$^-$CD4$^+$ cells) in mesenteric lymph nodes and/or the level of Th memory cells in Peyer's patches, e.g., as compared to the corresponding level in a subject systemically administered the same dose of the immune modulator. Methods for determining the level of Th memory cells (CD44$^+$CD45RB$^-$CD4$^+$ cells) in Peyer's patches, and the level of Th memory cells (CD44$^+$CD45RB$^-$CD4$^+$ cells) in mesenteric lymph nodes are known in the art.

In some examples of any of the methods described herein can result, e.g., in a 1% to 99% decrease (or any of the subranges of this range described herein) in one or more (e.g., two, three, four, five, six, or seven) of: the level of interferon-K in GI tissue or GI content; the level of IL-1 in GI tissue or GI content; the level of IL-6 in GI tissue or GI content; the level of IL-22 in GI tissue or GI content; the level of IL-17A in GI tissue or GI content; the level of TNFα in GI tissue or GI content; and the level of IL-2 in GI tissue or GI content, e.g., as compared to the corresponding level in a subject not administered a treatment, or not administered an IL-12/IL-23 inhibitor locally as disclosed herein. Accordingly, in some embodiments, the methods described herein can result, e.g., in a 1% to 99% decrease (or any of the subranges of this range described herein) in one or more (e.g., two, three, four, five, six, or seven) of the level of interferon-K; the level of IL-1β; the level of IL-6; the level of IL-22; the level of IL-17A; the level of TNFα; and the level of IL-2, in the duodenum tissue proximate to one or more sites of disease. Accordingly, in some embodiments, the methods described herein can result, e.g., in a 1% to 99% decrease (or any of the subranges of this range described herein) in one or more (e.g., two, three, four, five, six, or seven) of the level of interferon-K; the level of IL-1β; the level of IL-6; the level of IL-22; the level of IL-17A; the level of TNFα; and the level of IL-2, in the ileum tissue proximate to one or more sites of disease. Accordingly, in some embodiments, the methods described herein can result, e.g., in a 1% to 99% decrease (or any of the subranges of this range described herein) in one or more (e.g., two, three, four, five, six, or seven) of the level of interferon-K; the level of IL-1β; the level of IL-6; the level of IL-22; the level of IL-17A; the level of TNFα; and the level of IL-2, in the jejunum tissue proximate to one or more sites of disease. Accordingly, in some embodiments, the methods described herein can result, e.g., in a 1% to 99% decrease (or any of the subranges of this range described herein) in one or more (e.g., two, three, four, five, six, or seven) of the level of interferon-K; the level of IL-1β; the level of IL-6; the level of IL-22; the level of IL-17A; the level of TNFα; and the level of IL-2, in the cecum tissue proximate to one or more sites of disease. Accordingly, in some embodiments, the methods described herein can result, e.g., in a 1% to 99% decrease (or any of the subranges of this range described herein) in one or more (e.g., two, three, four, five, six, or seven) of the level of interferon-K; the level of IL-1β; the level of IL-6; the level of IL-22; the level of IL-17A; the level of TNFα; and the level of IL-2, in the ascending colon tissue proximate to one or more sites of disease. Accordingly, in some embodiments, the methods described herein can result, e.g., in a 1% to 99% decrease (or any of the subranges of this range described herein) in one or more (e.g., two, three, four, five, six, or seven) of the level of interferon-K; the level of IL-1β; the level of IL-6; the level of IL-22; the level of IL-17A; the level of TNFα; and the level of IL-2, in the transverse colon tissue proximate to one or more sites of disease. Accordingly, in some embodiments, the methods described herein can result, e.g., in a 1% to 99% decrease (or any of the subranges of this range described herein) in one or more (e.g., two, three, four, five, six, or seven) of the level of interferon-K; the level of IL-1β; the level of IL-6; the level of IL-22; the level of IL-17A; the level of TNFα; and the level of IL-2, in the descending colon tissue proximate to one or more sites of disease. Accordingly, in some embodiments, the methods described herein can result, e.g., in a 1% to 99% decrease (or any of the subranges of this range described herein) in one or more (e.g., two, three, four, five, six, or seven) of the level of interferon-K; the level of IL-1β; the level of IL-6; the level of IL-22; the level of IL-17A; the level of TNFα; and the level of IL-2, in the sigmoid colon tissue proximate to one or more sites of disease.

In some embodiments, the immune modulator is delivered to the location by a process that does not comprise systemic transport of the immune modulator.

In some embodiments, the amount of the immune modulator that is administered is from about 1 mg to about 650 mg. In some embodiments, the amount of immune modulator that is administered is from about 1 mg to about 600 mg. In some embodiments, the amount of the immune modulator that is administered is from about 1 mg to about 500 mg. In some embodiments, the amount of the immune modulator that is administered is from about 1 mg to about 100 mg. In some embodiments, the amount of the immune modulator that is administered is from about 5 mg to about 300 mg. In some embodiments, the amount of the immune modulator that is administered is from about 5 mg to about 50 mg. In some embodiments, the amount of the immune modulator that is administered is from about 10 mg to about 50 mg. In some embodiments, the amount of the immune modulator that is administered is from about 5 mg to about 40 mg.

In some embodiments, the amount of the immune modulator is administered as an escalating dose of 10 mg, followed by 20 mg, followed by 30 mg; or an escalating dose of 20 mg, followed by 30 mg, followed by 50 mg.

In some embodiments, the amount of the immune modulator is administered in a dose of, e.g., about 1 mg to about 300 mg, about 1 mg to about 250 mg, about 1 mg to about 200 mg, about 1 mg to about 195 mg, about 1 mg to about 190 mg, about 1 mg to about 185 mg, about 1 mg to about 180 mg, about 1 mg to about 175 mg, about 1 mg to about 170 mg, about 1 mg to about 165 mg, about 1 mg to about 160 mg, about 1 mg to about 155 mg, about 1 mg to about 150 mg, about 1 mg to about 145 mg, about 1 mg to about 140 mg, about 1 mg to about 135 mg, about 1 mg to about 130 mg, about 1 mg to about 125 mg, about 1 mg to about 120 mg, about 1 mg to about 115 mg, about 1 mg to about 110 mg, about 1 mg to about 105 mg, about 1 mg to about 100 mg, about 1 mg to about 95 mg, about 1 mg to about 90 mg, about 1 mg to about 85 mg, about 1 mg to about 80 mg, about 1 mg to about 75 mg, about 1 mg to about 70 mg, about 1 mg to about 65 mg, about 1 mg to about 60 mg, about 1 mg to about 55 mg, about 1 mg to about 50 mg, about 1 mg to about 45 mg, about 1 mg to about 40 mg, about 1 mg to about 35 mg, about 1 mg to about 30 mg, about 1 mg to about 25 mg, about 1 mg to about 20 mg, about 1 mg to about 15 mg, about 1 mg to about 10 mg, about 1 mg to about 5 mg, about 5 mg to about 200 mg, about 5 mg to about 195 mg, about 5 mg to about 190 mg, about 5 mg to about 185 mg, about 5 mg to about 180 mg, about 5 mg to about 175 mg, about 5 mg to about 170 mg, about 5 mg to about 165 mg, about 5 mg to about 160 mg, about 5 mg to about 155 mg, about 5 mg to about 150 mg, about 5 mg to about 145 mg, about 5 mg to about 140 mg, about 5 mg to about 135 mg, about 5 mg to about 130 mg, about 5 mg to about 125 mg, about 5 mg to about 120 mg, about 5 mg to about 115 mg, about 5 mg to about 110 mg, about 5 mg to about 105 mg, about 5 mg to about 100 mg, about 5 mg to about 95 mg, about 5 mg to about 90 mg, about 5 mg to about 85 mg, about 5 mg to about 80 mg, about 5 mg to about 75 mg, about 5 mg to about 70 mg, about 5 mg to about 65 mg, about 5 mg to about 60 mg, about 5 mg to about 55 mg, about 5 mg to about 50 mg, about 5 mg to about 45 mg, about 5 mg to about 40 mg, about 5 mg to about 35 mg, about 5 mg to about 30 mg, about 5 mg to about 25 mg, about 5 mg to about 20 mg, about 5 mg to about 15 mg, about 5 mg to about 10 mg, about 10 mg to about 200 mg, about 10 mg to about 195 mg, about 10 mg to about 190 mg, about 10 mg to about 185 mg, about 10 mg to about 180 mg, about 10 mg to about 175 mg, about 10 mg to about 170 mg, about 10 mg to about 165 mg, about 10 mg to about 160 mg, about 10 mg to about 155 mg, about 10 mg to about 150 mg, about 10 mg to about 145 mg, about 10 mg to about 140 mg, about 10 mg to about 135 mg, about 10 mg to about 130 mg, about 10 mg to about 125 mg, about 10 mg to about 120 mg, about 10 mg to about 115 mg, about 10 mg to about 110 mg, about 10 mg to about 105 mg, about 10 mg to about 100 mg, about 10 mg to about 95 mg, about 10 mg to about 90 mg, about 10 mg to about 85 mg, about 10 mg to about 80 mg, about 10 mg to about 75 mg, about 10 mg to about 70 mg, about 10 mg to about 65 mg, about 10 mg to about 60 mg, about 10 mg to about 55 mg, about 10 mg to about 50 mg, about 10 mg to about 45 mg, about 10 mg to about 40 mg, about 10 mg to about 35 mg, about 10 mg to about 30 mg, about 10 mg to about 25 mg, about 10 mg to about 20 mg, about 10 mg to about 15 mg, about 15 mg to about 200 mg, about 15 mg to about 195 mg, about 15 mg to about 190 mg, about 15 mg to about 185 mg, about 15 mg to about 180 mg, about 15 mg to about 175 mg, about 15 mg to about 170 mg, about 15 mg to about 165 mg, about 15 mg to about 160 mg, about 15 mg to about 155 mg, about 15 mg to about 150 mg, about 15 mg to about 145 mg, about 15 mg to about 140 mg, about 15 mg to about 135 mg, about 15 mg to about 130 mg, about 15 mg to about 125 mg, about 15 mg to about 120 mg, about 15 mg to about 115 mg, about 15 mg to about 110 mg, about 15 mg to about 105 mg, about 15 mg to about 100 mg, about 15 mg to about 95 mg, about 15 mg to about 90 mg, about 15 mg to about 85 mg, about 15 mg to about 80 mg, about 15 mg to about 75 mg, about 15 mg to about 70 mg, about 15 mg to about 65 mg, about 15 mg to about 60 mg, about 15 mg to about 55 mg, about 15 mg to about 50 mg, about 15 mg to about 45 mg, about 15 mg to about 40 mg, about 15 mg to about 35 mg, about 15 mg to about 30 mg, about 15 mg to about 25 mg, about 15 mg to about 20 mg, about 20 mg to about 200 mg, about 20 mg to about 195 mg, about 20 mg to about 190 mg, about 20 mg to about 185 mg, about 20 mg to about 180 mg, about 20 mg to about 175 mg, about 20 mg to about 170 mg, about 20 mg to about 165 mg, about 20 mg to about 160 mg, about 20 mg to about 155 mg, about 20 mg to about 150 mg, about 20 mg to about 145 mg, about 20 mg to about 140 mg, about 20 mg to about 135 mg, about 20 mg to about 130 mg, about 20 mg to about 125 mg, about 20 mg to about 120 mg, about 20 mg to about 115 mg, about 20 mg to about 110 mg, about 20 mg to about 105 mg, about 20 mg to about 100 mg, about 20 mg to about 95 mg, about 20 mg to about 90 mg, about 20 mg to about 85 mg, about 20 mg to about 80 mg, about 20 mg to about 75 mg, about 20 mg to about 70 mg, about 20 mg to about 65 mg, about 20 mg to about 60 mg, about 20 mg to about 55 mg, about 20 mg to about 50 mg, about 20 mg to about 45 mg, about 20 mg to about 40 mg, about 20 mg to about 35 mg, about 20 mg to about 30 mg, about 20 mg to about 25 mg, about 25 mg to about 200 mg, about 25 mg to about 195 mg, about 25 mg to about 190 mg, about 25 mg to about 185 mg, about 25 mg to about 180 mg, about 25 mg to about 175 mg, about 25 mg to about 170 mg, about 25 mg to about 165 mg, about 25 mg to about 160 mg, about 25 mg to about 155 mg, about 25 mg to about 150 mg, about 25 mg to about 145 mg, about 25 mg to about 140 mg, about 25 mg to about 135 mg, about 25 mg to about 130 mg, about 25 mg to about 125 mg, about 25 mg to about 120 mg, about 25 mg to about 115 mg, about 25 mg to about 110 mg, about 25 mg to about 105 mg, about 25 mg to about 100 mg, about 25 mg to about 95 mg, about 25 mg to about 90 mg, about 25 mg to about 85 mg, about 25 mg to about 80 mg, about 25 mg to about 75 mg, about 25 mg to about 70 mg, about 25 mg to about 65 mg, about 25 mg to about 60 mg, about 25 mg to about 55 mg, about 25 mg to about 50 mg, about 25 mg to about 45 mg, about 25 mg to about 40 mg, about 25 mg to about 35 mg, about 25 mg to about 30 mg, about 30 mg to about 200 mg, about 30 mg to about 195 mg, about 30 mg to about 190 mg, about 30 mg to about 185 mg, about 30 mg to about 180 mg, about 30 mg to about 175 mg, about 30 mg to about 170 mg, about 30 mg to about 165 mg, about 30 mg to about 160 mg, about 30 mg to about 155 mg, about 30 mg to about 150 mg, about 30 mg to about 145 mg, about 30 mg to about 140 mg, about 30 mg to about 135 mg, about 30 mg to about 130 mg, about 30 mg to about 125 mg, about 30 mg to about 120 mg, about 30 mg to about 115 mg, about 30 mg to about 110 mg, about 30 mg to about 105 mg, about 30 mg to about 100 mg, about 30 mg to about 95 mg, about 30 mg to about 90 mg, about 30 mg to about 85 mg, about 30 mg to about 80 mg, about 30 mg to about 75 mg, about 30 mg to about 70 mg, about 30 mg to about 65 mg, about 30 mg to about 60 mg, about 30 mg to about 55 mg, about 30 mg to about 50 mg, about 30 mg to about 45 mg, about 30 mg to about 40 mg, about 30 mg to about 35 mg, about 35 mg to about 200 mg, about 35 mg to about 195 mg, about 35 mg to about 190 mg, about 35 mg to about 185 mg, about 35 mg to about 180 mg, about 35 mg to about 175 mg, about 35 mg to about 170 mg, about 35 mg to about 165 mg, about 35 mg to about 160 mg, about 35 mg to about 155 mg, about 35 mg to about 150 mg, about 35 mg to about 145 mg, about 35 mg to about 140 mg, about 35 mg to about 135 mg, about 35 mg to about 130 mg, about 35 mg to about 125 mg, about 35 mg to about 120 mg, about 35 mg to about 115 mg, about 35 mg to about 110 mg, about 35 mg to about 105 mg, about 35 mg to about 100 mg, about 35 mg to about 95 mg, about 35 mg to about 90 mg, about 35 mg to about 85 mg, about 35 mg to about 80 mg, about 35 mg to about 75 mg, about 35 mg to about 70 mg, about 35 mg to about 65 mg, about 35 mg to about 60 mg, about 35 mg to about 55 mg, about 35 mg to about 50 mg, about 35 mg to about 45 mg, about 35 mg to about 40 mg, about 40 mg to about 200 mg, about 40 mg to about 195 mg, about 40 mg to about 190 mg, about 40 mg to about 185 mg, about 40 mg to about 180 mg, about 40 mg to about 175 mg, about 40 mg to about 170 mg, about 40 mg to about 165 mg, about 40 mg to about 160 mg, about 40 mg to about 155 mg, about 40 mg to about 150 mg, about 40 mg to about 145 mg, about 40 mg to about 140 mg, about 40 mg to about 135 mg, about 40 mg to about 130 mg, about 40 mg to about 125 mg, about 40 mg to about 120 mg, about 40 mg to about 115 mg, about 40 mg to about 110 mg, about 40 mg to about 105 mg, about 40 mg to about 100 mg, about 40 mg to about 95 mg, about 40 mg to about 90 mg, about 40 mg to about 85 mg, about 40 mg to about 80 mg, about 40 mg to about 75 mg, about 40 mg to about 70 mg, about 40 mg to about 65 mg, about 40 mg to about 60 mg, about 40 mg to about 55 mg, about 40 mg to about 50 mg, about 40 mg to about 45 mg, about 45 mg to about 200 mg, about 45 mg to about 195 mg, about 45 mg to about 190 mg, about 45 mg to about 185 mg, about 45 mg to about 180 mg, about 45 mg to about 175 mg, about 45 mg to about 170 mg, about 45 mg to about 165 mg, about 45 mg to about 160 mg, about 45 mg to about 155 mg, about 45 mg to about 150 mg, about 45 mg to about 145 mg, about 45 mg to about 140 mg, about 45 mg to about 135 mg, about 45 mg to about 130 mg, about 45 mg to about 125 mg, about 45 mg to about 120 mg, about 45 mg to about 115 mg, about 45 mg to about 110 mg, about 45 mg to about 105 mg, about 45 mg to about 100 mg, about 45 mg to about 95 mg, about 45 mg to about 90 mg, about 45 mg to about 85 mg, about 45 mg to about 80 mg, about 45 mg to about 75 mg, about 45 mg to about 70 mg, about 45 mg to about 65 mg, about 45 mg to about 60 mg, about 45 mg to about 55 mg, about 45 mg to about 50 mg, about 50 mg to about 200 mg, about 50 mg to about 195 mg, about 50 mg to about 190 mg, about 50 mg to about 185 mg, about 50 mg to about 180 mg, about 50 mg to about 175 mg, about 50 mg to about 170 mg, about 50 mg to about 165 mg, about 50 mg to about 160 mg, about 50 mg to about 155 mg, about 50 mg to about 150 mg, about 50 mg to about 145 mg, about 50 mg to about 140 mg, about 50 mg to about 135 mg, about 50 mg to about 130 mg, about 50 mg to about 125 mg, about 50 mg to about 120 mg, about 50 mg to about 115 mg, about 50 mg to about 110 mg, about 50 mg to about 105 mg, about 50 mg to about 100 mg, about 50 mg to about 95 mg, about 50 mg to about 90 mg, about 50 mg to about 85 mg, about 50 mg to about 80 mg, about 50 mg to about 75 mg, about 50 mg to about 70 mg, about 50 mg to about 65 mg, about 50 mg to about 60 mg, about 50 mg to about 55 mg, about 55 mg to about 200 mg, about 55 mg to about 195 mg, about 55 mg to about 190 mg, about 55 mg to about 185 mg, about 55 mg to about 180 mg, about 55 mg to about 175 mg, about 55 mg to about 170 mg, about 55 mg to about 165 mg, about 55 mg to about 160 mg, about 55 mg to about 155 mg, about 55 mg to about 150 mg, about 55 mg to about 145 mg, about 55 mg to about 140 mg, about 55 mg to about 135 mg, about 55 mg to about 130 mg, about 55 mg to about 125 mg, about 55 mg to about 120 mg, about 55 mg to about 115 mg, about 55 mg to about 110 mg, about 55 mg to about 105 mg, about 55 mg to about 100 mg, about 55 mg to about 95 mg, about 55 mg to about 90 mg, about 55 mg to about 85 mg, about 55 mg to about 80 mg, about 55 mg to about 75 mg, about 55 mg to about 70 mg, about 55 mg to about 65 mg, about 55 mg to about 60 mg, about 60 mg to about 200 mg, about 60 mg to about 195 mg, about 60 mg to about 190 mg, about 60 mg to about 185 mg, about 60 mg to about 180 mg, about 60 mg to about 175 mg, about 60 mg to about 170 mg, about 60 mg to about 165 mg, about 60 mg to about 160 mg, about 60 mg to about 155 mg, about 60 mg to about 150 mg, about 60 mg to about 145 mg, about 60 mg to about 140 mg, about 60 mg to about 135 mg, about 60 mg to about 130 mg, about 60 mg to about 125 mg, about 60 mg to about 120 mg, about 60 mg to about 115 mg, about 60 mg to about 110 mg, about 60 mg to about 105 mg, about 60 mg to about 100 mg, about 60 mg to about 95 mg, about 60 mg to about 90 mg, about 60 mg to about 85 mg, about 60 mg to about 80 mg, about 60 mg to about 75 mg, about 60 mg to about 70 mg, about 60 mg to about 65 mg, about 65 mg to about 200 mg, about 65 mg to about 195 mg, about 65 mg to about 190 mg, about 65 mg to about 185 mg, about 65 mg to about 180 mg, about 65 mg to about 175 mg, about 65 mg to about 170 mg, about 65 mg to about 165 mg, about 65 mg to about 160 mg, about 65 mg to about 155 mg, about 65 mg to about 150 mg, about 65 mg to about 145 mg, about 65 mg to about 140 mg, about 65 mg to about 135 mg, about 65 mg to about 130 mg, about 65 mg to about 125 mg, about 65 mg to about 120 mg, about 65 mg to about 115 mg, about 65 mg to about 110 mg, about 65 mg to about 105 mg, about 65 mg to about 100 mg, about 65 mg to about 95 mg, about 65 mg to about 90 mg, about 65 mg to about 85 mg, about 65 mg to about 80 mg, about 65 mg to about 75 mg, about 65 mg to about 70 mg, about 70 mg to about 200 mg, about 70 mg to about 195 mg, about 70 mg to about 190 mg, about 70 mg to about 185 mg, about 70 mg to about 180 mg, about 70 mg to about 175 mg, about 70 mg to about 170 mg, about 70 mg to about 165 mg, about 70 mg to about 160 mg, about 70 mg to about 155 mg, about 70 mg to about 150 mg, about 70 mg to about 145 mg, about 70 mg to about 140 mg, about 70 mg to about 135 mg, about 70 mg to about 130 mg, about 70 mg to about 125 mg, about 70 mg to about 120 mg, about 70 mg to about 115 mg, about 70 mg to about 110 mg, about 70 mg to about 105 mg, about 70 mg to about 100 mg, about 70 mg to about 95 mg, about 70 mg to about 90 mg, about 70 mg to about 85 mg, about 70 mg to about 80 mg, about 70 mg to about 75 mg, about 75 mg to about 200 mg, about 75 mg to about 195 mg, about 75 mg to about 190 mg, about 75 mg to about 185 mg, about 75 mg to about 180 mg, about 75 mg to about 175 mg, about 75 mg to about 170 mg, about 75 mg to about 165 mg, about 75 mg to about 160 mg, about 75 mg to about 155 mg, about 75 mg to about 150 mg, about 75 mg to about 145 mg, about 75 mg to about 140 mg, about 75 mg to about 135 mg, about 75 mg to about 130 mg, about 75 mg to about 125 mg, about 75 mg to about 120 mg, about 75 mg to about 115 mg, about 75 mg to about 110 mg, about 75 mg to about 105 mg, about 75 mg to about 100 mg, about 75 mg to about 95 mg, about 75 mg to about 90 mg, about 75 mg to about 85 mg, about 75 mg to about 80 mg, about 80 mg to about 200 mg, about 80 mg to about 195 mg, about 80 mg to about 190 mg, about 80 mg to about 185 mg, about 80 mg to about 180 mg, about 80 mg to about 175 mg, about 80 mg to about 170 mg, about 80 mg to about 165 mg, about 80 mg to about 160 mg, about 80 mg to about 155 mg, about 80 mg to about 150 mg, about 80 mg to about 145 mg, about 80 mg to about 140 mg, about 80 mg to about 135 mg, about 80 mg to about 130 mg, about 80 mg to about 125 mg, about 80 mg to about 120 mg, about 80 mg to about 115 mg, about 80 mg to about 110 mg, about 80 mg to about 105 mg, about 80 mg to about 100 mg, about 80 mg to about 95 mg, about 80 mg to about 90 mg, about 80 mg to about 85 mg, about 85 mg to about 200 mg, about 85 mg to about 195 mg, about 85 mg to about 190 mg, about 85 mg to about 185 mg, about 85 mg to about 180 mg, about 85 mg to about 175 mg, about 85 mg to about 170 mg, about 85 mg to about 165 mg, about 85 mg to about 160 mg, about 85 mg to about 155 mg, about 85 mg to about 150 mg, about 85 mg to about 145 mg, about 85 mg to about 140 mg, about 85 mg to about 135 mg, about 85 mg to about 130 mg, about 85 mg to about 125 mg, about 85 mg to about 120 mg, about 85 mg to about 115 mg, about 85 mg to about 110 mg, about 85 mg to about 105 mg, about 85 mg to about 100 mg, about 85 mg to about 95 mg, about 85 mg to about 90 mg, about 90 mg to about 200 mg, about 90 mg to about 195 mg, about 90 mg to about 190 mg, about 90 mg to about 185 mg, about 90 mg to about 180 mg, about 90 mg to about 175 mg, about 90 mg to about 170 mg, about 90 mg to about 165 mg, about 90 mg to about 160 mg, about 90 mg to about 155 mg, about 90 mg to about 150 mg, about 90 mg to about 145 mg, about 90 mg to about 140 mg, about 90 mg to about 135 mg, about 90 mg to about 130 mg, about 90 mg to about 125 mg, about 90 mg to about 120 mg, about 90 mg to about 115 mg, about 90 mg to about 110 mg, about 90 mg to about 105 mg, about 90 mg to about 100 mg, about 90 mg to about 95 mg, about 95 mg to about 200 mg, about 95 mg to about 195 mg, about 95 mg to about 190 mg, about 95 mg to about 185 mg, about 95 mg to about 180 mg, about 95 mg to about 175 mg, about 95 mg to about 170 mg, about 95 mg to about 165 mg, about 95 mg to about 160 mg, about 95 mg to about 155 mg, about 95 mg to about 150 mg, about 95 mg to about 145 mg, about 95 mg to about 140 mg, about 95 mg to about 135 mg, about 95 mg to about 130 mg, about 95 mg to about 125 mg, about 95 mg to about 120 mg, about 95 mg to about 115 mg, about 95 mg to about 110 mg, about 95 mg to about 105 mg, about 95 mg to about 100 mg, about 100 mg to about 200 mg, about 100 mg to about 195 mg, about 100 mg to about 190 mg, about 100 mg to about 185 mg, about 100 mg to about 180 mg, about 100 mg to about 175 mg, about 100 mg to about 170 mg, about 100 mg to about 165 mg, about 100 mg to about 160 mg, about 100 mg to about 155 mg, about 100 mg to about 150 mg, about 100 mg to about 145 mg, about 100 mg to about 140 mg, about 100 mg to about 135 mg, about 100 mg to about 130 mg, about 100 mg to about 125 mg, about 100 mg to about 120 mg, about 100 mg to about 115 mg, about 100 mg to about 110 mg, about 100 mg to about 105 mg, about 105 mg to about 200 mg, about 105 mg to about 195 mg, about 105 mg to about 190 mg, about 105 mg to about 185 mg, about 105 mg to about 180 mg, about 105 mg to about 175 mg, about 105 mg to about 170 mg, about 105 mg to about 165 mg, about 105 mg to about 160 mg, about 105 mg to about 155 mg, about 105 mg to about 150 mg, about 105 mg to about 145 mg, about 105 mg to about 140 mg, about 105 mg to about 135 mg, about 105 mg to about 130 mg, about 105 mg to about 125 mg, about 105 mg to about 120 mg, about 105 mg to about 115 mg, about 105 mg to about 110 mg, about 110 mg to about 200 mg, about 110 mg to about 195 mg, about 110 mg to about 190 mg, about 110 mg to about 185 mg, about 110 mg to about 180 mg, about 110 mg to about 175 mg, about 110 mg to about 170 mg, about 110 mg to about 165 mg, about 110 mg to about 160 mg, about 110 mg to about 155 mg, about 110 mg to about 150 mg, about 110 mg to about 145 mg, about 110 mg to about 140 mg, about 110 mg to about 135 mg, about 110 mg to about 130 mg, about 110 mg to about 125 mg, about 110 mg to about 120 mg, about 110 mg to about 115 mg, about 115 mg to about 200 mg, about 115 mg to about 195 mg, about 115 mg to about 190 mg, about 115 mg to about 185 mg, about 115 mg to about 180 mg, about 115 mg to about 175 mg, about 115 mg to about 170 mg, about 115 mg to about 165 mg, about 115 mg to about 160 mg, about 115 mg to about 155 mg, about 115 mg to about 150 mg, about 115 mg to about 145 mg, about 115 mg to about 140 mg, about 115 mg to about 135 mg, about 115 mg to about 130 mg, about 115 mg to about 125 mg, about 115 mg to about 120 mg, about 120 mg to about 200 mg, about 120 mg to about 195 mg, about 120 mg to about 190 mg, about 120 mg to about 185 mg, about 120 mg to about 180 mg, about 120 mg to about 175 mg, about 120 mg to about 170 mg, about 120 mg to about 165 mg, about 120 mg to about 160 mg, about 120 mg to about 155 mg, about 120 mg to about 150 mg, about 120 mg to about 145 mg, about 120 mg to about 140 mg, about 120 mg to about 135 mg, about 120 mg to about 130 mg, about 120 mg to about 125 mg, about 125 mg to about 200 mg, about 125 mg to about 195 mg, about 125 mg to about 190 mg, about 125 mg to about 185 mg, about 125 mg to about 180 mg, about 125 mg to about 175 mg, about 125 mg to about 170 mg, about 125 mg to about 165 mg, about 125 mg to about 160 mg, about 125 mg to about 155 mg, about 125 mg to about 150 mg, about 125 mg to about 145 mg, about 125 mg to about 140 mg, about 125 mg to about 135 mg, about 125 mg to about 130 mg, about 130 mg to about 200 mg, about 130 mg to about 195 mg, about 130 mg to about 190 mg, about 130 mg to about 185 mg, about 130 mg to about 180 mg, about 130 mg to about 175 mg, about 130 mg to about 170 mg, about 130 mg to about 165 mg, about 130 mg to about 160 mg, about 130 mg to about 155 mg, about 130 mg to about 150 mg, about 130 mg to about 145 mg, about 130 mg to about 140 mg, about 130 mg to about 135 mg, about 135 mg to about 200 mg, about 135 mg to about 195 mg, about 135 mg to about 190 mg, about 135 mg to about 185 mg, about 135 mg to about 180 mg, about 135 mg to about 175 mg, about 135 mg to about 170 mg, about 135 mg to about 165 mg, about 135 mg to about 160 mg, about 135 mg to about 155 mg, about 135 mg to about 150 mg, about 135 mg to about 145 mg, about 135 mg to about 140 mg, about 140 mg to about 200 mg, about 140 mg to about 195 mg, about 140 mg to about 190 mg, about 140 mg to about 185 mg, about 140 mg to about 180 mg, about 140 mg to about 175 mg, about 140 mg to about 170 mg, about 140 mg to about 165 mg, about 140 mg to about 160 mg, about 140 mg to about 155 mg, about 140 mg to about 150 mg, about 140 mg to about 145 mg, about 145 mg to about 200 mg, about 145 mg to about 195 mg, about 145 mg to about 190 mg, about 145 mg to about 185 mg, about 145 mg to about 180 mg, about 145 mg to about 175 mg, about 145 mg to about 170 mg, about 145 mg to about 165 mg, about 145 mg to about 160 mg, about 145 mg to about 155 mg, about 145 mg to about 150 mg, about 150 mg to about 200 mg, about 150 mg to about 195 mg, about 150 mg to about 190 mg, about 150 mg to about 185 mg, about 150 mg to about 180 mg, about 150 mg to about 175 mg, about 150 mg to about 170 mg, about 150 mg to about 165 mg, about 150 mg to about 160 mg, about 150 mg to about 155 mg, about 155 mg to about 200 mg, about 155 mg to about 195 mg, about 155 mg to about 190 mg, about 155 mg to about 185 mg, about 155 mg to about 180 mg, about 155 mg to about 175 mg, about 155 mg to about 170 mg, about 155 mg to about 165 mg, about 155 mg to about 160 mg, about 160 mg to about 200 mg, about 160 mg to about 195 mg, about 160 mg to about 190 mg, about 160 mg to about 185 mg, about 160 mg to about 180 mg, about 160 mg to about 175 mg, about 160 mg to about 170 mg, about 160 mg to about 165 mg, about 165 mg to about 200 mg, about 165 mg to about 195 mg, about 165 mg to about 190 mg, about 165 mg to about 185 mg, about 165 mg to about 180 mg, about 165 mg to about 175 mg, about 165 mg to about 170 mg, about 170 mg to about 200 mg, about 170 mg to about 195 mg, about 170 mg to about 190 mg, about 170 mg to about 185 mg, about 170 mg to about 180 mg, about 170 mg to about 175 mg, about 175 mg to about 200 mg, about 175 mg to about 195 mg, about 175 mg to about 190 mg, about 175 mg to about 185 mg, about 175 mg to about 180 mg, about 180 mg to about 200 mg, about 180 mg to about 195 mg, about 180 mg to about 190 mg, about 180 mg to about 185 mg, about 185 mg to about 200 mg, about 185 mg to about 195 mg, about 185 mg to about 190 mg, about 190 mg to about 200 mg, about 190 mg to about 195 mg, or about 195 mg to about 200 mg.

In some embodiments, the amount of the immune modulator that is administered is less than an amount that is effective when the immune modulator is delivered systemically.

In some embodiments, the amount of the immune modulator that is administered is an induction dose. In some embodiments, such induction dose is effective to induce remission of the TNF and cytokine storm and healing of acute inflammation and lesions. In some embodiments, the induction dose is administered once a day. In some embodiments of any of the methods described herein, the induction dose is administered once every two days. In some embodiments, the induction dose is administered once every three days. In some embodiments, the induction dose is administered once a week. In some embodiments, the induction dose is administered once a day, once every three days, or once a week, over a period of about 6-8 weeks.

In some embodiments, the method comprises administering (i) an amount of the immune modulator that is an induction dose, and (ii) an amount of the immune modulator that is a maintenance dose, in this order. In some embodiments, step (ii) is repeated one or more times. In some embodiments, the induction dose is equal to the maintenance dose. In some embodiments, the induction dose is greater than the maintenance dose. In some embodiments, the induction dose is five times greater than the maintenance dose. In some embodiments, the induction dose is two times greater than the maintenance dose.

In some embodiments, the induction dose is the same as or higher than an induction dose administered systemically for treatment of the same disorder to a subject. In more particular embodiments, the induction dose is the same as or higher than an induction dose administered systemically for treatment of the same disorder to a subject, and the maintenance dose is lower than the maintenance dose administered systemically for treatment of the same disorder to a subject. In some embodiments, the induction dose is the same as or higher than an induction dose administered systemically for treatment of the same disorder to a subject, and the maintenance dose is higher than the maintenance dose administered systemically for treatment of the same disorder to a subject.

In some embodiments an induction dose of the immune modulator and a maintenance dose of immune modulator are each administered to the subject by administering a pharmaceutical composition comprising a therapeutically effective amount of the immune modulator, wherein the pharmaceutical composition is a device. In some embodiments an induction dose of immune modulator is administered to the subject in a different manner from the maintenance dose. As an example, the induction dose may be administered systemically. In some embodiments, the induction dose may be administered other than orally. As an example, the induction dose may be administered rectally. As an example, the induction dose may be administered intravenously. As an example, the induction dose may be administered subcutaneously. In some embodiments, the induction dose may be administered by spray catheter.

In some embodiments, the concentration of the immune modulator delivered at the location in the gastrointestinal tract is 10%, 25%, 50%, 75%, 100%, 200%, 300%, 400%, 500%, 1000%, 2000% greater than the concentration of the immune modulator in plasma.

In some embodiments, the method provides a concentration of the immune modulator at a location that is a site of disease or proximate to a site of disease that is 2-100 times greater than at a location that is not a site of disease or proximate to a site of disease.

In some embodiments, the method comprises delivering the immune modulator at the location in the gastrointestinal tract as a single bolus.

In some embodiments, the method comprises delivering the immune modulator at the location in the gastrointestinal tract as more than one bolus.

In some embodiments, the method comprises delivering the immune modulator at the location in the gastrointestinal tract in a continuous manner.

In some embodiments, the method comprises delivering the immune modulator at the location in the gastrointestinal tract over a time period of 20 or more minutes.

In some embodiments, the method provides a concentration of the immune modulator in the plasma of the subject that is less than 10 µg/mL. In some embodiments, the method provides a concentration of the immune modulator in the plasma of the subject that is less than 3 µg/mL. In some embodiments, the method provides a concentration of the immune modulator in the plasma of the subject that is less than 1 µg/mL. In some embodiments, the method provides a concentration of the immune modulator in the plasma of the subject that is less than 0.3 µg/mL. In some embodiments, the method provides a concentration of the immune modulator in the plasma of the subject that is less than 0.1 µg/mL. In some embodiments, the method provides a concentration of the immune modulator in the plasma of the subject that is less than 0.01 µg/mL. In some embodiments, the values of the concentration of the immune modulator in the plasma of the subject provided herein refer to $C_{trough}$, that is, the lowest value of the concentration prior to administration of the next dose.

In some embodiments, the method provides a concentration of the immune modulator inhibitor in the plasma of the subject that is, e.g., about 1 ng/L to about 100 ng/mL, about 1 ng/mL to about 95 ng/mL, about 1 ng/mL to about 90 ng/mL, about 1 ng/mL to about 85 ng/mL, about 1 ng/mL to about 80 ng/mL, about 1 ng/mL to about 75 ng/mL, about 1 ng/mL to about 70 ng/mL, about 1 ng/mL to about 65 ng/mL, about 1 ng/mL to about 60 ng/mL, about 1 ng/ml to about 55 ng/mL, about 1 ng/mL to about 50 ng/mL, about 1 ng/mL to about 45 ng/mL, about 1 ng/mL to about 40 ng/mL, about 1 ng/mL to about 35 ng/mL, about 1 ng/mL to about 30 ng/mL, about 1 ng/mL to about 25 ng/mL, about 1 ng/mL to about 20 ng/mL, about 1 ng/ml to about 15 ng/mL, about 1 ng/mL to about 10 ng/mL, about 1 ng/mL to about 5 ng/mL, about 2 ng/L to about 100 ng/mL, about 2 ng/mL to about 95 ng/mL, about 2 ng/mL to about 90 ng/mL, about 2 ng/mL to about 85 ng/mL, about 2 ng/mL to about 80 ng/mL, about 2 ng/ml to about 75 ng/mL, about 2 ng/mL to about 70 ng/mL, about 2 ng/mL to about 65 ng/mL, about 2 ng/mL to about 60 ng/mL, about 2 ng/mL to about 55 ng/mL, about 2 ng/mL to about 50 ng/mL, about 2 ng/mL to about 45 ng/mL, about 2 ng/mL to about 40 ng/mL, about 2 ng/ml to about 35 ng/mL, about 2 ng/mL to about 30 ng/mL, about 2 ng/mL to about 25 ng/mL, about 2 ng/mL to about 20 ng/mL, about 2 ng/mL to about 15 ng/mL, about 2 ng/mL to about 10 ng/mL, about 2 ng/mL to about 5 ng/mL, about 5 ng/L to about 100 ng/mL, about 5 ng/mL to about 95 ng/mL, about 5 ng/mL to about 90 ng/mL, about 5 ng/mL to about 85 ng/mL, about 5 ng/mL to about 80 ng/mL, about 5 ng/mL to about 75 ng/mL, about 5 ng/mL to about 70 ng/mL, about 5 ng/mL to about 65 ng/mL, about 5 ng/mL to about 60 ng/mL, about 5 ng/ml to about 55 ng/mL, about 5 ng/mL to about 50 ng/mL, about 5 ng/mL to about 45 ng/mL, about 5 ng/mL to about 40 ng/mL, about 5 ng/mL to about 35 ng/ml., about 5 ng/mL to about 30 ng/mL, about 5 ng/mL to about 25 ng/mL, about 5 ng/mL to about 20 ng/mL, about 5 ng/ml to about 15 ng/mL, about 5 ng/mL to about 10 ng/mL, about 10 ng/L to about 100 ng/mL, about 10 ng/mL to about 95 ng/mL, about 10 ng/mL to about 90 ng/mL, about 10 ng/mL to about 85 ng/mL, about 10 ng/mL to about 80 ng/mL, about 10 ng/mL to about 75 ng/mL, about 10 ng/ml to about 70 ng/mL, about 10 ng/mL to about 65 ng/mL, about 10 ng/mL to about 60 ng/mL, about 10 ng/mL to about 55 ng/mL, about 10 ng/mL to about 50 ng/mL, about 10 ng/mL to about 45 ng/ml., about 10 ng/mL to about 40 ng/mL, about 10 ng/mL to about 35 ng/mL, about 10 ng/mL to about 30 ng/mL, about 10 ng/mL to about 25 ng/mL, about 10 ng/mL to about 20 ng/mL, about 10 ng/mL to about 15 ng/mL, about 15 ng/L to about 100 ng/mL, about 15 ng/ml to about 95 ng/mL, about 15 ng/mL to about 90 ng/mL, about 15 ng/mL to about 85 ng/mL, about 15 ng/mL to about 80 ng/mL, about 15 ng/mL to about 75 ng/mL, about 15 ng/mL to about 70 ng/mL, about 15 ng/mL to about 65 ng/mL, about 15 ng/mL to about 60 ng/mL, about 15 ng/mL to about 55 ng/mL, about 15 ng/mL to about 50 ng/mL, about 15 ng/mL to about 45 ng/mL, about 15 ng/mL to about 40 ng/mL, about 15 ng/mL to about 35 ng/mL, about 15 ng/ml to about 30 ng/mL, about 15 ng/mL to about 25 ng/mL, about 15 ng/mL to about 20 ng/mL, about 20 ng/L to about 100 ng/mL, about 20 ng/mL to about 95 ng/mL, about 20 ng/mL to about 90 ng/mL, about 20 ng/mL to about 85 ng/mL, about 20 ng/mL to about 80 ng/mL, about 20 ng/mL to about 75 ng/mL, about 20 ng/mL to about 70 ng/mL, about 20 ng/mL to about 65 ng/mL, about 20 ng/mL to about 60 ng/mL, about 20 ng/mL to about 55 ng/mL, about 20 ng/ml to about 50 ng/mL, about 20 ng/mL to about 45 ng/mL, about 20 ng/mL to about 40 ng/mL, about 20 ng/mL to about 35 ng/mL, about 20 ng/mL to about 30 ng/mL, about 20 ng/mL to about 25 ng/mL, about 25 ng/L to about 100 ng/mL, about 25 ng/mL to about 95 ng/mL, about ng/mL to about 90 ng/mL, about 25 ng/mL to about 85 ng/mL, about 25 ng/mL to about 80 ng/mL, about 25 ng/mL to about 75 ng/mL, about 25 ng/mL to about 70 ng/mL, about 25 ng/ml to about 65 ng/mL, about 25 ng/mL to about 60 ng/mL, about 25 ng/mL to about 55 ng/mL, about 25 ng/mL to about 50 ng/mL, about 25 ng/mL to about 45 ng/mL, about 25 ng/mL to about 40 ng/mL, about 25 ng/mL to about 35 ng/mL., about 25 ng/mL to about 30 ng/mL, about ng/L to about 100 ng/mL, about 30 ng/mL to about 95 ng/ml., about 30 ng/mL to about 90 ng/mL, about 30 ng/mL to about 85 ng/mL, about 30 ng/mL to about 80 ng/mL, about 30 ng/mL to about 75 ng/mL, about 30 ng/mL to about 70 ng/mL, about 30 ng/mL to about 65 ng/mL, about 30 ng/mL to about 60 ng/mL, about 30 ng/mL to about 55 ng/mL, about 30 ng/mL to about 50 ng/mL, about 30 ng/mL to about 45 ng/mL, about 30 ng/mL to about 40 ng/mL, about 30 ng/mL to about 35 ng/mL, about 35 ng/L to about 100 ng/mL, about 35 ng/mL to about 95 ng/mL, about 35 ng/mL to about 90 ng/mL, about 35 ng/mL to about 85 ng/mL, about 35 ng/ml to about 80 ng/mL, about 35 ng/mL to about 75 ng/mL, about 35 ng/mL to about 70 ng/mL, about 35 ng/mL to about 65 ng/mL, about 35 ng/mL to about 60 ng/mL, about 35 ng/mL to about 55 ng/mL, about 35 ng/mL to about 50 ng/mL, about 35 ng/mL to about 45 ng/mL, about 35 ng/mL to about 40 ng/mL, about 40 ng/L to about 100 ng/mL, about 40 ng/mL to about 95 ng/mL, about 40 ng/mL to about 90 ng/mL, about 40 ng/mL to about 85 ng/mL, about 40 ng/ml to about 80 ng/mL, about 40 ng/mL to about 75 ng/mL, about 40 ng/mL to about 70 ng/mL, about 40 ng/mL to about 65 ng/mL, about 40 ng/mL to about 60 ng/mL, about 40 ng/mL to about 55 ng/mL, about 40 ng/mL to about 50 ng/mL, about 40 ng/mL to about 45 ng/mL, about ng/L to about 100 ng/mL, about 45 ng/mL to about 95 ng/mL, about 45 ng/mL to about 90 ng/mL, about 45 ng/mL to about 85 ng/mL, about 45 ng/mL to about 80 ng/mL, about 45 ng/ml to about 75 ng/mL, about 45 ng/mL to about 70 ng/mL, about 45 ng/mL to about 65 ng/mL, about 45 ng/mL to about 60 ng/mL, about 45 ng/mL to about 55 ng/mL, about 45 ng/mL to about 50 ng/mL, about 50 ng/L to about 100 ng/mL, about 50 ng/mL to about 95 ng/mL, about ng/mL to about 90 ng/mL, about 50 ng/mL to about 85 ng/mL, about 50 ng/mL to about 80 ng/mL, about 50 ng/mL to about 75 ng/ml., about 50 ng/mL to about 70 ng/mL, about 50 ng/ml to about 65 ng/mL, about 50 ng/mL to about 60 ng/mL, about 50 ng/mL to about 55 ng/mL, about 55 ng/L to about 100 ng/mL, about 55 ng/mL to about 95 ng/mL, about 55 ng/mL to about 90 ng/mL, about 55 ng/mL to about 85 ng/mL, about 55 ng/mL to about 80 ng/mL, about ng/mL to about 75 ng/mL, about 55 ng/mL to about 70 ng/mL, about 55 ng/mL to about 65 ng/mL, about 55 ng/mL to about 60 ng/mL, about 60 ng/L to about 100 ng/mL, about 60 ng/ml to about 95 ng/mL, about 60 ng/mL to about 90 ng/mL, about 60 ng/mL to about 85 ng/mL, about 60 ng/mL to about 80 ng/mL, about 60 ng/mL to about 75 ng/mL, about 60 ng/mL to about 70 ng/mL, about 60 ng/mL to about 65 ng/mL, about 65 ng/L to about 100 ng/mL, about 65 ng/mL to about 95 ng/mL, about 65 ng/mL to about 90 ng/mL, about 65 ng/mL to about 85 ng/mL, about 65 ng/mL to about 80 ng/mL, about 65 ng/mL to about 75 ng/mL, about 65 ng/ml to about 70 ng/mL, about 70 ng/L to about 100 ng/mL, about 70 ng/mL to about 95 ng/mL, about 70 ng/mL to about 90 ng/mL, about 70 ng/mL to about 85 ng/ml., about 70 ng/mL to about 80 ng/ml., about 70 ng/mL to about 75 ng/ml., about 75 ng/L to about 100 ng/mL, about 75 ng/mL to about 95 ng/mL, about 75 ng/mL to about 90 ng/mL, about 75 ng/mL to about 85 ng/mL, about 75 ng/mL to about 80 ng/mL, about 80 ng/L to about 100 ng/mL, about 80 ng/ml to about 95 ng/mL, about 80 ng/mL to about 90 ng/mL, about 80 ng/mL to about 85 ng/mL, about 85 ng/L to about 100 ng/mL, about 85 ng/mL to about 95 ng/mL, about 85 ng/mL to about 90 ng/mL, about 90 ng/L to about 100 ng/mL, about 90 ng/mL to about 95 ng/mL, or about 95 ng/mL to about 100 ng/mL.

In some embodiments, the method provides a concentration $C_{max}$ of the immune modulator in the plasma of the subject that is less than 10 μg/mL. In some embodiments, the method provides a concentration $C_{max}$ of the immune modulator in the plasma of the subject that is less than 3 μg/mL. In some embodiments, the method provides a concentration $C_{max}$ of the immune modulator in the plasma of the subject that is less than 1 μg/mL. In some embodiments, the method provides a concentration $C_{max}$ of the immune modulator in the plasma of the subject that is less than 0.3 μg/mL. In some embodiments, the method provides a concentration $C_{max}$ of the immune modulator in the plasma of the subject that is less than 0.1 μg/mL. In some embodiments, the method provides a concentration $C_{max}$ of the immune modulator in the plasma of the subject that is less than 0.01 μg/mL.

In some embodiments, the method does not comprise delivering an immune modulator rectally to the subject.

In some embodiments, the method does not comprise delivering an immune modulator via an enema to the subject.

In some embodiments, the method does not comprise delivering an immune modulator via suppository to the subject.

In some embodiments, the method does not comprise delivering an immune modulator via instillation to the rectum of a subject.

In some embodiments, the methods disclosed herein comprise producing a therapeutically effective degradation product of the immune modulator in the gastrointestinal tract. In some embodiments, the degradation product is a therapeutic antibody fragment. In some embodiments, a therapeutically effective amount of the degradation product is produced.

In some embodiments, the methods comprising administering the immune modulator in the manner disclosed herein disclosed herein result in a reduced immunosuppressive properties relative to methods of administration of the immune modulator systemically.

In some embodiments, the methods comprising administering the immune modulator in the manner disclosed herein disclosed herein result in reduced immunogenicity relative to methods of administration of the immune modulator systemically.

Patient Condition, Diagnosis and Treatment

In some embodiments herein, the method of treating an inflammatory disease or disorder that arises in a tissue that originates from the endoderm that comprises releasing an immune modulator at a location in the gastrointestinal tract that is proximate to an intended site of release comprises one or more of the following:
  a) identifying a subject having an inflammatory disease or condition that arises in tissue originating from the endoderm;
  b) determining the severity of the disease;
  c) evaluating the subject for suitability to treatment, for example by determining the patency of the subject's GI tract, or if the patients has strictures or fistulae;
  d) administering an induction dose or a maintenance dose of an immune modulator; and
  e) monitoring the progress of the disease one or more times, for example over a period of about 1-14 weeks, such as about 6-8 weeks following administration of the immune modulator, including at the 6-8 week time point, or over a period of about 52 weeks following administration of the immune modulator, including at the 52 week time point.

As used herein, an induction dose is a dose of drug that may be administered, for example, at the beginning of a course of treatment, and that is higher than the maintenance dose administered during treatment. An induction dose may also be administered during treatment, for example if the condition of the patients becomes worse.

As used herein, a maintenance dose is a dose of drug that is provided on a repetitive basis, for example at regular dosing intervals.

In some embodiments the immune modulator is released from an ingestible device.

In some embodiments herein, the method of treating an inflammatory disease or condition that arises in a tissue originating from the endoderm comprises releasing an immune modulator at a location in the gastrointestinal tract that is proximate to the intended site of release comprises a) hereinabove.

In some embodiments herein, the method of treating an inflammatory disease or condition that arises in a tissue originating from the endoderm comprises releasing an immune modulator at a location in the gastrointestinal tract that is proximate to the intended site of release comprises b) hereinabove.

In some embodiments herein, the method of treating an inflammatory disease or condition that arises in a tissue originating from the endoderm comprises releasing an immune modulator at a location in the gastrointestinal tract that is proximate to the intended site of release comprises c) hereinabove.

In some embodiments herein, the method of treating an inflammatory disease or condition that arises in a tissue originating from the endoderm comprises releasing an immune modulator at a location in the gastrointestinal tract that is proximate to the intended site of release comprises d) hereinabove.

In some embodiments herein, the method of treating an inflammatory disease or condition that arises in a tissue originating from the endoderm comprises releasing an immune modulator at a location in the gastrointestinal tract that is proximate to the intended site of release comprises e) hereinabove.

In some embodiments herein, the method of treating an inflammatory disease or condition that arises in a tissue originating from the endoderm comprises releasing an immune modulator at a location in the gastrointestinal tract that is proximate to the intended site of release comprises a) and b) hereinabove. In some embodiments herein, the method of treating an inflammatory disease or condition that arises in a tissue originating from the endoderm comprises releasing an immune modulator at a location in the gastrointestinal tract that is proximate to the intended site of release comprises a) and c) hereinabove. In some embodiments herein, the method of treating an inflammatory disease or condition that arises in a tissue originating from the endoderm comprises releasing an immune modulator at a location in the gastrointestinal tract that is proximate to the intended site of release comprises a) and d) hereinabove. In some embodiments herein, the method of treating an inflammatory disease or condition that arises in a tissue originating from the endoderm comprises releasing an immune modulator at a location in the gastrointestinal tract that is proximate to the intended site of release comprises a) and e) hereinabove.

In some embodiments herein, the method of treating an inflammatory disease or condition that arises in a tissue originating from the endoderm comprises releasing an immune modulator at a location in the gastrointestinal tract that is proximate to the intended site of release comprises b) and c) hereinabove. In some embodiments herein, the method of treating an inflammatory disease or condition that arises in a tissue originating from the endoderm comprises releasing an immune modulator at a location in the gastrointestinal tract that is proximate to the intended site of release comprises b) and d) hereinabove. In some embodiments herein, the method of treating an inflammatory disease or condition that arises in a tissue originating from the endoderm comprises releasing an immune modulator at a location in the gastrointestinal tract that is proximate to the intended site of release comprises b) and e) hereinabove.

In some embodiments herein, the method of treating an inflammatory disease or condition that arises in a tissue originating from the endoderm comprises releasing an immune modulator at a location in the gastrointestinal tract that is proximate to the intended site of release comprises c) and d) hereinabove. In some embodiments herein, the method of treating an inflammatory disease or condition that arises in a tissue originating from the endoderm comprises releasing an immune modulator at a location in the gastrointestinal tract that is proximate to the intended site of release comprises c) and e) hereinabove. In some embodiments herein, the method of treating an inflammatory disease or condition that arises in a tissue originating from the endoderm comprises releasing an immune modulator at a location in the gastrointestinal tract that is proximate to the intended site of release comprises d) and e) hereinabove.

In some embodiments, one or more steps a) to e) herein comprise endoscopy of the gastrointestinal tract. In some embodiments, one or more steps a) to e) herein comprise colonoscopy of the gastrointestinal tract. In some embodiments, one or more steps a) to e) herein is performed one or more times. In some embodiments, such one or more of such one or more steps a) to e) is performed after releasing the immune modulator at the location in the gastrointestinal tract that is proximate to the intended site of release.

In some embodiments, the method comprises administering one or more maintenance doses following administration of the induction dose. In some embodiments an induction dose of an immune modulator and a maintenance dose of an immune modulator are each administered to the subject by administering a pharmaceutical composition comprising a therapeutically effective amount of the immune modulator. In some embodiments an induction dose of an immune modulator is administered to the subject in a different manner from the maintenance dose. As an example, the maintenance dose may be administered systemically, while the maintenance dose is administered locally using a device. In one embodiment, a maintenance dose is administered systemically, and an induction dose is administered using a device every 1, 2, 3, 4, 5, 6, 7, 10, 15, 20, 25, 30, 35, 40, or 45 days. In another embodiment, a maintenance dose is administered systemically, and an induction dose is administered when a disease flare up is detected or suspected.

In some embodiments, the induction dose is a dose of the immune modulator is administered in an ingestible device as disclosed herein. In some embodiments, the maintenance dose is a dose of the immune modulator administered in an ingestible device as disclosed herein.

In some embodiments, the induction dose is a dose of the immune modulator administered in an ingestible device as disclosed herein. In some embodiments, the maintenance dose is a dose of the immune modulator delivered systemically, such as orally with a tablet or capsule, or subcutaneously, or intravenously.

In some embodiments, the induction dose is a dose of the immune modulator delivered systemically, such as orally with a tablet or capsule, or subcutaneously, or intravenously. In some embodiments, the maintenance dose is a dose of the immune modulator administered in an ingestible device as disclosed herein.

In some embodiments, the induction dose is a dose of the immune modulator administered in an ingestible device as disclosed herein. In some embodiments, the maintenance dose is a dose of a second agent as disclosed herein delivered systemically, such as orally with a tablet or capsule, or subcutaneously, or intravenously.

In some embodiments, the induction dose is a dose of a second agent as disclosed herein delivered systemically, such as orally with a tablet or capsule, or subcutaneously, or intravenously. In some embodiments, the maintenance dose is a dose of the immune modulator administered in an ingestible device as disclosed herein.

In one embodiment of the methods provided herein, the patient is not previously treated with an immune modulator.

In some embodiments, the method comprises identifying the intended site of release substantially at the same time as releasing the immune modulator.

In some embodiments, the method comprises monitoring the progress of the disease. In some embodiments, the method comprises administering an immune modulator with a spray catheter. For example, administering an immune modulator with a spray catheter may be performed in step (e) hereinabove.

In some embodiments, the method does not comprise administering an immune modulator with a spray catheter.

In some embodiments, data obtained from cell culture assays and animal studies can be used in formulating an appropriate dosage of any given immune modulator. The effectiveness and dosing of any immune modulator can be determined by a health care professional or veterinary professional using methods known in the art, as well as by the observation of one or more disease symptoms in a subject (e.g., a human). Certain factors may influence the dosage and timing required to effectively treat a subject (e.g., the severity of the disease or disorder, previous treatments, the general health and/or age of the subject, and the presence of other diseases).

In some embodiments, the subject is further administered an additional therapeutic agent (e.g., any of the additional therapeutic agents described herein). The additional therapeutic agent can be administered to the subject at substantially the same time as the immune modulator or pharmaceutical composition comprising it is administered and/or at one or more other time points. In some embodiments, the additional therapeutic agent is formulated together with the immune modulator (e.g., using any of the examples of formulations described herein).

In some embodiments, the subject is administered a dose of the immune modulator at least once a month (e.g., at least twice a month, at least three times a month, at least four times a month, at least once a week, at least twice a week, three times a week, once a day, or twice a day). The immune modulator may be administered to a subject chronically. Chronic treatments include any form of repeated administration for an extended period of time, such as repeated administrations for one or more months, between a month and a year, one or more years, more than five years, more than 10 years, more than 15 years, more than 20 years, more than 25 years, more than 30 years, more than 35 years, more than 40 years, more than 45 years, or longer. Alternatively or in addition, chronic treatments may be administered. Chronic treatments can involve regular administrations, for example one or more times a day, one or more times a week, or one or more times a month. For example, chronic treatment can include administration (e.g., intravenous administration) about every two weeks (e.g., between about every 10 to 18 days).

A suitable dose may be the amount that is the lowest dose effective to produce a desired therapeutic effect. Such an effective dose will generally depend upon the factors described herein. If desired, an effective daily dose of immune modulator can be administered as two, three, four, five, or six or more sub-doses administered separately at appropriate intervals throughout the day, optionally, in unit dosage forms.

In some examples, administration of an immune modulator using any of the compositions or devices described herein can result in the onset of treatment (e.g., a reduction in the number, severity, or duration of one or more symptoms and/or markers of any of the inflammatory diseases or conditions that arise in tissue originating from the endoderm described herein) or drug-target engagement in a subject within a time period of about 10 minutes to about 10 hours, about 10 minutes to about 9 hours, about 10 minutes to about 8 hours, about 10 minutes to about 7 hours, about 10 minutes to about 6 hours, about 10 minutes to about 5 hours, about 10 minutes to about 4.5 hours, about 10 minutes to about 4 hours, about 10 minutes to about 3.5 hours, about 10 minutes to about 3 hours, about 10 minutes to about 2.5 hours, about 10 minutes to about 2 hours, about 10 minutes to about 1.5 hours, about 10 minutes to about 1 hour, about 10 minutes to about 55 minutes, about 10 minutes to about 50 minutes, about 10 minutes to about 45 minutes, about 10 minutes to about 40 minutes, about 10 minutes to about 35 minutes, about 10 minutes to about 30 minutes, about 10 minutes to about 25 minutes, about 10 minutes to about 20 minutes, about 10 minutes to about 15 minutes, about 15 minutes to about 10 hours, about 15 minutes to about 9 hours, about 15 minutes to about 8 hours, about 15 minutes to about 7 hours, about 15 minutes to about 6 hours, about 15 minutes to about 5 hours, about 15 minutes to about 4.5 hours, about 15 minutes to about 4 hours, about 15 minutes to about 3.5 hours, about 15 minutes to about 3 hours, about 15 minutes to about 2.5 hours, about 15 minutes to about 2 hours, about 15 minutes to about 1.5 hours, about 15 minutes to about 1 hour, about 15 minutes to about 55 minutes, about 15 minutes to about 50 minutes, about 15 minutes to about 45 minutes, about 15 minutes to about 40 minutes, about 15 minutes to about 35 minutes, about 15 minutes to about 30 minutes, about 15 minutes to about 25 minutes, about 15 minutes to about 20 minutes, about 20 minutes to about 10 hours, about 20 minutes to about 9 hours, about 20 minutes to about 8 hours, about 20 minutes to about 7 hours, about 20 minutes to about 6 hours, about 20 minutes to about 5 hours, about 20 minutes to about 4.5 hours, about 20 minutes to about 4 hours, about 20 minutes to about 3.5 hours, about 20 minutes to about 3 hours, about 20 minutes to about 2.5 hours, about 20 minutes to about 2 hours, about 20 minutes to about 1.5 hours, about 20 minutes to about 1 hour, about 20 minutes to about 55 minutes, about 20 minutes to about 50 minutes, about 20 minutes to about 45 minutes, about 20 minutes to about 40 minutes, about 20 minutes to about 35 minutes, about 20 minutes to about 30 minutes, about 20 minutes to about 25 minutes, about 25 minutes to about 10 hours, about 25 minutes to about 9 hours, about 25 minutes to about 8 hours, about 25 minutes to about 7 hours, about 25 minutes to about 6 hours, about 25 minutes to about 5 hours, about 25 minutes to about 4.5 hours, about 25 minutes to about 4 hours, about 25 minutes to about 3.5 hours, about 25 minutes to about 3 hours, about 25 minutes to about 2.5 hours, about 25 minutes to about 2 hours, about 25 minutes to about 1.5 hours, about 25 minutes to about 1 hour, about 25 minutes to about 55 minutes, about 25 minutes to about 50 minutes, about 25 minutes to about 45 minutes, about 25 minutes to about 40 minutes, about 25 minutes to about 35 minutes, about 25 minutes to about 30 minutes, about 30 minutes to about 10 hours, about 30 minutes to about 9 hours, about 30 minutes to about 8 hours, about 30 minutes to about 7 hours, about 30 minutes to about 6 hours, about 30 minutes to about 5 hours, about 30 minutes to about 4.5 hours, about 30 minutes to about 4 hours, about 30 minutes to about 3.5 hours, about 30 minutes to about 3 hours, about 30 minutes to about 2.5 hours, about 30 minutes to about 2 hours, about 30 minutes to about 1.5 hours, about 30 minutes to about 1 hour, about 30 minutes to about 55 minutes, about 30 minutes to about 50 minutes, about 30 minutes to about 45 minutes, about 30 minutes to about 40 minutes, about 30 minutes to about 35 minutes, about 35 minutes to about 10 hours, about 35 minutes to about 9 hours, about 35 minutes to about 8 hours, about 35 minutes to about 7 hours, about 35 minutes to about 6 hours, about 35 minutes to about 5 hours, about 35 minutes to about 4.5 hours, about 35 minutes to about 4 hours, about 35 minutes to about 3.5 hours, about 35 minutes to about 3 hours, about 35 minutes to about 2.5 hours, about 35 minutes to about 2 hours, about 35 minutes to about 1.5 hours, about 35 minutes to about 1 hour, about 35 minutes to about 55 minutes, about 35 minutes to about 50 minutes, about 35 minutes to about 45 minutes, about 35 minutes to about 40 minutes, about 40 minutes to about 10 hours, about 40 minutes to about 9 hours, about 40 minutes to about 8 hours, about 40 minutes to about 7 hours, about 40 minutes to about 6 hours, about 40 minutes to about 5 hours, about 40 minutes to about 4.5 hours, about 40 minutes to about 4 hours, about 40 minutes to about 3.5 hours, about 40 minutes to about 3 hours, about 40 minutes to about 2.5 hours, about 40 minutes to about 2 hours, about 40 minutes to about 1.5 hours, about 40 minutes to about 1 hour, about 40 minutes to about 55 minutes, about 40 minutes to about 50 minutes, about 40 minutes to about 45 minutes, about 45 minutes to about 10 hours, about 45 minutes to about 9 hours, about 45 minutes to about 8 hours, about 45 minutes to about 7 hours, about 45 minutes to about 6 hours, about 45 minutes to about 5 hours, about 45 minutes to about 4.5 hours, about 45 minutes to about 4 hours, about 45 minutes to about 3.5 hours, about 45 minutes to about 3 hours, about 45 minutes to about 2.5 hours, about 45 minutes to about 2 hours, about 45 minutes to about 1.5 hours, about 45 minutes to about 1 hour, about 45 minutes to about 55 minutes, about 45 minutes to about 50 minutes, about 50 minutes to about 10 hours, about 50 minutes to about 9 hours, about 50 minutes to about 8 hours, about 50 minutes to about 7 hours, about 50 minutes to about 6 hours, about 50 minutes to about 5 hours, about 50 minutes to about 4.5 hours, about 50 minutes to about 4 hours, about 50 minutes to about 3.5 hours, about 50 minutes to about 3 hours, about 50 minutes to about 2.5 hours, about 50 minutes to about 2 hours, about 50 minutes to about 1.5 hours, about 50 minutes to about 1 hour, about 50 minutes to about 55 minutes, about 55 minutes to about 10 hours, about 55 minutes to about 9 hours, about 55 minutes to about 8 hours, about 55 minutes to about 7 hours, about 55 minutes to about 6 hours, about 55 minutes to about 5 hours, about 55 minutes to about 4.5 hours, about 55 minutes to about 4 hours, about 55 minutes to about 3.5 hours, about 55 minutes to about 3 hours, about 55 minutes to about 2.5 hours, about 55 minutes to about 2 hours, about 55 minutes to about 1.5 hours, about 55 minutes to about 1 hour, about 1 hour to about 10 hours, about 1 hour to about 9 hours, about 1 hour to about 8 hours, about 1 hour to about 7 hours, about 1 hour to about 6 hours, about 1 hour to about 5 hours, about 1 hour to about 4.5 hours, about 1 hour to about 4 hours, about 1 hour to about 3.5 hours, about 1 hour to about 3 hours, about 1 hour to about 2.5 hours, about 1 hour to about 2 hours, about 1 hour to about 1.5 hours, about 1.5 hours to about 10 hours, about 1.5 hours to about 9 hours, about 1.5 hours to about 8 hours, about 1.5 hours to about 7 hours, about 1.5 hours to about 6 hours, about 1.5 hours to about 5 hours, about 1.5 hours to about 4.5 hours, about 1.5 hours to about 4 hours, about 1.5 hours to about 3.5 hours, about 1.5 hours to about 3 hours, about 1.5 hours to about 2.5 hours, about 1.5 hours to about 2 hours, about 2 hours to about 10 hours, about 2 hours to about 9 hours, about 2 hours to about 8 hours, about 2 hours to about 7 hours, about 2 hours to about 6 hours, about 2 hours to about 5 hours, about 2 hours to about 4.5 hours, about 2 hours to about 4 hours, about 2 hours to about 3.5 hours, about 2 hours to about 3 hours, about 2 hours to about 2.5 hours, about 2.5 hours to about 10 hours, about 2.5 hours to about 9 hours, about 2.5 hours to about 8 hours, about 2.5 hours to about 7 hours, about 2.5 hours to about 6 hours, about 2.5 hours to about 5 hours, about 2.5 hours to about 4.5 hours, about 2.5 hours to about 4 hours, about 2.5 hours to about 3.5 hours, about 2.5 hours to about 3 hours, about 3 hours to about 10 hours, about 3 hours to about 9 hours, about 3 hours to about 8 hours, about 3 hours to about 7 hours, about 3 hours to about 6 hours, about 3 hours to about 5 hours, about 3 hours to about 4.5 hours, about 3 hours to about 4 hours, about 3 hours to about 3.5 hours, about 3.5 hours to about 10 hours, about 3.5 hours to about 9 hours, about 3.5 hours to about 8 hours, about 3.5 hours to about 7 hours, about 3.5 hours to about 6 hours, about 3.5 hours to about 5 hours, about 3.5 hours to about 4.5 hours, about 3.5 hours to about 4 hours, about 4 hours to about 10 hours, about 4 hours to about 9 hours, about 4 hours to about 8 hours, about 4 hours to about 7 hours, about 4 hours to about 6 hours, about 4 hours to about 5 hours, about 4 hours to about 4.5 hours, about 4.5 hours to about 10 hours, about 4.5 hours to about 9 hours, about 4.5 hours to about 8 hours, about 4.5 hours to about 7 hours, about 4.5 hours to about 6 hours, about 4.5 hours to about 5 hours, about 5 hours to about 10 hours, about 5 hours to about 9 hours, about 5 hours to about 8 hours, about 5 hours to about 7 hours, about 5 hours to about 6 hours, about 6 hours to about 10 hours, about 6 hours to about 9 hours, about 6 hours to about 8 hours, about 6 hours to about 7 hours, about 7 hours to about 10 hours, about 7 hours to about 9 hours, about 7 hours to about 8 hours, about 8 hours to about 10 hours, about 8 hours to about 9 hours, or about 9 hours to about 10 hours of administration of a dose of an immune modulator using any of the devices or compositions described herein. Drug-target engagement may be determined, for example, as disclosed in Simon G M, Niphakis M J, Cravatt B F, *Nature chemical biology.* 2013; 9 (4): 200-205, incorporated by reference herein in its entirety.

In some embodiments, administration of an immune modulator using any of the devices or compositions described herein can provide for treatment (e.g., a reduction in the number, severity, and/or duration of one or more symptoms and/or markers of any of the inflammatory diseases or conditions that arise in a tissue originating from the endoderm in a subject) for a time period of between about 1 hour to about 30 days, about 1 hour to about 28 days, about 1 hour to about 26 days, about 1 hour to about 24 days, about 1 hour to about 22 days, about 1 hour to about 20 days, about 1 hour to about 18 days, about 1 hour to about 16 days, about 1 hour to about 14 days, about 1 hour to about 12 days, about 1 hour to about 10 days, about 1 hour to about 8 days, about 1 hour to about 6 days, about 1 hour to about 5 days, about 1 hour to about 4 days, about 1 hour to about 3 days, about 1 hour to about 2 days, about 1 hour to about 1 day, about 1 hour to about 12 hours, about 1 hour to about 6 hours, about 1 hour to about 3 hours, about 3 hours to about 30 days, about 3 hours to about 28 days, about 3 hours to about 26 days, about 3 hours to about 24 days, about 3 hours to about 22 days, about 3 hours to about 20 days, about 3 hours to about 18 days, about 3 hours to about 16 days, about 3 hours to about 14 days, about 3 hours to about 12 days, about 3 hours to about 10 days, about 3 hours to about 8 days, about 3 hours to about 6 days, about 3 hours to about 5 days, about 3 hours to about 4 days, about 3 hours to about 3 days, about 3 hours to about 2 days, about 3 hours to about 1 day, about 3 hours to about 12 hours, about 3 hours to about 6 hours, about 6 hours to about 30 days, about 6 hours to about 28 days, about 6 hours to about 26 days, about 6 hours to about 24 days, about 6 hours to about 22 days, about 6 hours to about 20 days, about 6 hours to about 18 days, about 6 hours to about 16 days, about 6 hours to about 14 days, about 6 hours to about 12 days, about 6 hours to about 10 days, about 6 hours to about 8 days, about 6 hours to about 6 days, about 6 hours to about 5 days, about 6 hours to about 4 days, about 6 hours to about 3 days, about 6 hours to about 2 days, about 6 hours to about 1 day, about 6 hours to about 12 hours, about 12 hours to about 30 days, about 12 hours to about 28 days, about 12 hours to about 26 days, about 12 hours to about 24 days, about 12 hours to about 22 days, about 12 hours to about 20 days, about 12 hours to about 18 days, about 12 hours to about 16 days, about 12 hours to about 14 days, about 12 hours to about 12 days, about 12 hours to about 10 days, about 12 hours to about 8 days, about 12 hours to about 6 days, about 12 hours to about 5 days, about 12 hours to about 4 days, about 12 hours to about 3 days, about 12 hours to about 2 days, about 12 hours to about 1 day, about 1 day to about 30 days, about 1 day to about 28 days, about 1 day to about 26 days, about 1 day to about 24 days, about 1 day to about 22 days, about 1 day to about 20 days, about 1 day to about 18 days, about 1 day to about 16 days, about 1 day to about 14 days, about 1 day to about 12 days, about 1 day to about 10 days, about 1 day to about 8 days, about 1 day to about 6 days, about 1 day to about 5 days, about 1 day to about 4 days, about 1 day to about 3 days, about 1 day to about 2 days, about 2 days to about 30 days, about 2 days to about 28 days, about 2 days to about 26 days, about 2 days to about 24 days, about 2 days to about 22 days, about 2 days to about 20 days, about 2 days to about 18 days, about 2 days to about 16 days, about 2 days to about 14 days, about 2 days to about 12 days, about 2 days to about 10 days, about 2 days to about 8 days, about 2 days to about 6 days, about 2 days to about 5 days, about 2 days to about 4 days, about 2 days to about 3 days, about 3 days to about 30 days, about 3 days to about 28 days, about 3 days to about 26 days, about 3 days to about 24 days, about 3 days to about 22 days, about 3 days to about 20 days, about 3 days to about 18 days, about 3 days to about 16 days, about 3 days to about 14 days, about 3 days to about 12 days, about 3 days to about 10 days, about 3 days to about 8 days, about 3 days to about 6 days, about 3 days to about 5 days, about 3 days to about 4 days, about 4 days to about 30 days, about 4 days to about 28 days, about 4 days to about 26 days, about 4 days to about 24 days, about 4 days to about 22 days, about 4 days to about 20 days, about 4 days to about 18 days, about 4 days to about 16 days, about 4 days to about 14 days, about 4 days to about 12 days, about 4 days to about 10 days, about 4 days to about 8 days, about 4 days to about 6 days, about 4 days to about 5 days, about 5 days to about 30 days, about 5 days to about 28 days, about 5 days to about 26 days, about 5 days to about 24 days, about 5 days to about 22 days, about 5 days to about 20 days, about 5 days to about 18 days, about 5 days to about 16 days, about 5 days to about 14 days, about 5 days to about 12 days, about 5 days to about 10 days, about 5 days to about 8 days, about 5 days to about 6 days, about 6 days to about 30 days, about 6 days to about 28 days, about 6 days to about 26 days, about 6 days to about 24 days, about 6 days to about 22 days, about 6 days to about 20 days, about 6 days to about 18 days, about 6 days to about 16 days, about 6 days to about 14 days, about 6 days to about 12 days, about 6 days to about 10 days, about 6 days to about 8 days, about 8 days to about 30 days, about 8 days to about 28 days, about 8 days to about 26 days, about 8 days to about 24 days, about 8 days to about 22 days, about 8 days to about 20 days, about 8 days to about 18 days, about 8 days to about 16 days, about 8 days to about 14 days, about 8 days to about 12 days, about 8 days to about 10 days, about 10 days to about 30 days, about 10 days to about 28 days, about 10 days to about 26 days, about 10 days to about 24 days, about 10 days to about 22 days, about 10 days to about 20 days, about 10 days to about 18 days, about 10 days to about 16 days, about 10 days to about 14 days, about 10 days to about 12 days, about 12 days to about 30 days, about 12 days to about 28 days, about 12 days to about 26 days, about 12 days to about 24 days, about 12 days to about 22 days, about 12 days to about 20 days, about 12 days to about 18 days, about 12 days to about 16 days, about 12 days to about 14 days, about 14 days to about 30 days, about 14 days to about 28 days, about 14 days to about 26 days, about 14 days to about 24 days, about 14 days to about 22 days, about 14 days to about 20 days, about 14 days to about 18 days, about 14 days to about 16 days, about 16 days to about 30 days, about 16 days to about 28 days, about 16 days to about 26 days, about 16 days to about 24 days, about 16 days to about 22 days, about 16 days to about 20 days, about 16 days to about 18 days, about 18 days to about 30 days, about 18 days to about 28 days, about 18 days to about 26 days, about 18 days to about 24 days, about 18 days to about 22 days, about 18 days to about 20 days, about 20 days to about 30 days, about 20 days to about 28 days, about 20 days to about 26 days, about 20 days to about 24 days, about 20 days to about 22 days, about 22 days to about 30 days, about 22 days to about 28 days, about 22 days to about 26 days, about 22 days to about 24 days, about 24 days to about 30 days, about 24 days to about 28 days, about 24 days to about 26 days, about 26 days to about 30 days, about 26 days to about 28 days, or about 28 days to about 30 days in a subject following first administration of an immune modulator using any of the compositions or devices described herein. Non-limiting examples of symptoms and/or markers of a disease described herein are described below.

For example, treatment can result in a decrease (e.g., about 1% to about 99% decrease, about 1% to about 95% decrease, about 1% to about 90% decrease, about 1% to about 85% decrease, about 1% to about 80% decrease, about 1% to about 75% decrease, about 1% to about 70% decrease, about 1% to about 65% decrease, about 1% to about 60% decrease, about 1% to about 55% decrease, about 1% to about 50% decrease, about 1% to about 45% decrease, about 1% to about 40% decrease, about 1% to about 35% decrease, about 1% to about 30% decrease, about 1% to about 25% decrease, about 1% to about 20% decrease, about 1% to about 15% decrease, about 1% to about 10% decrease, about 1% to about 5% decrease, about 5% to about 99% decrease, about 5% to about 95% decrease, about 5% to about 90% decrease, about 5% to about 85% decrease, about 5% to about 80% decrease, about 5% to about 75% decrease, about 5% to about 70% decrease, about 5% to about 65% decrease, about 5% to about 60% decrease, about 5% to about 55% decrease, about 5% to about 50% decrease, about 5% to about 45% decrease, about 5% to about 40% decrease, about 5% to about 35% decrease, about 5% to about 30% decrease, about 5% to about 25% decrease, about 5% to about 20% decrease, about 5% to about 15% decrease, about 5% to about 10% decrease, about 10% to about 99% decrease, about 10% to about 95% decrease, about 10% to about 90% decrease, about 10% to about 85% decrease, about 10% to about 80% decrease, about 10% to about 75% decrease, about 10% to about 70% decrease, about 10% to about 65% decrease, about 10% to about 60% decrease, about 10% to about 55% decrease, about 10% to about 50% decrease, about 10% to about 45% decrease, about 10% to about 40% decrease, about 10% to about 35% decrease, about 10% to about 30% decrease, about 10% to about 25% decrease, about 10% to about 20% decrease, about 10% to about 15% decrease, about 15% to about 99% decrease, about 15% to about 95% decrease, about 15% to about 90% decrease, about 15% to about 85% decrease, about 15% to about 80% decrease, about 15% to about 75% decrease, about 15% to about 70% decrease, about 15% to about 65% decrease, about 15% to about 60% decrease, about 15% to about 55% decrease, about 15% to about 50% decrease, about 15% to about 45% decrease, about 15% to about 40% decrease, about 15% to about 35% decrease, about 15% to about 30% decrease, about 15% to about 25% decrease, about 15% to about 20% decrease, about 20% to about 99% decrease, about 20% to about 95% decrease, about 20% to about 90% decrease, about 20% to about 85% decrease, about 20% to about 80% decrease, about 20% to about 75% decrease, about 20% to about 70% decrease, about 20% to about 65% decrease, about 20% to about 60% decrease, about 20% to about 55% decrease, about 20% to about 50% decrease, about 20% to about 45% decrease, about 20% to about 40% decrease, about 20% to about 35% decrease, about 20% to about 30% decrease, about 20% to about 25% decrease, about 25% to about 99% decrease, about 25% to about 95% decrease, about 25% to about 90% decrease, about 25% to about 85% decrease, about 25% to about 80% decrease, about 25% to about 75% decrease, about 25% to about 70% decrease, about 25% to about 65% decrease, about 25% to about 60% decrease, about 25% to about 55% decrease, about 25% to about 50% decrease, about 25% to about 45% decrease, about 25% to about 40% decrease, about 25% to about 35% decrease, about 25% to about 30% decrease, about 30% to about 99% decrease, about 30% to about 95% decrease, about 30% to about 90% decrease, about 30% to about 85% decrease, about 30% to about 80% decrease, about 30% to about 75% decrease, about 30% to about 70% decrease, about 30% to about 65% decrease, about 30% to about 60% decrease, about 30% to about 55% decrease, about 30% to about 50% decrease, about 30% to about 45% decrease, about 30% to about 40% decrease, about 30% to about 35% decrease, about 35% to about 99% decrease, about 35% to about 95% decrease, about 35% to about 90% decrease, about 35% to about 85% decrease, about 35% to about 80% decrease, about 35% to about 75% decrease, about 35% to about 70% decrease, about 35% to about 65% decrease, about 35% to about 60% decrease, about 35% to about 55% decrease, about 35% to about 50% decrease, about 35% to about 45% decrease, about 35% to about 40% decrease, about 40% to about 99% decrease, about 40% to about 95% decrease, about 40% to about 90% decrease, about 40% to about 85% decrease, about 40% to about 80% decrease, about 40% to about 75% decrease, about 40% to about 70% decrease, about 40% to about 65% decrease, about 40% to about 60% decrease, about 40% to about 55% decrease, about 40% to about 50% decrease, about 40% to about 45% decrease, about 45% to about 99% decrease, about 45% to about 95% decrease, about 45% to about 90% decrease, about 45% to about 85% decrease, about 45% to about 80% decrease, about 45% to about 75% decrease, about 45% to about 70% decrease, about 45% to about 65% decrease, about 45% to about 60% decrease, about 45% to about 55% decrease, about 45% to about 50% decrease, about 50% to about 99% decrease, about 50% to about 95% decrease, about 50% to about 90% decrease, about 50% to about 85% decrease, about 50% to about 80% decrease, about 50% to about 75% decrease, about 50% to about 70% decrease, about 50% to about 65% decrease, about 50% to about 60% decrease, about 50% to about 55% decrease, about 55% to about 99% decrease, about 55% to about 95% decrease, about 55% to about 90% decrease, about 55% to about 85% decrease, about 55% to about 80% decrease, about 55% to about 75% decrease, about 55% to about 70% decrease, about 55% to about 65% decrease, about 55% to about 60% decrease, about 60% to about 99% decrease, about 60% to about 95% decrease, about 60% to about 90% decrease, about 60% to about 85% decrease, about 60% to about 80% decrease, about 60% to about 75% decrease, about 60% to about 70% decrease, about 60% to about 65% decrease, about 65% to about 99% decrease, about 65% to about 95% decrease, about 65% to about 90% decrease, about 65% to about 85% decrease, about 65% to about 80% decrease, about 65% to about 75% decrease, about 65% to about 70% decrease, about 70% to about 99% decrease, about 70% to about 95% decrease, about 70% to about 90% decrease, about 70% to about 85% decrease, about 70% to about 80% decrease, about 70% to about 75% decrease, about 75% to about 99% decrease, about 75% to about 95% decrease, about 75% to about 90% decrease, about 75% to about 85% decrease, about 75% to about 80% decrease, about 80% to about 99% decrease, about 80% to about 95% decrease, about 80% to about 90% decrease, about 80% to about 85% decrease, about 85% to about 99% decrease, about 85% to about 95% decrease, about 85% to about 90% decrease, about 90% to about 99% decrease, about 90% to about 95% decrease, or about 95% to about 99% decrease) in one or more (e.g., two, three, four, five, six, seven, eight, nine, ten, eleven, or twelve) of: the severity of one or more symptoms of the inflammatory disease or condition that arises in a tissue originating from the endoderm, a decrease in the number of memory Th cells present in a mesenteric lymph node, a decrease in the expression of α4β7 integrin in memory Th cells present in a mesenteric lymph node, a decrease in the number of memory Th cells present in the Peyer's patch, and a decrease in the expression of α4β7 integrin in memory Th cells present in the Peyer's patch, a decrease in the level of interferon-K in the tissue originating from the endoderm involved in the inflammatory disease or condition, a decrease in the level of IL-1B in the tissue originating from the endoderm involved in the inflammatory disease or condition, a decrease in the level of IL-6 in the tissue originating from the endoderm involved in the inflammatory disease or condition, a decrease in the level of IL-22 in the tissue originating from the endoderm involved in the inflammatory disease or condition, a decrease in the level of IL-17A in the tissue originating from the endoderm involved in the inflammatory disease or condition, a decrease in the level of TNFI in the tissue originating from the endoderm involved in the inflammatory disease or condition, a decrease in the level of IL-2 in the tissue originating from the endoderm involved in the inflammatory disease or condition, and a decrease in the number of T-lymphocytes that have migrated into the tissue originating from the endoderm involved in the inflammatory disease or condition, in a subject (e.g., as compared to the level in the subject prior to treatment or compared to a subject or population of subjects having a similar disease but receiving a placebo or a different treatment) (e.g., for a time period of between about 1 hour to about 30 days (e.g., or any of the subranges herein) following the first administration of an immune modulator using any of the compositions or devices described herein. As used herein, "GI tissue" refers to tissue in the gastrointestinal (GI) tract, such as tissue in one or more of duodenum, jejunum, ileum, cecum, ascending colon, transverse colon, descending colon, sigmoid colon, and rectum, more particularly in the proximal portion of one or more of duodenum, jejunum, ileum, cecum, ascending colon, transverse colon, descending colon, and sigmoid colon, or in the distal portion of one or more of duodenum, jejunum, ileum, cecum, ascending colon, transverse colon, descending colon, and sigmoid colon. Exemplary methods for determining the levels of interferon-K, IL-1β, IL-6, IL-22, IL-17A, TNFI, and IL-2 are described herein. Additional methods for determining the levels of these cytokines are known in the art. Exemplary methods for determining the number of Th memory cells in Peyer's patches and mesentery lymph nodes are described herein. Additional methods for determining the number of Th memory cells in Peyer's patches and mesentery lymph nodes are known in the art.

Accordingly, in some embodiments, a method of treatment disclosed herein includes determining the level of a marker at the location of disease in a subject (e.g., either before and/or after administration of the device). In some embodiments, the marker is a biomarker and the method of treatment disclosed herein comprises determining that the level of a biomarker at the location of disease is a subject following administration of the device is decreased as compared to the level of the biomarker at the same location of disease in a subject either before administration or at the same time point following systemic administration of an equal amount of the immune modulator. In some examples, the level of the biomarker at the same location of disease following administration of the device is 1% decreased to 99% decreased as compared to the level of the biomarker at the same location of disease in a subject either before administration or at the same time point following systemic administration of an equal amount of the immune modulator. In some embodiments, the level of the marker is one or more of: the level of interferon-K, the level of IL-17A, the level of TNFα, the level of IL-2, the number of Th memory cells in Peyer's patches, and the number of Th memory cells in mesenteric lymph nodes.

In some embodiments, the method of treatment disclosed herein includes determining that the level of a marker at a time point following administration of a device is lower than the level of the marker at a time point following administration of the device is lower than the level of the marker in a subject prior to administration of the device or in a subject at substantially the same time point following systemic administration of an equal amount of the immune modulator. In some examples, the level of the marker following administration of the device is 1% decreased to 99% decreased as compared to the level of the marker in a subject prior to administration of the device or in a subject at the same time point following systemic administration of an equal amount of the immune modulator. In some examples, a method of treatment disclosed herein includes determining the level of the biomarker at the location of disease in a subject within a time period of about 10 minutes to 10 hours following administration of the device.

In some embodiments, a method of treatment described herein includes: (i) determining the ratio $R_B$ of the level $L_{1B}$ of a biomarker at the location of disease at a first time point following administration of the device and the level $L_{2B}$ of the biomarker at the same location of disease in a subject at substantially the same time point following systemic administration of an equal amount of the immune modulator; (ii) determining the ratio of $R_D$ of the level of L1D of the immune modulator at the same location and the substantially the same time point as in (i) and the level L2D of the immune modulator at the same location of disease in a subject at substantially the same time point following systemic administration of an equal amount of the immune modulator; and (iii) determining the ratio of $R_B/R_D$.

In some embodiments, a method of treatment disclosed herein can include: (i) determining the ratio $R_B$ of the level $L_{1B}$ of a biomarker at the location of disease at a time point following administration of the device and the level $L_{2B}$ of the biomarker at the same location of disease in a subject at substantially the same time point following systemic administration of an equal amount of the immune modulator; (ii) determining the ratio $R_D$ of the level L1D of the immune modulator at the same location and at substantially the time point as in (i) and the level $L_{2D}$ of the immune modulator in a subject at the same location of disease at substantially the same time point following systemic administration of an equal amount of the immune modulator; and (iii) determining the product $R_B \times R_D$.

In some embodiments, a method of treatment disclosed herein can include determining that the level of a marker in a subject at a time point following administration of the device is elevated as compared to a level of the marker in a subject prior to administration of the device or a level at substantially the same time point in a subject following systemic administration of an equal amount of the immune modulator. In some examples, the level of the marker at a time point following administration of the device is 1% increased or 400% increased as compared to the level of the marker in a subject prior to administration of the device or a level at substantially the same time point in a subject following systemic administration of an equal amount of the immune modulator. In some examples, a method of treatment disclosed herein includes determining the level of the marker in a subject within a period of about 10 minutes to about 10 hours following administration of the device.

In some embodiments, a method of treatment disclosed herein can include determining the level of a marker in a subject's blood, serum or plasma.

An illustrative list of examples of biomarkers for GI disorders includes interferon-K, IL-1β, IL-6, IL-22, IL-17A, TNFI, IL-2, memory cells (CD44'CD45RB CD4+ cells); α4β7; VEGF; ICAM; VCAM; SAA; Calprotectin; lactoferrin; FGF2; TGFb; ANG-1; ANG-2; PLGF; Biologics (Infliximab; Humira; Stelara; Vedolizumab; Simponi; Jak inhibitors; Others); EGF; IL12/23p40; GMCSF; A4 B7; AeB7; CRP; SAA; ICAM; VCAM; AREG; EREG; HB-EGF; HRG; BTC; TGFα; SCF; TWEAK; MMP-9; MMP-6; Ceacam CD66; IL10; ADA; Madcam-1; CD166 (AL CAM); FGF2; FGF7; FGF9; FGF19; ANCA Antineutrophil cytoplasmic antibody; ASCAA Anti-*Saccharomyces Cerevisiae* Antibody IgA; ASCAG Anti-*Saccharomyces Cerevisiae* Antibody IgG; CBir1 Anti-*Clostridium* cluster XIVa flagellin CBir1 antibody; A4-Fla2 Anti-*Clostridium* cluster XIVa flagellin 2 antibody; FlaX Anti-*Clostridium* cluster XIVa flagellin X antibody; OmpC Anti-*Escherichia coli* Outer Membrane Protein C; ANCA Perinuclear AntiNeutrophil Cytoplasmic Antibody; AREG Amphiregulin Protein; BTC Betacellulin Protein; EGF Epidermal Growth Factor EREG Epiregulin Protein; HBEGF Heparin Binding Epidermal Growth Factors; HGF Hepatocyte Growth Factor; HRG Neuregulin-1; TGFA Transforming Growth Factor alpha; CRP C-Reactive Protein; SAA Serum Amyloid A; ICAM-1 Intercellular Adhesion Molecule 1; VCAM-1 Vascular Cell Adhesion Molecule 1; fibroblasts underlying the intestinal epithelium; and HGF.

In some embodiments, a marker is an IBD biomarker, such as, for example: anti-glycan; anti-*Saccharomices cerevisiae* (ASCA); anti-laminaribioside (ALCA); anti-chitobioside (ACCA); anti-mannobioside (AMCA); anti-laminarin (anti-L); anti-chitin (anti-C) antibodies: anti-outer membrane porin C (anti-OmpC), anti-Cbir1 flagellin; anti-12 antibody; autoantibodies targeting the exocrine pancreas (PAB); and perinuclear anti-neutrophil antibody (pANCA); and calprotectin.

In some embodiments, a biomarker is associated with membrane repair, fibrosis, angiogenesis. In certain embodiments, a biomarker is an inflammatory biomarker, an anti-inflammatory biomarker, an MMP biomarker, an immune marker, or a TNF pathway biomarker. In some embodiments, a biomarker is gut specific.

For tissue samples, HER2 can be used as a biomarker relating to cytotoxic T cells. Additionally, other cytokine levels can be used as biomarkers in tissue (e.g., phospho STAT 1, STAT 3 and STAT 5), in plasma (e.g., VEGF, VCAM, ICAM, IL-6), or both.

In some embodiments, the target analyte(s) include one or more immunoglobulins, such as, for example, immunoglobulin M (IgM), immunoglobulin D (IgD), immunoglobulin G (IgG), immunoglobulin E (IgE) and/or immunoglobulin A (IgA). In some embodiments, IgM is a biomarker of infection and/or inflammation. In some embodiments, IgD is a biomarker of autoimmune disease. In some embodiments, IgG is a biomarker of Alzheimer's disease and/or for cancer. In some embodiments, IgE is a biomarker of asthma and/or allergen immunotherapy. In some embodiments, IgA is a biomarker of kidney disease.

In some embodiments, a biomarker or marker of a liver disease or disorder (e.g., any of the liver diseases or disorders described herein) is a bile acid or a bile salt (also known as a conjugated bile acid). Bile acids are products of cholesterol synthesis that are synthesized in the liver, conjugated to taurine or glycine, and stored in the gallbladder until released into the small intestine. The primary bile acids are cholic acid, and chenodeoxycholic acid, which are deconjugated and dehydroxylated by intestinal bacteria to form the secondary bile acids deoxycholic acid and lithocholic acid, respectively. The majority of bile acids (about 95%) are reabsorbed in the distal ileum and returned to the liver (see, e.g., U.S. Publication No. 2017/0343535, incorporated herein by reference). Impaired absorption of bile acids in the ileum can lead to excess bile acids in the colon which can cause symptoms of bile acid malabsorption (BAM; also known as bile acid diarrhea), including watery stool and fecal incontinence. Interestingly, up to 50% of patients with irritable bowel syndrome with diarrhea (IBS-D) also have BAM (see, e.g., Camilleri et al. (2009) Neurogastroeterol. Motil. 21 (7): 734-43). In some embodiments, the presence, absence, and/or a specific level of one or more bile acids or bile salts in the GI tract of a subject is indicative of a condition or disease state (e.g., a GI disorder and/or a non-GI disorder (e.g., a systemic disorder or a liver disease)). In some embodiments, the level of at least one bile acid or bile salt in the GI tract of the subject is used to diagnose a GI disorder such as BAM or IBS (e.g., IBS-D). In some embodiments, a level of a bile acid or a bile salt in the GI tract of a subject is determined. For instance, the presence and/or absence, and/or the concentration of a bile acid, a bile salt, or a combination thereof, may be determined at a specific region of the GI tract of a subject (e.g., one or more of the duodenum, jejunum, ileum, ascending colon, transverse colon or descending colon) to determine whether the subject has or is at risk of developing a GI disorder, such as BAM or IBS-D. In some embodiments, the ratio of two or more bile acids or bile acid salts in the GI tract of a subject (e.g., a specific region of the GI tract of a subject including one or more of the duodenum, jejunum, ileum, ascending colon, transverse colon or descending colon) can be determined. In some embodiments, the presence and/or absence, and/or the concentration of a bile acid, a bile salt, or a combination thereof, is determined in the ileum of a subject. In some embodiments, the presence and/or absence, and/or the concentration of a bile acid, a bile salt, or a combination thereof, is determined in the colon of a subject. In some embodiments, the concentration of a bile acid, a bile salt, or a combination thereof, is determined in specific regions of the GI tract of the subject, and for example, compared to determine where along the GI tract the compounds are accumulating. In some embodiments, the detection of a concentration of a bile acid, bile salt, or a combination thereof, in a specific region of the GI tract of the subject (e.g., the colon or the ileum) that is above a reference level of a bile acid, bile salt, or a combination thereof (e.g., the average level of a bile acid in healthy subjects) may be indicative of BAM and/or IBS-D in a subject. In some embodiments, the bile acid is selected from the group consisting of chenodeoxycholic acid, cholic acid, deoxycholate, lithocholate, and ursodeoxycholic acid. In some embodiments, the bile acid comprises cholesten-3-one or a structural variant thereof. In some embodiments, the bile acid is cholesten-3-one or a structural variant thereof. In some embodiments, the bile acid is cholesten-3-one. In some embodiments, the bile acid is a structural variant of cholesten-3-one. In some embodiments, the bile salt is selected from the group consisting of glycocholic acid, taurocholic acid, glycodeoxycholic acid, glycochenodeoxycholic acid, taurodeoxycholic acid, taurochenodeoxycholic acid, glycolithocholic acid, and taurolithocholic acid.

Another biomarker of a liver disease or disorder is 7α-hydroxy-4-cholesten-3-one (7αC4). The measurement of 7αC4 allows for the monitoring of the enzymatic activity of hepatic cholesterol 7α-hydroxylase, the rate limiting enzyme in the synthesis of bile acids and can be used as a surrogate to detect BAM (see, e.g., Galman et al. (2003) J. Lipid. Res. 44:859-66; and Camilleri et al. (2009) Neurogastrocterol. Motil. 21 (7): 734-43, incorporated herein by reference in their entirety).

Biomarkers of a liver disease or disorder also include cholesterol, a lipid, a fat soluble vitamin (e.g., ascorbic acid, cholecalciferol, ergocalciferol, a tocopherol, a tocotrienol, phylloquinone, and a menaquinone), bilirubin, fibroblast growth factor 19 (FGF19), TGR5 (also known as GP-BARI or M-BAR), glycine, taurine, and cholecystokinin (CCK or CCK-PZ). In some embodiments, a biomarker of a liver disease or disorder is cholecystokinin. Cholecystokinin is a peptide hormone that contributes to control intestinal motility (see Rehfeld (2017) Front. Endocrinol. (Lausanne) 8:47). In some embodiments, a biomarker of a liver disease or disorder is secretin. Secretin is a peptide hormone that regulates the pH of the duodenal content by controlling gastric acid secretion, regulates bile acid and bicarbonate secretion in the duodenum, and regulates water homeostasis (see, e.g., Afroze et al. (2013) Ann. Transl. Med. 1 (3): 29). In some embodiments, a subject has previously been administered cholecystokinin or secretin to induce the release of a biomarker or marker (e.g., from the liver and/or gall bladder into the GI tract).

An illustrative list of examples of biomarkers that may be used to detect, diagnose, or monitor treatment efficacy for a liver disease or disorder include bilirubin, gamma-glutamyl transferase (GGT), haptoglobin, apolipoprotein A1, alpha2-macroglobulin, cholesterol, triglycerides, alanine aminotransferase (ALT), aspartate aminotransferase (AST), glucose, cytokeratin-18 (CK18) fragment, hyaluronic acid, TGF-β, fatty acid binding protein, hydroxysteroid 17-beta dehydrogenase 13 (17β-HSD13), glutamyl dipeptides, glutamyl valine, glutamyl leucine, glutamyl phenylalanine, glutamyl tyrosine, carnitine, butylcarnitine, lysine, tyrosine, isoleucine, glycerophosphatidylcholine, glycerylphsphorylethanolamine, taurine, glycine conjugates, taurocholic acid, taurodeoxycholic acid, lactate, glutamate, cysteine-gluthatione disulfide, caprate, 10-undecenoate, olcoyl-lysophosphatidylcholine, oxidized and reduced gluthatione, glutamate, andenosine triphosphate, creatine, cholic acid, and glycodeoxycholic acid. In some embodiments, a biomarker of a liver disease or disorder can be a metabolite of any of the markers or biomarkers described herein.

In some embodiments, the biomarker is High Sensitivity C-reactive Protein (hsCRP); 7 α-hydroxy-4-cholesten-3-one (7C4); Anti-Endomysial IgA (EMA IgA); Anti-Human Tissue Transglutaminase IgA ((TG IgA); Total Serum IgA by Nephelometry; Fecal Calprotectin; or Fecal Gastrointestinal Pathogens.

In some embodiments, the biomarker is:
a) an anti-gliadin IgA antibody, an anti-gliadin IgG antibody, an anti-tissue transglutaminase (tTG) antibody, an anti-endomysial antibody;
b)i) a serological marker that is ASCA-A, ASCA-G, ANCA, pANCA, anti-OmpC antibody, anti-CBir1 antibody, anti-FlaX antibody, or anti-A4-Fla2 antibody;
b)ii) an inflammation marker that is VEGF, ICAM, VCAM, SAA, or CRP;

b)iii) the genotype of the genetic markers ATG16L1, ECM1, NKX2-3, or STAT3;
c) a bacterial antigen antibody marker;
d) a mast cell marker;
e) an inflammatory cell marker;
f) a bile acid malabsorption (BAM) marker;
g) a kynurenine marker; or
h) a serotonin marker.

In some embodiments, the bacterial antigen antibody marker is selected from the group consisting of an anti-Fla1 antibody, anti-Fla2 antibody, anti-FlaA antibody, anti-FliC antibody, anti-FliC2 antibody, anti-FliC3 antibody, anti-YBaN1 antibody, anti-ECFliC antibody, anti-Ec0FliC antibody, anti-SeFljB antibody, anti-CjFlaA antibody, anti-CjFlaB antibody, anti-SfFliC antibody, anti-CjCgtA antibody, anti-Cjdmh antibody, anti-CjGT-A antibody, anti-EcYidX antibody, anti-EcEra antibody, anti-EcFrvX antibody, anti-EcGabT antibody, anti-EcYedK antibody, anti-EcYbaN antibody, anti-EcYhgN antibody, anti-RtMaga antibody, anti-RbCpaF antibody, anti-RgPilD antibody, anti-LaFrc antibody, anti-LaEno antibody, anti-LjEFTu antibody, anti-BfOmpa antibody, anti-PrOmpA antibody, anti-Cp10bA antibody, anti-CpSpA antibody, anti-EfSant antibody, anti-LmOsp antibody, anti-SfET-2 antibody, anti-Cpatox antibody, anti-Cpbtox antibody, anti-EcSta2 antibody, anti-Ec0Stx2A antibody, anti-CjcdtB/C antibody, anti-CdtcdA/B antibody, and combinations thereof.

In some embodiments, the mast cell marker is selected from the group consisting of beta-tryptase, histamine, prostaglandin E2 (PGE2), and combinations thereof.

In some embodiments, the inflammatory marker is selected from the group consisting of CRP, ICAM, VCAM, SAA, GRO.alpha., and combinations thereof.

In some embodiments, the bile acid malabsorption marker is selected from the group consisting of 7α-hydroxy-4-cholesten-3-one, FGF19, and a combination thereof.

In some embodiments, the kynurenine marker is selected from the group consisting of kynurenine (K), kynurenic acid (KyA), anthranilic acid (AA), 3-hydroxykynurenine (3-HK), 3-hydroxyanthranilic acid (3-HAA), xanthurenic acid (XA), quinolinic acid (QA), tryptophan, 5-hydroxytryptophan (5-HTP), and combinations thereof.

In some embodiments, the serotonin marker is selected from the group consisting of serotonin (5-HT), 5-hydroxyindoleacetic acid (5-HIAA), serotonin-O-sulfate, serotonin-O-phosphate, and combinations thereof.

In some embodiments, the biomarker is a biomarker as disclosed in U.S. Pat. No. 9,739,786, incorporated by reference herein in its entirety.

The following markers can be expressed by mesenchymal stem cells (MSC): CD105, CD73, CD90, CD13, CD29, CD44, CD10, Stro-1, CD271, SSEA-4, CD146, CD49f, CD349, GD2, 3G5, SSEA-3, SISD2, Stro-4, MSCA-1, CD56, CD200, PODX1, Sox11, or TM4SF1 (e.g., 2 or more, 3 or more, 4 or more, 5 or more, 6 or more, 7 or more, 8 or more, 9 or more, or 10 or more of such markers), and lack expression of one or more of CD45, CD34, CD14, CD19, and HLA-DR (e.g., lack expression of two or more, three or more, four or more, or five or more such markers). In some embodiments, MSC can express CD105, CD73, and CD90. In some embodiments, MSC can express CD105, CD73, CD90, CD13, CD29, CD44, and CD10. In some embodiments, MSC can express CD105, CD73, and CD90 and one or more stemness markers such as Stro-1, CD271, SSEA-4, CD146, CD49f, CD349, GD2, 3G5, SSEA-3. SISD2, Stro-4, MSCA-1, CD56, CD200, PODX1, Sox11, or TM4SF1. In some embodiments, MSC can express CD105, CD73, CD90, CD13, CD29, CD44, and CD10 and one or more stemness markers such as Stro-1, CD271, SSEA-4, CD146, CD49f, CD349, GD2, 3G5, SSEA-3. SISD2, Stro-4, MSCA-1, CD56, CD200, PODX1, Sox11, or TM4SF1. See, e.g., Lv, et al., *Stem Cells,* 2014, 32:1408-1419.

Intestinal stem cells (ISC) can be positive for one or more markers such as Musashi-1 (Msi-1), Ascl2, Bmi-1, Doublecortin and Ca2+/calmodulin-dependent kinase-like 1 (DCAMKL1), and Leucin-rich repeat-containing G-protein-coupled receptor 5 (Lgr5). See, e.g., Mohamed, et al., Cytotechnology, 2015 67 (2): 177-189.

Any of the foregoing biomarkers can be used as a biomarker for one or more of other conditions as appropriate.

In some embodiments of the methods herein, the methods comprise determining the time period of onset of treatment following administration of the device.

EXAMPLES

Example 1—Preclinical Murine Colitis Model

Experimental Induction of Colitis

Colitis is experimentally induced to mice via the dextran sulfate sodium (DSS)-induced colitis model. This model is widely used because of its simplicity and many similarities with human ulcerative colitis. Briefly, mice are subjected to DSS via cecal catheterization, which is thought to be directly toxic to colonic epithelial cells of the basal crypts, for several days until colitis is induced.

Groups

Mice are allocated to one of seven cohorts, depending on the agent that is administered:

1. Control (no agent)
2. Adalimumab (2.5 mg/kg)
3. Adalimumab (5 mg/kg)
4. Adalimumab (10 mg/kg)

The control or agent is applied to a damaged mucosal surface of the bowel via administration through a cecal catheter at the dose levels described above.

Additionally, for each cohort, the animals are separated into two groups. One group receives a single dose of the control or agent on day 10 or 12. The other group receives daily (or similar) dosing of the control or agent.

Analysis

For each animal, efficacy is determined (e.g., by endoscopy, histology, etc.), and cytotoxic T-cell levels are determined in blood, feces, and tissue (tissue levels are determined after animal sacrifice). For tissue samples, levels HER2 are additionally determined, and the level of cytotoxic T cells is normalized to the level of HER2. Additionally, other cytokine levels are determined in tissue (e.g., phospho STAT 1, STAT 3 and STAT 5), in plasma (e.g., VEGF, VCAM, ICAM, IL-6), or both.

Pharmacokinetics are determined both systemically (e.g., in the plasma) and locally (e.g., in colon tissue). For systemic pharmacokinetic analysis, blood and/or feces is collected from the animals at one or more timepoints after administration (e.g., plasma samples are collected at 15 minutes, 30 minutes, 1 hour, 2 hours, 4 hours, and/or 8 hours after administration). Local/colon tissue samples are collected once after animal sacrifice.

Example 2a—Development of Preclinical Porcine Colitis Model

Experimental Induction of Colitis

Female swine weighing approximately 35 to 45 kg at study start are fasted at least 24 hours prior to intra-rectal administration of trinitrobenzene sulfonic acid (TNBS). Animals are lightly anesthetized during the dosing and endoscopy procedure. An enema to clean the colon is used, if necessary. One animal is administered 40 mL of 100% EtOH mixed with 5 grams of TNBS diluted in 10 mL of water via an enema using a ball-tipped catheter. The enema is deposited in the proximal portion of the descending colon just past the bend of the transverse colon. The TNBS is retained at the dose site for 12 minutes by use of two Foley catheters with 60-mL balloons placed in the mid-section of the descending colon below the dose site. A second animal is similarly treated, but with a solution containing 10 grams of TNBS. An Endoscope is employed to positively identify the dose site in both animals prior to TNBS administration. Dosing and endoscopy are performed by a veterinary surgeon Seven (7) days after TNBS administration, after light anesthesia, the dose site and mucosal tissues above and below the dose site are evaluated by the veterinary surgeon using an endoscope. Pinch Biopsies are obtained necessary, as determined by the surgeon. Based on the endoscopy findings, the animals may be euthanized for tissue collection on that day, or may proceed on study pending the results of subsequent endoscopy exams for 1 to 4 more days. Macroscopic and microscopic alterations of colonic architecture, possible necrosis, thickening of the colon, and substantial histologic changes are observed at the proper TNBS dose.

Clinical signs (e.g., ill health, behavioral changes, etc.) are recorded at least daily during acclimation and throughout the study. Additional pen-side observations are conducted twice daily (once-daily on weekends). Body weight is measured for both animals Days 1 and 7 (and on the day of euthanasia if after Day 7).

On the day of necropsy, the animals are euthanized via injection of a veterinarian-approved euthanasia solution. Immediately after euthanasia in order to avoid autolytic changes, colon tissues are collected, opened, rinsed with saline, and a detailed macroscopic examination of the colon is performed to identify macroscopic finings related to TNBS-damage. Photos are taken. Tissue samples are taken from the proximal, mid, and distal transverse colon; the dose site; the distal colon; the rectum; and the anal canal. Samples are placed into NBF and evaluated by a board certified veterinary pathologist.

Example 2b—Pharmacokinetic/Pharmacodynamic and Bioavailability of Adalimumab After Topical Application Groups Sixteen (16) swine (approximately 35 to 45 kg at study start) are allocated to one of five groups:

1. Vehicle Control: (3.2 mL saline); intra-rectal; (n-2)
2. Treated Control: Adalimumab (40 mg in 3.2 mL saline); subcutaneous; (n=2)
3. Adalimumab (low): Adalimumab (40 mg in 3.2 mL saline); intra-rectal; (n=4)
4. Adalimumab (med): Adalimumab (80 mg in 3.2 mL saline); intra-rectal; (n=4)
5. Adalimumab (high): Adalimumab (160 mg in 3.2 mL saline); intra-rectal; (n=4)

On Day 0, the test article is applied to a damaged mucosal surface of the bowel via intra-rectal administration or subcutaneous injection by a veterinary surgeon at the dose levels and volume described above.

Clinical Observations and Body Weight

Clinical observations are conducted at least once daily. Clinical signs (e.g., ill health, behavioral changes, etc.) are recorded on all appropriate animals at least daily prior to the initiation of experiment and throughout the study until termination. Additional clinical observations may be performed if deemed necessary. Animals whose health condition warrants further evaluation are examined by a Clinical Veterinarian. Body weight is measured for all animals Days-6, 0, and after the last blood collections.

Samples

Blood: Blood is collected (cephalic, jugular, and/or catheter) into EDTA tubes during acclimation on Day −7, just prior to dose on Day 0, and 0.5, 1, 2, 4, 6, 8, 12, 24, and 48 hours post-dose. The EDTA samples are split into two aliquots and one is centrifuged for pharmacokinetic plasma and either analyzed immediately, or stored frozen (−80° C.) for later pharmacokinetic analyses. The remaining sample of whole blood is used for pharmacodynamic analyses.

Feces: Feces is collected Day −7, 0 and 0.5, 1, 2, 4, 6, 8, 12, 24 and 48 hours post-dose, and either analyzed immediately, or flash-frozen on liquid nitrogen and stored frozen at −70° C. pending later analysis of drug levels and inflammatory cytokines.

Tissue: Immediately after euthanasia in order to avoid autolytic changes, colon tissues are collected, opened, rinsed with saline, and a detailed macroscopic examination of the colon is performed to identify macroscopic finings related to TNBS-damage. Triplicate samples of normal and damaged tissues are either analyzed immediately, or are flash-frozen on liquid nitrogen and stored frozen at −70° C. pending later analysis of drug concentration, inflammatory cytokines and histology.

Samples are analyzed for adalimumab levels (local mucosal tissue levels and systemic circulation levels), and for levels of inflammatory cytokines including TNF-alpha.

Terminal Procedures

Animals are euthanized as per the schedule in Table 8, where one animal each of Vehicle and Treated Control groups is euthanized at 6 and 48 hours post-dose, and one animal of each the adalimumab groups are euthanized at 6, 12, 24 and 48 hours post-dose. Animals are discarded after the last blood collection unless retained for a subsequent study.

TABLE 8

| General | Sample size | Dose | Route | Days −7 | −6 | −5 | −4 | −3 | −2 | −1 | 0 | Hours 0.5 | 1 | 2 | 4 | 6 | 8 | 12 | 24 | 48 |
|---|---|---|---|---|---|---|---|---|---|---|---|---|---|---|---|---|---|---|---|---|
| Fast Food/Water Observations | | ad libidum | oral | • | • | • | • | • | • | • | • | • | • | • | • | • | • | • | • | • |
| clinical observations | | | | | • | • | • | • | • | • | • | | | | | | | | • | • |
| body weight | | | | | • | | | | | | • | | | | | | | | | • | • |

TABLE 8-continued

| General | Sample size | Dose | Route | Days -7 | -6 | -5 | -4 | -3 | -2 | -1 | 0 | Hours 0.5 | 1 | 2 | 4 | 6 | 8 | 12 | 24 | 48 |
|---|---|---|---|---|---|---|---|---|---|---|---|---|---|---|---|---|---|---|---|---|
| Treatments (groups) | | | | | | | | | | | | | | | | | | | | |
| TNBS (all animals) | | | intra rectal | | | | • | | | | | | | | | | | | | |
| 1. Vehicle control euthanized | n = 2 | 1.6 mL saline (vehicle) | intra rectal | | | | | | | • | | | | | | | | n = 1 | | n = 1 |
| 2. Treated control euthanized | n = 2 | 40 mg in 1.6 mL saline | sub-cutaneous | | | | | | | • | | | | | | | | n = 1 | | n = 1 |
| 3. Adalimumab (low) euthanized | n = 4 | 40 mg in 1.6 mL saline | intra rectal | | | | | | | • | | | | | | | | n = 1 | n = 1 | n = 1 | n = 1 |
| 4. Adalimumab (med) euthanized | n = 4 | 80 mg in 1.6 mL saline | intra rectal | | | | | | | • | | | | | | | | n = 1 | n = 1 | n = 1 | n = 1 |
| 5. Adalimumab (high) euthanized | n = 4 | 160 mg in 1.6 mL saline | intra rectal | | | | | | | • | | | | | | | | n = 1 | n = 1 | n = 1 | n = 1 |
| Adalimumab (required) Samples | | 1200 | | | | | | | | | | | | | | | | | | |
| Blood | | | cephalic, jugular or catheter | • | | | | | | | • | • | • | • | • | • | • | • | • | • |
| Fecal | | | rectal | • | | | | | | | • | | • | • | • | • | • | • | • | • | • |
| Tissue | | | necropsy | • | | | | | | | • | | | | | | | • | • | • | • |

Example 2c—Pharmacokinetic/Pharmacodynamic and Bioavailability of Adalimumab After Topical Application Groups DSS-induced colitis Yorkshire-Cross Farm Swine (approximately 5-10 kg at study start) are allocated to one of five groups:
 1. Vehicle Control: (saline); intra-rectal;
 2. Treated Control: Adalimumab (13 mg in saline); subcutaneous;
 3. Adalimumab: Adalimumab (13 mg in saline); intra-rectal;

Att=0, the test article is applied to a damaged mucosal surface of the bowel via intra-rectal administration or subcutaneous injection by a veterinary surgeon at the dose levels and volume described above.

Clinical Observations

Clinical signs (e.g., ill health, behavioral changes, etc.) are recorded on all appropriate animals at least daily prior to the initiation of experiment and throughout the study until termination. Additional clinical observations may be performed if deemed necessary. Animals whose health condition warrants further evaluation are examined by a Clinical Veterinarian.

Samples

Blood: Blood is collected (cephalic, jugular, and/or catheter) into EDTA tubes during acclimation on Day −7, just prior to dose on Day 0, and 12 hours post-dose. The EDTA samples are split into two aliquots and one is centrifuged for pharmacokinetic plasma and either analyzed immediately, or stored frozen (−80° C.) for later pharmacokinetic analyses. The remaining sample of whole blood is used for pharmacodynamic analyses.

Feces: Feces is collected Day −7, 0 and 12 hours post-dose, and either analyzed immediately, or flash-frozen on liquid nitrogen and stored frozen at −70° C. pending later analysis of drug levels and inflammatory cytokines.

Tissue: Immediately after euthanasia (12 hours after dosing) in order to avoid autolytic changes, colon tissues are collected, opened, rinsed with saline, and a detailed macroscopic examination of the colon is performed to identify macroscopic finings related to DSS-damage. Triplicate samples of normal and damaged tissues are either analyzed immediately, or are flash-frozen on liquid nitrogen and stored frozen at −70° C. pending later analysis of drug concentration, inflammatory cytokines and histology.

Samples are analyzed for adalimumab levels (local mucosal tissue levels and systemic circulation levels), and for levels of inflammatory cytokines including TNF-alpha.

Terminal Procedures

Animals are euthanized at 12 hours post-dose.

Example 3—Comparison of Systemic versus Intracecal Delivery of an Anti-IL-12 Antibody The objective of this study was to compare the efficacy of an IL-12 inhibitor (anti-IL-12 p40; anti-p40 mAb; BioXCell (Cat #: BE0051)), when dosed systemically versus intracecally, to the treat dextran sulfate sodium salt (DSS)-induced colitis in male C57Bl/6 mice.

Materials and Methods

Mice

Normal male C57Bl/6 mice between the ages of 6-8 weeks old, weighing 20-24 g, were obtained from Charles River Laboratories. The mice were randomized into thirteen groups of twelve animals and two groups of eight animals, and housed in groups of 6-8 per cage, and acclimatized for at least three days prior to entering the study. Animal rooms were set to maintain a minimum of 12 to 15 air changes per hour, with an automatic timer for a light/dark cycle of 12 hours on/off, and fed with Labdiet 5053 sterile rodent chow, with water administered ad libitum.

Cecal Cannulation

Animals were placed under isoflurane anesthesia, with the cecum exposed via a midline incision in the abdomen. A small point incision was made in the distal cecum where 1-2 cm of the cannula was inserted. The incision was closed with a purse string suture using 5-0 silk. An incision was then made in the left abdominal wall through which the distal end of the cannula was inserted and pushed subcutaneously to the dorsal aspect of the back. The site was then washed copiously with warmed saline prior to closing the abdominal wall. A small incision was also made in the skin of the back between the shoulder blades, exposing the tip of the cannula. The cannula was secured in place using suture, wound clips, and tissue glue. All animals received 1 mL of warm sterile saline (subcutaneous injection) and were monitored closely until recovery before returning to their cage. All animals received 0.6 mg/kg BID buprenorphine for the first 3 days, and Baytril® at 10 mg/kg every day for the first 5 days post-surgery.

Induction of Colitis

Colitis was induced in male C57Bl/6 mice by exposure to 3% DSS drinking water (MP Biomedicals #0260110) from Day 0 to Day 5. Fresh DSS/water solutions were made again on Day 3 and any of the remaining original DSS solution will be discarded.

Assessment of Colitis

All animals were weighed daily and visually assessed for the presence of diarrhea and/or bloody stool at the time of dosing. The mice underwent two video endoscopies, one on day 10 and one on day 14, to assess colitis severity. Images were captured from each animal at the most severe region of disease identified during the endoscopy, and assessed using the rubric demonstrated in Table 9. Additionally, stool consistency was scored during the endoscopy using this rubric (Table 10) (0=Normal, well-formed pellet, 1=Loose stool, soft, staying in shape, 2=Loose stool, abnormal form with excess moisture, 3=Watery or diarrhea, 4=Bloody diarrhea). At necropsy, intestinal contents, peripheral blood, and tissue, and cecum/colon contents were collected for analysis.

TABLE 9

Endoscopy Scoring

| Score | Description of Endoscopy Score |
|---|---|
| 0 | Normal |
| 1 | Loss of vascularity |
| 2 | Loss of vascularity and friability |
| 3 | Friability and erosions |
| 4 | Ulcerations and bleeding |

TABLE 10

Stool Consistency Score

| Score | Description of Stool Consistency |
|---|---|
| 0 | Normal, well-formed pellet |
| 1 | Loose stool, soft, staying in shape |
| 2 | Loose stool, abnormal form with excess moisture |
| 3 | Watery or diarrhea |
| 4 | Bloody diarrhea |

Treatment of Colitis

Mice were treated with anti-IL-12 p40 during the acute phase of colitis due to its efficacy in the treatment of DSS-induced colitis. The test article was dosed at a volume of 0.1 mL/20 g from days 0 to 14. Anti-IL-12 p40 was administered intraperitoneally at a dose of 10 mg/kg every 3 days, and intracecally at a dose of 10 mg/kg, either every 3 days or every day. There was also a lower dose of 1 mg/kg given every day intracecally. The control groups were not administered drugs, and the vehicles (sterile PBS) were administered the placebo drug intraperitoneally and intracecally every day. These drugs were given from days 5-14, which is 9 days of administration. A more detailed explanation of dosing and groups can be seen in Table 11.

TABLE 11

Groups of Animals

| Group # | # of Animals | DSS | Cecal Cannula | Treatment | Dose (mg/kg) | Route | Dosing Schedule |
|---|---|---|---|---|---|---|---|
| 1 | 8 males | — | NO | — | — | — | — |
| 2 | 8 males | — | YES | — | — | — | — |
| 3 | 12 males | 3% DSS (day 0-5) | NO | Vehicle | — | PO | QD day 0-14 |
| 4 | 12 males | 3% DSS (day 0-5) | YES | Vehicle | — | IC | QD day 0-14 |
| 5 | 12 males | 3% DSS (day 0-5) | NO | Anti-p40 | 10 | IP | Q3 0, 3, 6, 9, 12 |
| 6 | 12 males | 3% DSS (day 0-5) | YES | Anti-p40 | 10 | IC | Q3 0, 3, 6, 9, 12 |
| 7 | 12 males | 3% DSS (day 0-5) | YES | Anti-p40 | 10 | IC | QD day 0-14 |
| 8 | 12 males | 3% DSS (day 0-5) | YES | Anti-p40 | 1 | IC | QD day 0-14 |

Sample Collection

Intestinal contents, peripheral blood, and tissue were collected at sacrifice on day 14, as follows: at the end of each study period, mice were euthanized by $CO_2$ inhalation immediately following endoscopy on day 14. The blood was collected via cardiac puncture into K2EDTA-coated tubes and centrifuged at 4000×g for 10 minutes. The blood cell pellet was retained and snapped frozen. The resulting plasma was then split into two separate cryotubes, with 100 µL in one tube and the remainder in the second. Plasma and cell pellet were also collected, flash frozen, and stored at −80 degrees Celsius.

The cecum and colon were removed from each animal and contents were collected, weighed, and snap frozen in separate cryovials. The colon was excised, rinsed, measured, weighed, and then trimmed to 6 cm in length and divided into 5 pieces. The most proximal 1 cm of colon was snapped frozen for subsequent bioanalysis of test article levels. Of the remaining 5 cm of colon, the most distal and proximal 1.5-cm sections was placed in formalin for 24 hours then transferred to 70% ethanol for subsequent histological evaluation. The middle 2-cm portion was bisected longitudinally and placed into two separate cryotubes, weighed, and snap frozen in liquid nitrogen.

Results

Figure 30:
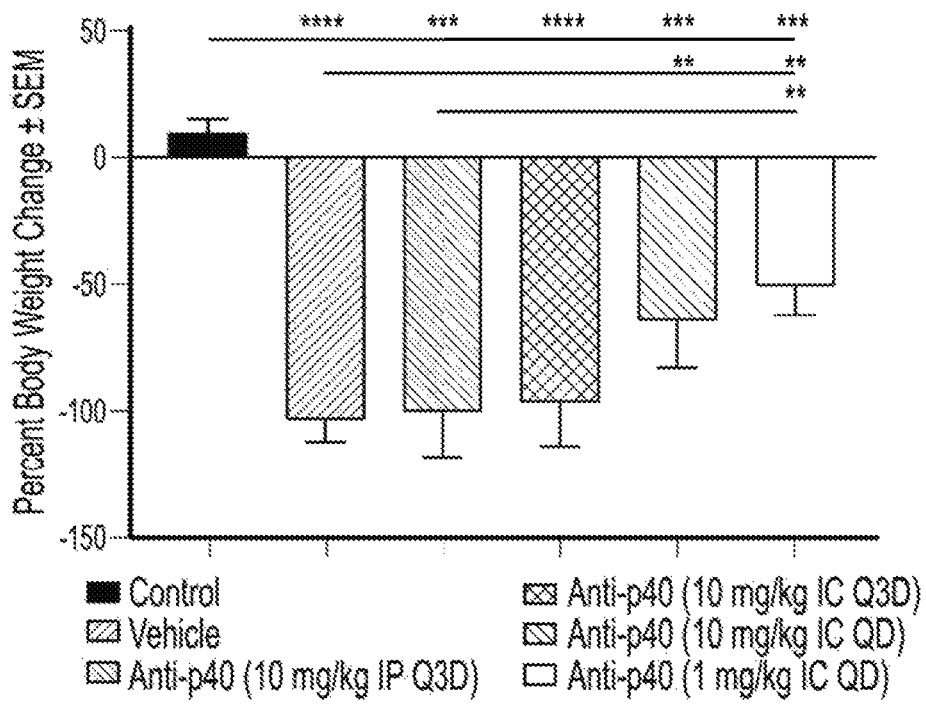
FIG. 30 is a graph showing the percentage (%) change in body weight at day 14 (±SEM) for DSS mice treated with anti-IL-12 p40 antibody intraperitoneally (10 mg/kg) every third day (Q3D) or intracecally (10 mg/kg or 1 mg/kg) daily (QD), when compared to mice treated with anti-IL-12 p40 antibody intraperitoneally (10 mg/kg) every third day (Q3D) and vehicle control (Vehicle). Mann-Whitney's U¬-test and Student's t-test were used for statistical analysis on non-Gaussian and Gaussian data respectively. A value of p<0.05 was considered significant (Graph Pad Software, Inc.).

The data in FIG. 30 show that the DSS mice that were intracecally administered an anti-IL-12 p40 (IgG2A) antibody had decreased weight loss as compared to DSS mice that were intraperitoneally administered the anti-IL-12 p40 antibody.

Figure 31:
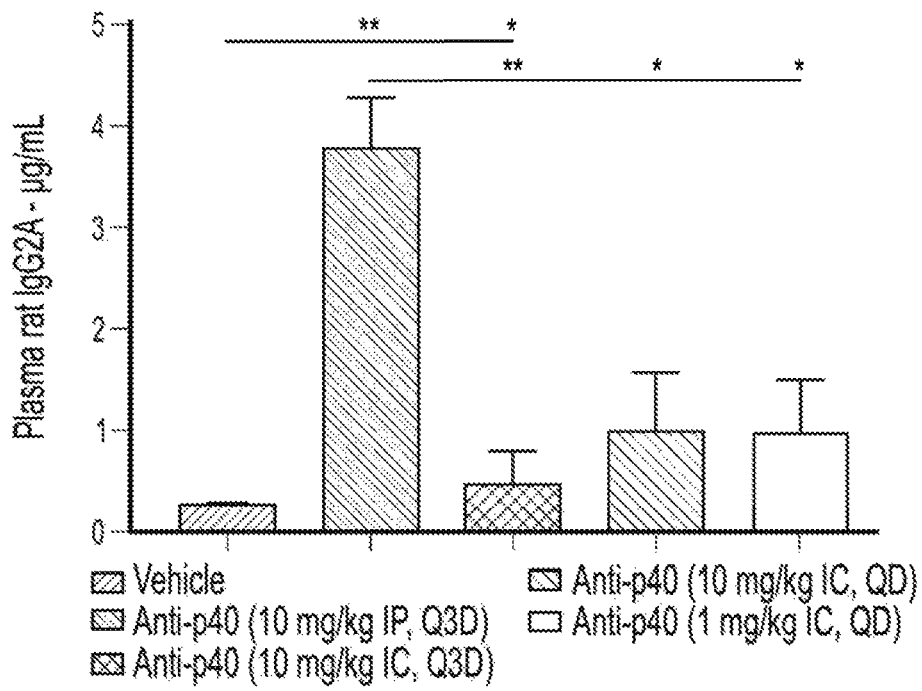
FIG. 31 is a graph showing the concentration of anti-IL-12 p40 rat IgG2A (µg/mL) in plasma of anti-IL-12 p40 intraperitoneally (10 mg/kg) and intracecally (10 mg/kg and 1 mg/kg) administered treatment groups given daily (QD) or every third day (Q3D) when compared to vehicle control (Vehicle) and when IP is compared to IC. ELISA analysis was used to determine the concentration of anti-IL-12 p40 (IgG2A). Data presented as mean±SEM. Mann-Whitney's U¬-test and Student's t-test were used for statistical analysis on non-Gaussian and Gaussian data respectively. A value of p<0.05 was considered significant (Graph Pad Software, Inc.).
Figure 32:
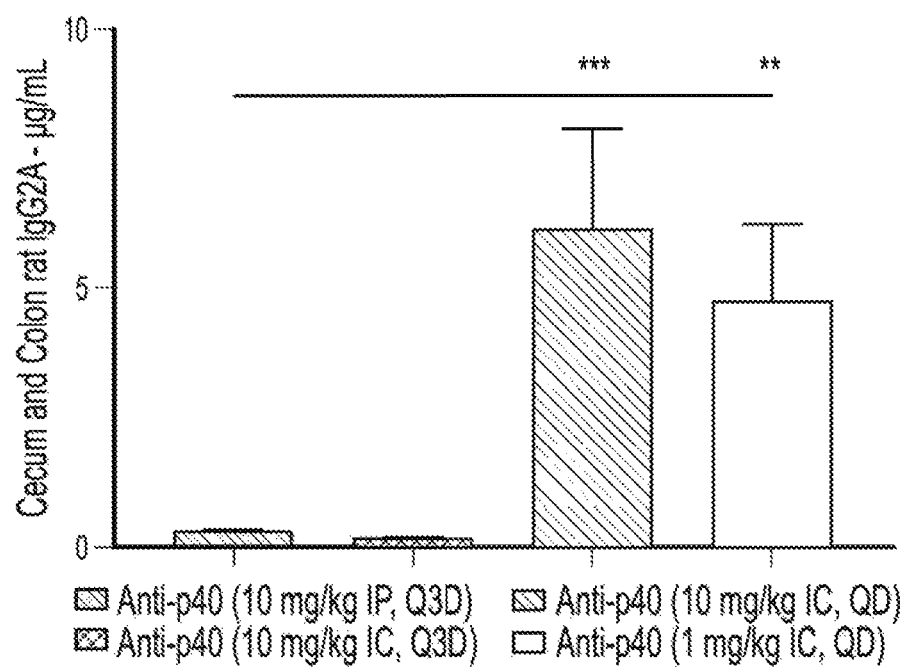
FIG. 32 is a graph showing the concentration of anti-IL-12 p40 antibody (IgG2A) (µg/mL) in the cecum and colon content of anti-IL-12 p40 antibody intraperitoneally (10 mg/kg) and intracecally (10 mg/kg and 1 mg/kg) administered treatment groups given daily (QD) or every third day (Q3D), when compared to vehicle control (Vehicle) and when IP is compared to IC. ELISA analysis was used to determine the concentration of rat IgG2A. Data presented as mean±SEM. Mann-Whitney's U-test and Student's t-test were used for statistical analysis on non-Gaussian and Gaussian data respectively. A value of p<0.05 was considered significant (Graph Pad Software, Inc.).

The data in FIG. 31 show that the plasma concentration of the anti-IL-12 p40 antibody was decreased in DSS mice that were intracecally administered the anti-IL-12 p40 antibody as compared to DSS mice that were intraperitoneally administered the anti-IL-12 p40 antibody. The data in FIG. 32 show that the cecum and colon concentration of the anti-IL-12 p40 antibody is increased in DSS mice that were intracecally administered the anti-IL-12 p40 antibody as compared to the DSS mice that were intraperitoneally administered the anti-IL-12 p40 antibody.

Figure 33:
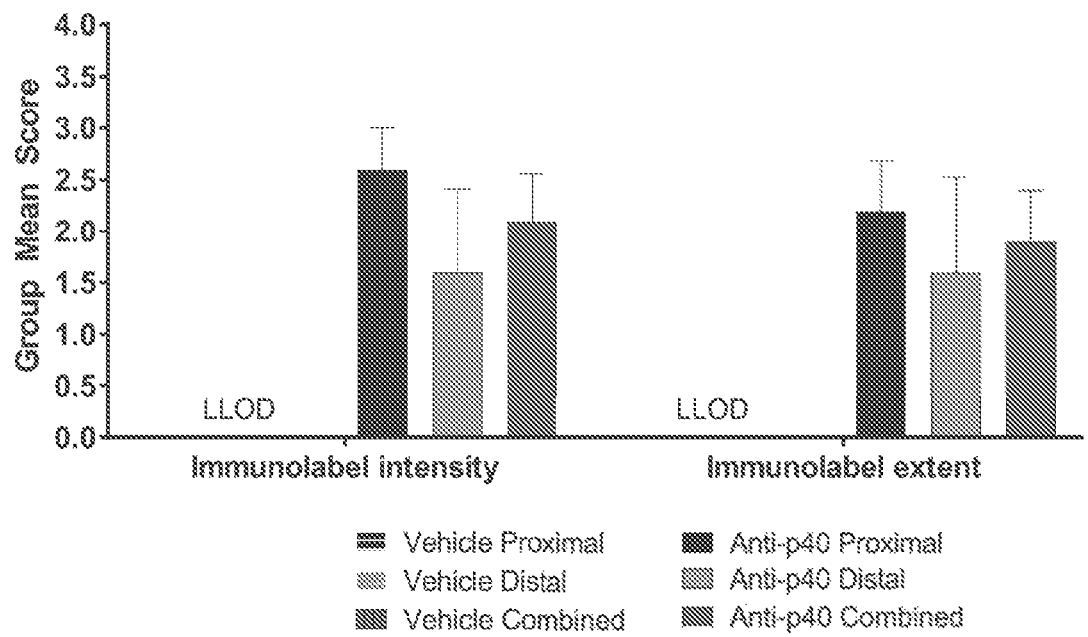
FIG. 33 is a graph showing the mean overall tissue immunolabel scores (intensity and extent) in acute DSS colitis mouse colon of anti-IL-12 p40 antibody intracecally-treated versus vehicle control-treated DSS mice. Data presented as mean±SEM.
Figure 34:
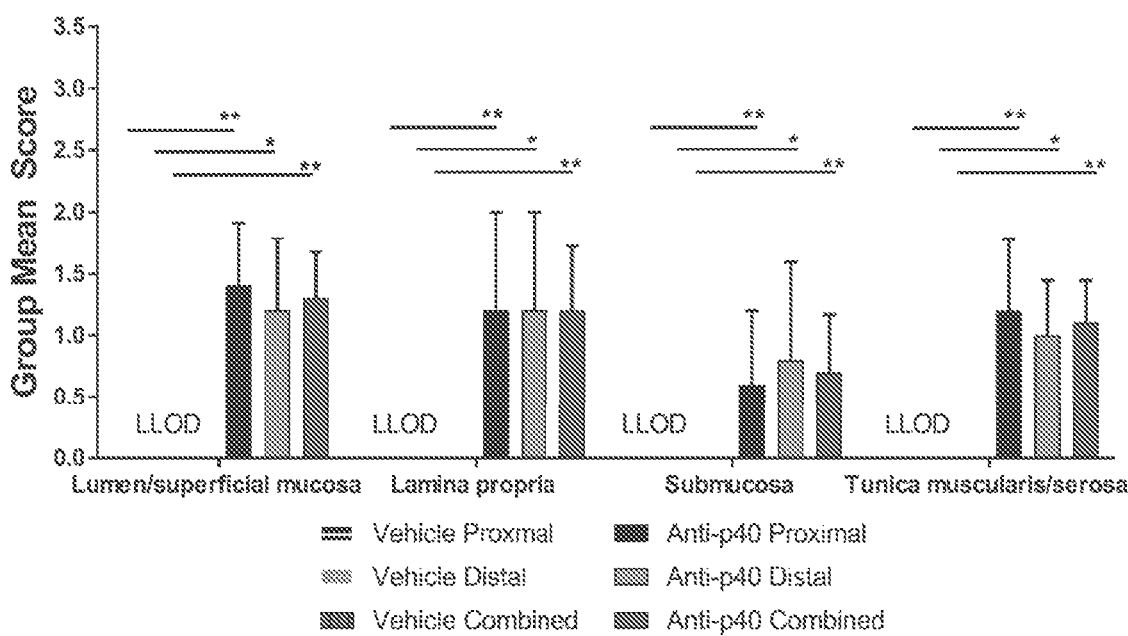
FIG. 34 is a graph showing the mean location-specific immunolabel scores in acute DSS colitis mouse colon of anti-IL-12 p40 intracecally-treated versus vehicle control-treated DSS mice. Data presented as mean±SEM. Mann-Whitney's U-test and Student's t-test were used for statistical analysis on non-Gaussian and Gaussian data respectively. A value of p<0.05 was considered significant (Graph Pad Software, Inc.).
Figure 35:
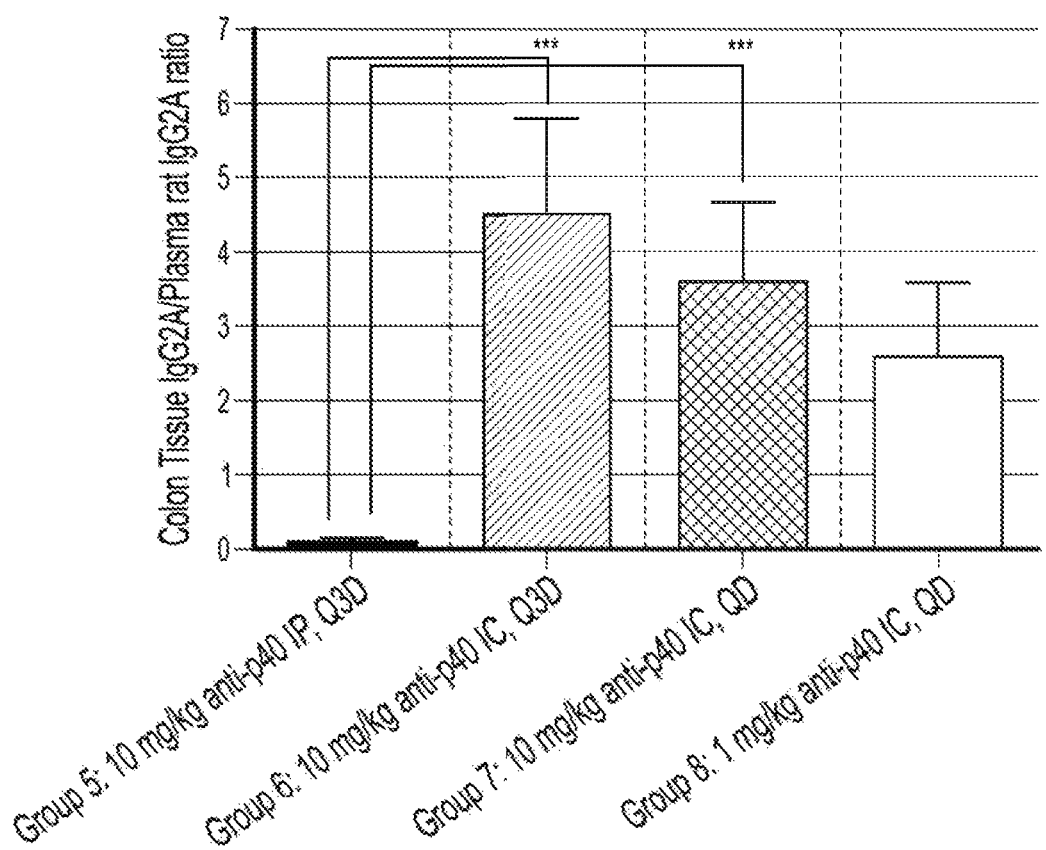
FIG. 35 is a graph showing the ratio of anti-IL-12 p40 antibody in the colon tissue to the plasma concentration of the anti-IL-12 p40 antibody in mice treated with the anti-IL-12 p40 antibody on day 0 (Q0) or day 3 (Q3D) of the study, when measured at the same time point after the initial dosing. An outlier animal was removed from Group 5.

The data in FIGS. 33 and 34 show that the anti-IL-12 p40 antibody is able to penetrate colon tissues (the lumen superficial, lamina propria, submucosa, and tunica muscularis/serosa) in DSS mice intracecally administered the anti-IL-12 p40 antibody, while the anti-IL-12 p40 antibody did not detectably penetrate the colon tissues of DSS mice intraperitoneally administered the anti-IL-12 p40 antibody. The data in FIG. 35 also show that the ratio of the concentration of anti-IL-12 p40 antibody in colon tissue to the concentration of the anti-IL-12 p40 antibody in plasma is increased in DSS mice intracecally administered the anti-IL-12 p40 antibody as compared to the ratio in DSS mice intraperitoneally administered the anti-IL-12 p40 antibody.

Figure 36:
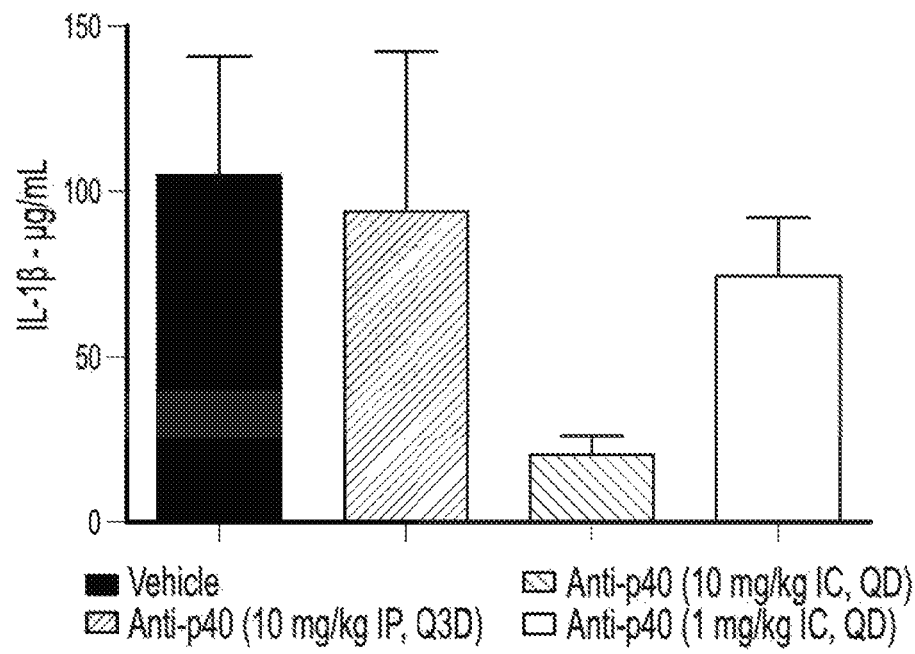
FIG. 36 is a graph showing the concentration of Il-1β (µg/mL) in colon tissue lysate of acute DSS colitis mice treated with anti-IL-12 p40 intraperitoneally (10 mg/kg) every third day (Q3D) or intracecally (10 mg/kg or 1 mg/kg) administered daily (QD), when compared to vehicle control (Vehicle). Data presented as mean±SEM. Mann-Whitney's U-test and Student's t-test were used for statistical analysis on non-Gaussian and Gaussian data respectively. A value of p<0.05 was considered significant (Graph Pad Software, Inc.).
Figure 37:
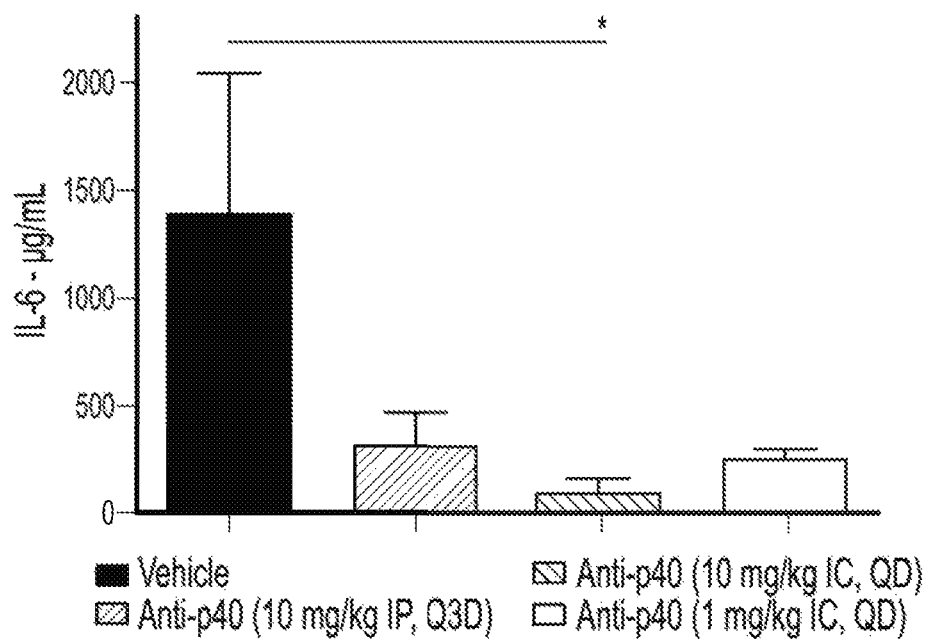
FIG. 37 is a graph showing the concentration of Il-6 (µg/mL) in colon tissue lysate of acute DSS colitis mice treated with anti-IL-12 p40 intraperitoneally (10 mg/kg) every third day (Q3D) or intracecally (10 mg/kg or 1 mg/kg) administered daily (QD), when compared to vehicle control (Vehicle). Data presented as mean±SEM. Mann-Whitney's U-test and Student's t-test were used for statistical analysis on non-Gaussian and Gaussian data respectively. A value of p<0.05 was considered significant (Graph Pad Software, Inc.
Figure 38:
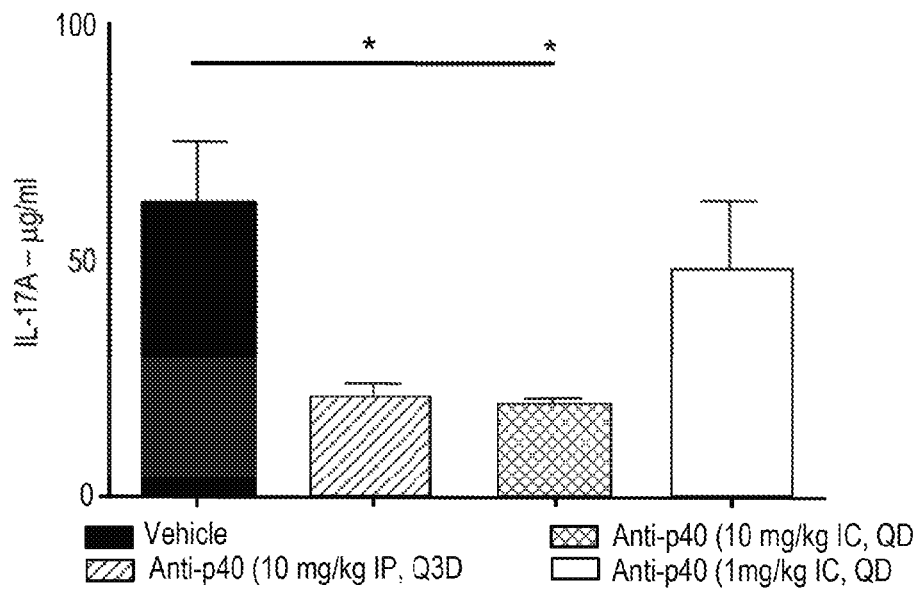
FIG. 38 is a graph showing the concentration of Il-17A (µg/mL) in colon tissue lysate of acute DSS colitis mice treated with anti-IL-12 p40 intraperitoneally (10 mg/kg) every third day (Q3D) or intracecally (10 mg/kg and 1 mg/kg) administered daily (QD), when compared to vehicle control (Vehicle). Data presented as mean±SEM. Mann-Whitney's U-test and Student's t-test were used for statistical analysis on non-Gaussian and Gaussian data respectively. A value of p<0.05 was considered significant (Graph Pad Software, Inc.).

The data in FIG. 36 show that the concentration of IL-1B in colon tissue is decreased in DSS mice intracecally administered the anti-IL-12 p40 antibody as compared to the concentration of IL-1 in colon tissue in DSS mice intraperitoneally administered the anti-IL-12 p40 antibody. The data in FIG. 37 show that the concentration of IL-6 in colon tissue is decreased in DSS mice intracecally administered the anti-IL-12 p40 antibody as compared to the concentration of IL-6 in colon tissue in DSS mice intraperitoneally administered the anti-IL-12 p40 antibody. The data in FIG. 38 show that the concentration of IL-17A in colon tissue is decreased in DSS mice intracecally administered the anti-IL-12 p40 antibody as compared to the concentration of IL-17A in colon tissue in DSS mice intraperitoneally administered the anti-IL-12 p40 antibody.

No significant differences in clinical observations or gastrointestinal-specific adverse effects, including stool consistency and/or bloody stool, were observed due to cannulation or intra-cecal treatments when compared with vehicle. No toxicity resulting from the treatments was reported. A significant reduction in body weight-loss (AUC) was found in groups treated with anti-IL-12 p40 antibody (10 mg/kg and 1 mg/kg, QD) via intra-cecal delivery when compared with vehicle control and intraperitoneal delivery (10 mg/kg, Q3D). The immunohistochemistry staining in anti-IL-12 p40 antibody (10 mg/kg, QD) treatment groups showed penetration of the antibody in all layers of colon tissue, including lumen mucosa, lamina propria, submucosa, tunica muscularis, via intra-cecal delivery. The distribution of anti-IL-12 p40 antibody was found in all segments of the colon, however, higher levels were detected in the proximal region. A significantly higher mean concentration of anti-IL-12 p40 antibody was found in the gastrointestinal contents and colon tissues when delivered via intra-cecal administration (Anti-p40:10 mg/kg and 1 mg/kg, QD) compared with intraperitoneal administration (anti-p40:10 mg/kg, Q3D). The blood level of anti-IL-12 p40 antibody was significantly higher when delivered via intraperitoneal administration (Q3D) as compared to intra-cecal administration (Q3D & QD). The concentrations of inflammatory cytokines, including IL-1β, IL-6, and IL-17, were significantly reduced by anti-IL-12 p40 antibody (10 mg/kg, QD) treatment when delivered via intra-cecal administration as compared to vehicle controls.

In sum, these data show that the compositions and devices provided herein can suppress the local immune response in the intestine, while having less of a suppressive effect on the systemic immune response of an animal. These data also suggest that the presently claimed compositions and devices will provide for treatment of colitis and other pro-inflammatory disorders of the intestine.

Example 4—Comparison of Systemic versus Intracecal Delivery of an Anti-Integrin α4β7 Antibody The objective of this study was to compare the efficacy of an integrin inhibitor (anti-integrin α4β7; anti-LPAM1; DATK-32 mAb; BioXCell (Cat #: BE0034)) when dosed systemically versus intracecally for treating dextran sulfate sodium salt (DSS)-induced colitis in male C57Bl/6 mice.

Materials and Methods

Mice

Normal male C57Bl/6 mice between the ages of 6-8 weeks old, weighing 20-24 g, were obtained from Charles River Laboratories. The mice were randomized into thirteen groups of twelve animals and two groups of eight animals, and housed in groups of 6-8 per cage, and acclimatized for at least three days prior to entering the study. Animal rooms were set to maintain a minimum of 12 to 15 air changes per hour, with an automatic timer for a light/dark cycle of 12 hours on/off, and fed with Labdiet 5053 sterile rodent chow, with water administered ad libitum.

Cecal Cannulation

The animals were placed under isoflurane anesthesia, with the cecum exposed via a midline incision in the abdomen. A small point incision was made in the distal cecum where 1-2 cm of the cannula was inserted. The incision was closed with a purse string suture using 5-0 silk. An incision was then made in the left abdominal wall through which the distal end of the cannula was inserted and pushed subcutaneously to the dorsal aspect of the back. The site was then washed copiously with warmed saline prior to closing the abdominal wall. A small incision was also made in the skin of the back between the shoulder blades, exposing the tip of the cannula. The cannula was secured in place using suture, wound clips, and tissue glue. All animals received 1 mL of warm sterile saline (subcutaneous injection) and were monitored closely until recovery before returning to their cage. All animals received 0.6 mg/kg BID buprenorphine for the first 3 days, and Baytril® at 10 mg/kg every day for the first 5 days post-surgery.

Induction of Colitis

Colitis was induced in male C57Bl/6 mice by exposure to 3% DSS drinking water (MP Biomedicals #0260110) from day 0 to day 5. Fresh DSS/water solutions were made again on day 3 and any of the remaining original DSS solution will be discarded.

Assessment of Colitis

All animals were weighed daily and visually assessed for the presence of diarrhea and/or bloody stool at the time of dosing. Mice underwent two video endoscopies, one on day 10 and one on day 14, to assess colitis severity. Images were captured from each animal at the most severe region of disease identified during the endoscopy, and assessed using the rubric demonstrated in Table 12. Additionally, stool consistency was scored during the endoscopy using this rubric (Table 13) (0=Normal, well-formed pellet, 1=Loose stool, soft, staying in shape, 2=Loose stool, abnormal form with excess moisture, 3=Watery or diarrhea, 4=Bloody diarrhea). At necropsy, intestinal contents, peripheral blood and tissue, and cecum/colon contents were collected for analysis.

TABLE 12

Endoscopy Score

| Score | Description of Endoscopy Score |
|---|---|
| 0 | Normal |
| 1 | Loss of vascularity |
| 2 | Loss of vascularity and friability |
| 3 | Friability and erosions |
| 4 | Ulcerations and bleeding |

TABLE 13

Stool Consistency Score

| Score | Description of Stool Consistency |
|---|---|
| 0 | Normal, well-formed pellet |
| 1 | Loose stool, soft, staying in shape |
| 2 | Loose stool, abnormal form with excess moisture |
| 3 | Watery or diarrhea |
| 4 | Bloody diarrhea |

Treatment of Colitis

Mice were treated with DATK32 during the acute phase of colitis due to its efficacy in the treatment of DSS-induced colitis. The test article was dosed at a volume of 0.1 mL/20 g from days 0 to 14. DATK32 was administered intraperitoneally at a dose of 25 mg/kg every 3 days, and intracecally at a dose of 25 mg/kg, either every 3 days or every day. There was also a lower dose of 5 mg/kg given every day intracecally. The control groups were not administered drugs, and the vehicle (sterile PBS) was administered as the placebo drug intraperitoneally and intracecally every day. These drugs were given from days 5-14, which is 9 days of administration. A more detailed explanation of dosing and groups can be seen in Table 14.

TABLE 14

Groups of Mice

| Group # | # of Animals | DSS | Cecal Cannula | Treatment | Dose (mg/kg) | Route | Dosing Schedule |
|---|---|---|---|---|---|---|---|
| 1 | 8 males | — | NO | — | — | — | — |
| 2 | 8 males | — | YES | — | — | — | — |
| 3 | 12 males | 3% DSS (day 0-5) | NO | Vehicle | — | PO | QD day 0-14 |
| 4 | 12 males | 3% DSS (day 0-5) | YES | Vehicle | — | IC | QD day 0-14 |
| 9 | 12 males | 3% DSS (day 0-5) | NO | DATK32 | 25 | IP | Q3 0, 3, 6, 9, 12 |
| 10 | 12 males | 3% DSS (day 0-5) | YES | DATK32 | 25 | IC | Q3 0, 3, 6, 9, 12 |
| 11 | 12 males | 3% DSS (day 0-5) | YES | DATK32 | 25 | IC | QD day 0-14 |
| 12 | 12 males | 3% DSS (day 0-5) | YES | DATK32 | 5 | IC | QD day 0-14 |

Sample Collection

Intestinal contents, peripheral blood, and tissue were collected at sacrifice on day 14, as follows: at the end of each study period, mice were euthanized by $CO_2$ inhalation immediately following endoscopy on day 14. The blood was collected via cardiac puncture into K2EDTA-coated tubes and centrifuged at 4000×g for 10 minutes. The blood cell pellet was retained and snapped frozen. The resulting plasma was then split into two separate cryotubes, with 100 µL in one tube and the remainder in the second. Plasma and the cell pellet were also collected, flash frozen, and stored at-80 degrees Celsius. An ELISA was used to determine the level of rat IgG2A. 10

The cecum and colon were removed from each animal and contents were collected, weighed, and snap frozen in separate cryovials. The colon was excised, rinsed, measured, weighed, and then trimmed to 6 cm in length and divided into 5 pieces. The most proximal 1 cm of colon was snapped frozen for subsequent bioanalysis of anti-DATK32 levels. Of the remaining 5 cm of colon, the most distal and proximal 1.5-cm sections was placed in formalin for 24 hours then transferred to 70% ethanol for subsequent histological evaluation. The middle 2-cm portion was bisected longitudinally and placed into two separate cryotubes, weighed, and snap frozen in liquid nitrogen.

There was an additional collection of 100 μL of whole blood from all animals and processed for FACS analysis of α4 and β7 expression on T-helper memory cells. Tissue and blood were immediately placed in FACS buffer (1×PBS containing 2.5% fetal calf serum) and analyzed using the following antibody panel (Table 15).

TABLE 15

Fluorophore Labelled Antibodies Used in FACS Analysis

| Antibody Target | Fluorochrome | Purpose |
| --- | --- | --- |
| CD4 | APC-Vio770 | Defines T-Helper Cells |
| CD44 | VioBlue | Memory/Naive Discrimination |
| CD45RB | FITC | Memory/Naive Discrimination |
| α4 | APC | Defines T-helper memory subset of interest |
| β7 | PE | Defines T-helper memory subset of interest |
| CD16/32 | — | Fc Block |

Results

Figure 39:
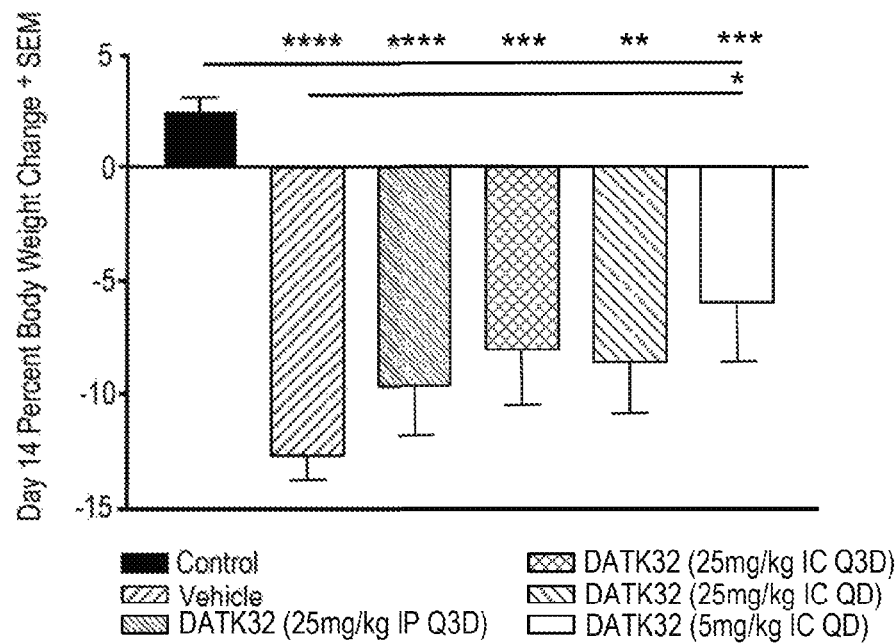
FIG. 39 is a graph showing the percentage (%) change in body weight at day 14 (±SEM) for DSS mice treated with DATK32 (anti-α4β7) antibody intraperitoneally (25 mg/kg) every third day (Q3D) or intracecally (25 mg/kg or 5 mg/kg) administered daily (QD), when compared to vehicle control (Vehicle) and when IC is compared to IP. Data presented as mean SEM. Mann-Whitney's U-test and Student's t-test were used for statistical analysis on non-Gaussian and Gaussian data respectively. A value of p<0.05 was considered significant (Graph Pad Software, Inc.).
Figure 40:
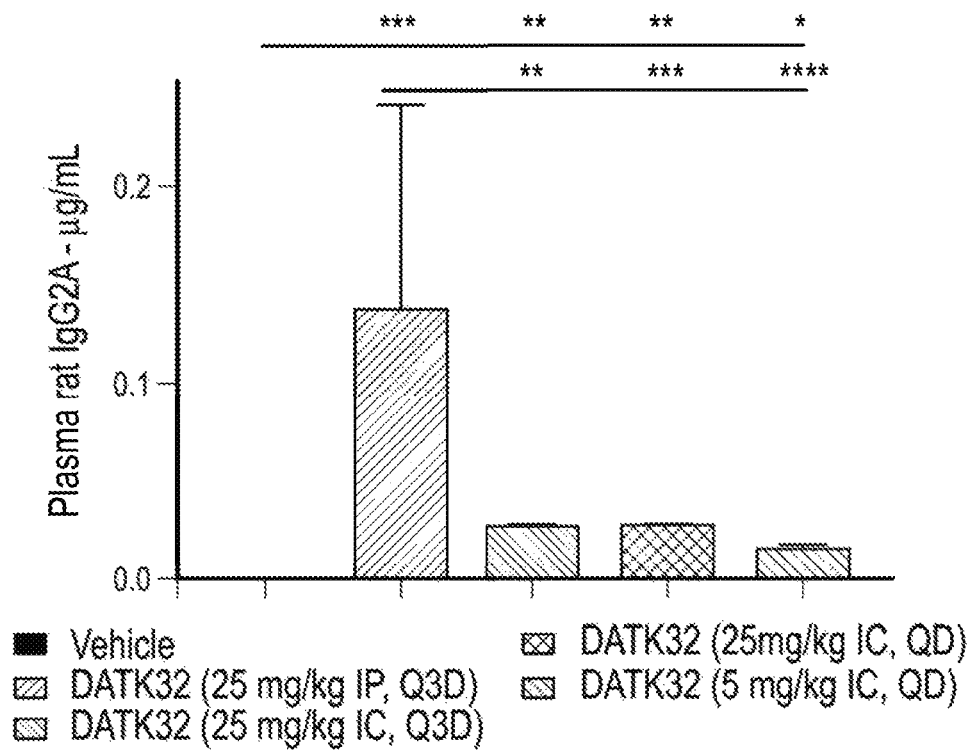
FIG. 40 is a graph showing the plasma concentration of DATK32 rat IgG2A (µg/mL) of intraperitoneally (25 mg/kg) and intracecally (25 mg/kg and 5 mg/kg) administered treatment groups given daily (QD) or every third day (Q3D), where IP is compared to IC. Data presented as mean±SEM. Mann-Whitney's U-test and Student's t-test were used for statistical analysis on non-Gaussian and Gaussian data respectively. A value of p<0.05 was considered significant (Graph Pad Software, Inc.).
Figure 41:
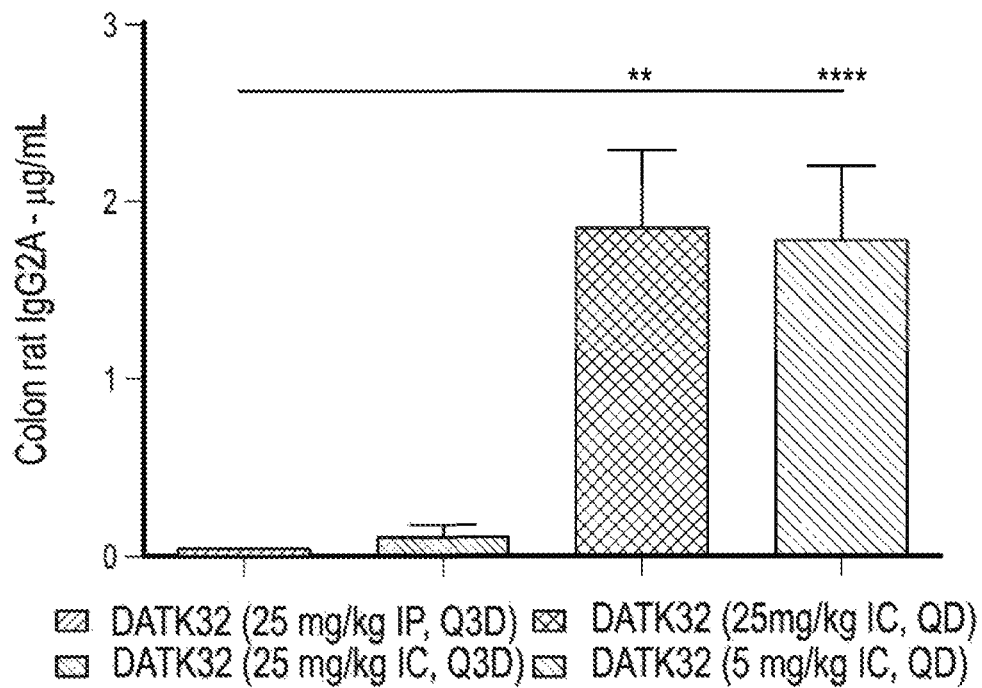
FIG. 41 is a graph showing the concentration of DATK32 rat IgG2A antibody (µg/mL) in cecum and colon content of intraperitoneally (25 mg/kg) or intracecally (25 mg/kg and 5 mg/kg) administered treatment groups given daily (QD) or every third day (Q3D), where IP is compared to IC. Data presented as mean±SEM. Mann-Whitney's U-test and Student's t-test were used for statistical analysis on non-Gaussian and Gaussian data respectively. A value of p<0.05 was considered significant (Graph Pad Software, Inc.).
Figure 42:
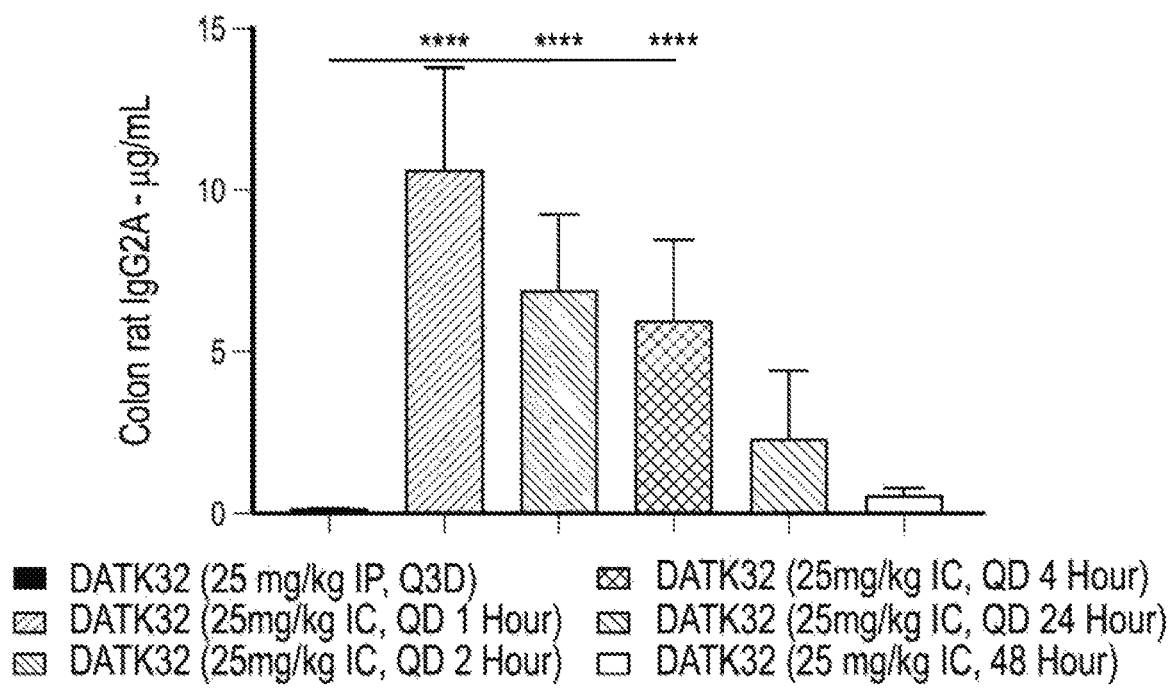
FIG. 42 is a graph showing the concentration of DATK32 rat IgG2A (µg/mL) in the colon content of intraperitoneally (25 mg/kg) or intracecally (25 mg/kg and 5 mg/kg) administered treatment groups given daily (QD), and concentration over time (1, 2, 4, 24, and 48 hours), where IP is compared to IC. Data presented as mean±SEM. Mann- Whitney's U-test and Student's t-test were used for statistical analysis on non-Gaussian and Gaussian data respectively. A value of p<0.05 was considered significant (Graph Pad Software, Inc.).
Figure 43:
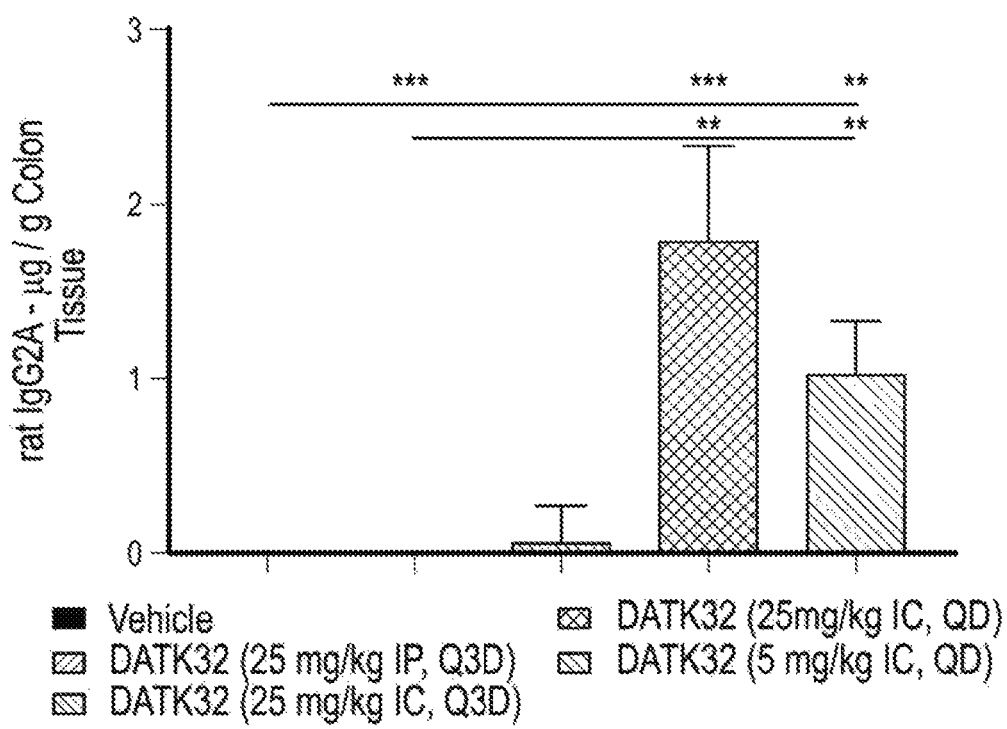
FIG. 43 is a graph showing the concentration of DATK32 rat IgG2A (μg/g) in colon tissue of intraperitoneally (25 mg/kg) or intracecally (25 mg/kg and 5 mg/kg) administered treatment groups given daily (QD) or every third day (Q3D), where IP is compared to IC. Data presented as mean±SEM. Mann-Whitney's U-test and Student's t-test were used for statistical analysis on non-Gaussian and Gaussian data respectively. A value of p<0.05 was considered significant (Graph Pad Software, Inc.).
Figure 44:
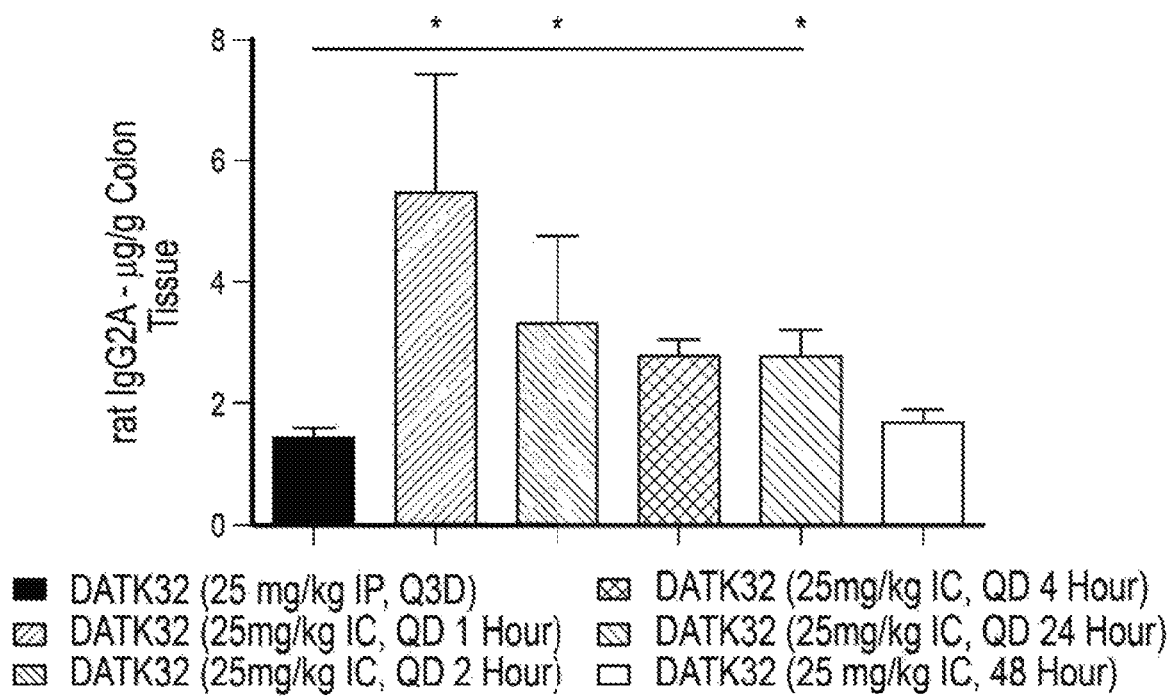
FIG. 44 is a graph showing the concentration of DATK32 rat IgG2A (μg/g) in the colon tissue of intraperitoneally (25 mg/kg) or intracecally (25 mg/kg and 5 mg/kg) administered treatment groups given daily (QD), and the concentration over time (1, 2, 4, 24, and 48 hours) was determined, where IP is compared to IC. Data presented as mean±SEM. Mann-Whitney's U-test and Student's t-test were used for statistical analysis on non-Gaussian and Gaussian data respectively. A value of p<0.05 was considered significant (Graph Pad Software, Inc.).
Figure 45:
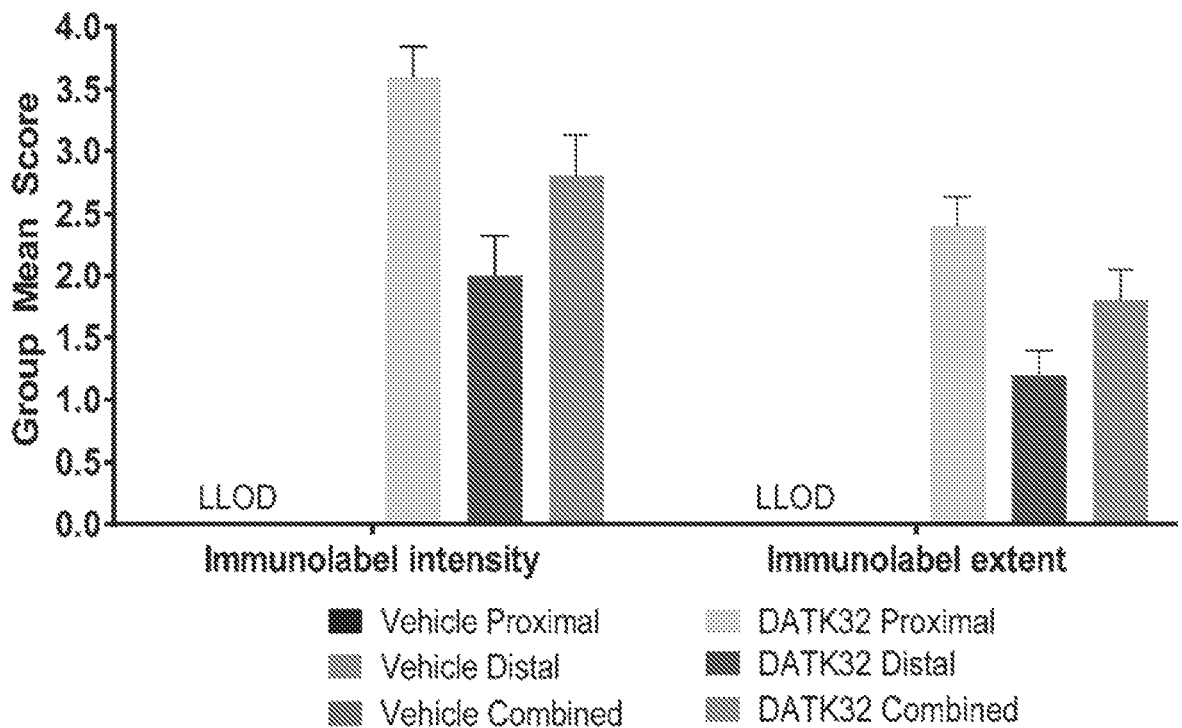
FIG. 45 is a graph showing the mean overall tissue immunolabel scores (intensity and extent) in acute DSS colitis mouse colon of DATK32 (anti-α4β7) antibody treated versus vehicle control (Vehicle) treated DSS mice. The data are presented as mean±SEM.
Figure 46:
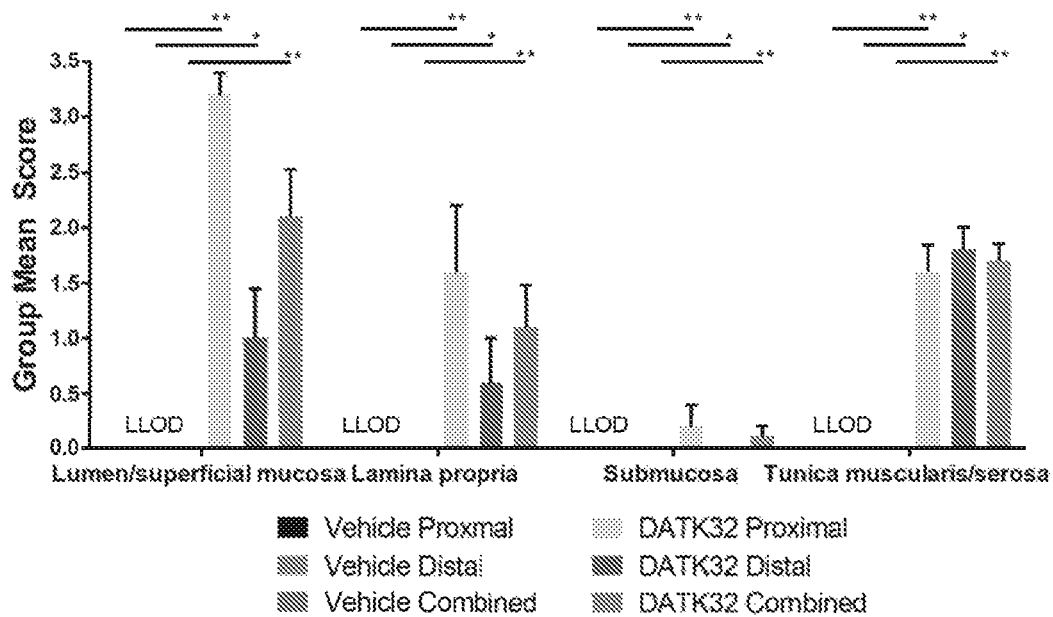
FIG. 46 is a graph showing the mean location-specific immunolabel scores in acute DSS colitis mouse colon of DATK32 (anti-α4β7) antibody-treated versus vehicle control (Vehicle)-treated DSS mice. Data presented as mean±SEM. Mann-Whitney's U-test and Student's t-test were used for statistical analysis on non-Gaussian and Gaussian data respectively. A value of p<0.05 was considered significant (Graph Pad Software, Inc.).
Figure 47:
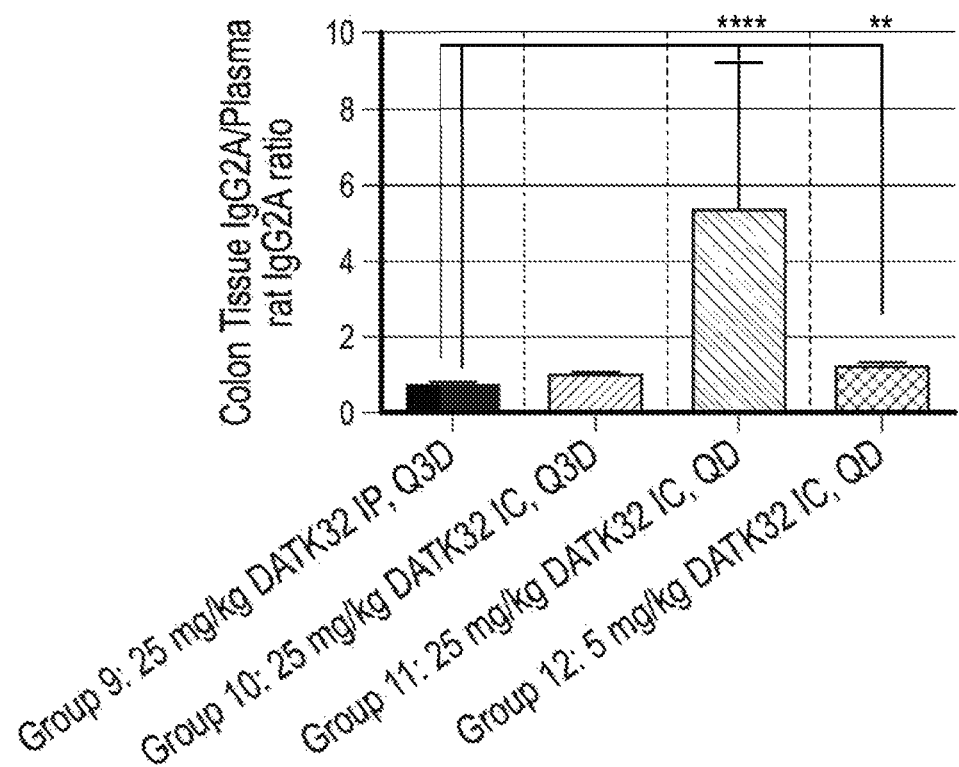
FIG. 47 is a graph showing the ratio of the DATK-32 antibody in the colon tissue to the plasma concentration of the DATK-32 antibody in mice treated with the DATK-32 antibody on day 0 (Q0) or day 3 (Q3D) of the study (Groups 9-12), when measured after initial dosing.

The data in FIG. 39 show decreased weight loss in DSS mice intracecally administered DATK antibody as compared to DSS mice that were intraperitoneally administered the DATK antibody. The data in FIG. 40 show that DSS mice intracecally administered DATK antibody have a decreased plasma concentration of DATK antibody as compared to DSS mice that were intraperitoneally administered DATK antibody. The data in FIGS. 41 and 42 show that DSS mice intracecally administered DATK antibody have an increased concentration of DATK antibody in the cecum and colon content as compared to DSS mice intraperitoneally administered DATK antibody. The data in FIGS. 43 and 44 show that DSS mice intracecally administered DATK antibody have an increased concentration of DATK antibody in colon tissue as compared to DSS mice intraperitoneally administered DATK antibody. The data in FIGS. 45 and 46 show an increased level of penetration of DATK antibody into colon tissue in DSS mice intracecally administered the DATK antibody as compared to an intracecal vehicle control (PBS). The data in FIG. 47 show that DSS mice intracecally administered DATK antibody have an increased ratio of the concentration of DATK antibody in colon tissue to the plasma concentration of the DATK antibody, as compared to the same ratio in DSS mice intraperitoneally administered the DATK antibody.

Figure 48:
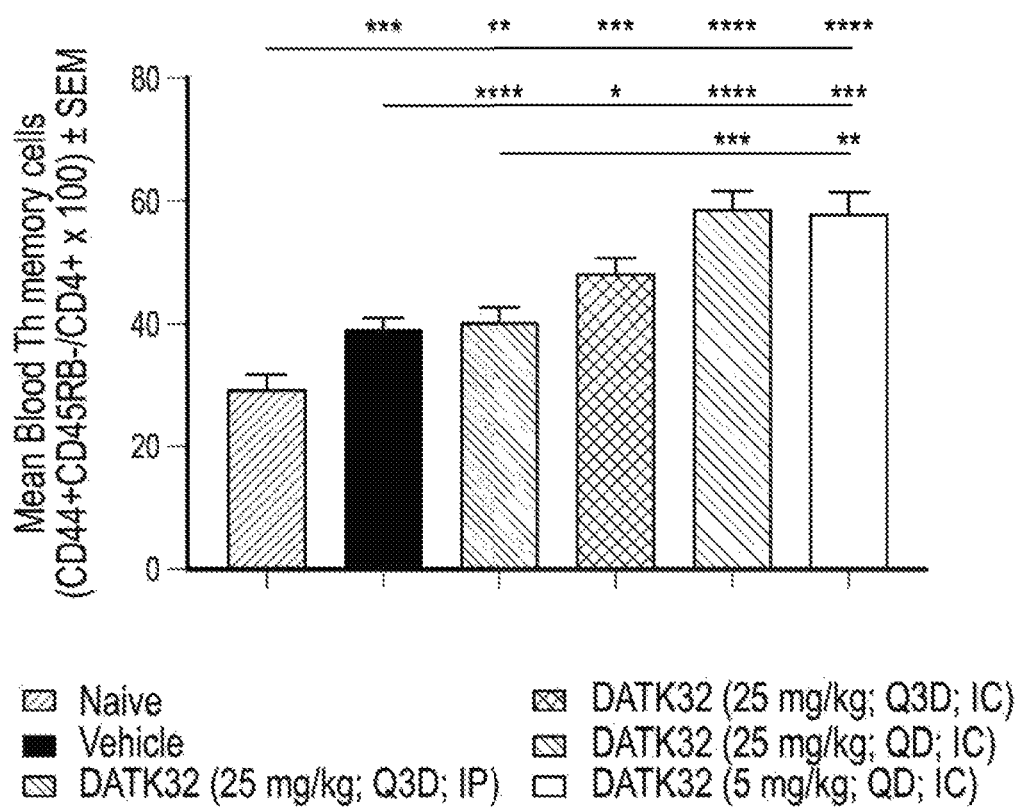
FIG. 48 is a graph showing the mean percentage of Th memory cells (mean±SEM) in blood for DATK32 (anti-α4β7) antibody intraperitoneally (25 mg/kg) or intracecally (25 mg/kg or 5 mg/kg) administered treatment groups given daily (QD) or every third day (Q3D), when compared to vehicle control (Vehicle) and when IP is compared to IC. Mean percentage Th memory cells were measured using FACS analysis. Data presented as mean±SEM. Mann-Whitney's U-test and Student's t-test were used for statistical analysis on non-Gaussian and Gaussian data respectively. A value of p<0.05 was considered significant (Graph Pad Software, Inc.).

The data in FIG. 48 show that DSS mice intracecally administered the DATK antibody have an increased percentage of blood Th memory cells as compared to DSS mice intraperitoneally administered the DATK antibody. The data in FIG. 101 show that the relative number of Peyer's Patch Th memory cells is decreased in the animals that were intracecally administered the DATK32 antibody as compared to the animals that were intraperitoneally administered the DATK32 antibody. The data in FIG. 102 show a decrease in the relative number of mesenteric lymph node (mLN) Th memory cells in the animals that were intracecally administered the DATK32 antibody as compared to the animals that were intraperitoneally administered the DATK32 antibody.

No significant differences in clinical observations or gastrointestinal-specific adverse effects, including stool consistency and/or bloody stool, were observed due to cannulation or intra-cecal treatments when compared with vehicle. No toxicity resulting from the treatments was reported. A significant reduction in body weight-loss was also found with DATK32 (5 mg/kg, QD) treatment (IC) when compared to vehicle control at the endpoint (day 14). The immunohistochemistry staining in DATK32 (25 mg/kg, QD) treatment groups showed penetration of DATK32 in all layers of colon tissue, including lumen mucosa, lamina propria, submucosa, tunica muscularis, via intra-cecal delivery. The distribution of DATK32 was found in all segments of the colon, however, higher levels were detected in the proximal region. A significantly higher mean concentration of DATK32 was found in gastrointestinal contents and colon tissues when delivered via intra-cecal administration (DATK32: 25 mg/kg and 5 mg/kg, QD) as compared to intraperitoneal administration (DATK32: 25 mg/kg, Q3D). The blood level of DATK32 was significantly higher when delivered via intraperitoneal administration (Q3D) as compared to intra-cecal administration (Q3D & QD). The pharmacokinetics of DATK32 (25 mg/kg, QD) showed significantly higher mean concentrations of DATK32 when delivered via intra-cecal administration at 1, 2, and 4 h post-dose in the gastrointestinal contents, and 1, 2, 4 and 24 h in colon tissue as compared with the mean concentrations of DATK32 following intraperitoneal administration. The mean number of gut-homing T cells (Th memory cells) was significantly higher in the blood of groups treated with DATK32 via intra-cecal administration (QD 25 mg/kg and QD 5 mg/kg) as compared to the groups treated with DATK32 via intraperitoneal administration (Q3D 25 mg/kg). The mean number of Th memory cells was significantly lower in the Peyer's Patches of groups treated with DATK32 via intra-cecal administration (QD 25 mg/kg and 5 mg/kg) as compared to the groups treated with DATK32 via intraperitoneal administration (Q3D 25 mg/kg). The mean number of Th memory cells in mesenteric lymph nodes (MLN) was significantly lower in groups treated with DATK32 via intra-cecal administration (QD and Q3D 25 mg/kg and QD 5 mg/kg) as compared to the groups treated with DATK32 via intraperitoneal administration (Q3D 25 mg/kg).

In sum, these data show that the compositions and devices provided herein can suppress the local immune response in the intestine, while having less of a suppressive effect on the systemic immune response of an animal. These data also show that the release of DATK-32 antibody in the colon can result in a suppression of leukocyte recruitment and may provide for the treatment of colitis and other pro-inflammatory diseases of the intestine.

Example 5—An Assessment of DATK32 Bio-Distribution Following Intracecal Administration in Male C57Bl/6 Mice The objective of this study is to assess DATK32 bio-distribution when dosed intracecally in male C57Bl/6 mice. A minimum of 10 days prior to the start of the experiment a cohort of animals will undergo surgical implantation of a cecal cannula. A sufficient number of animals will undergo implantation to allow for 24 cannulated animals to be enrolled in the main study (e.g., 31 animals). Animals were dosed with vehicle or test article via intracecal injection (IC)

on Day 0 as indicated in Table 3. Animals from all groups were sacrificed for terminal sample collection three hours following test article administration.

Materials and Methods

Mice

Normal male C57Bl/6 mice between the ages of 6-8 weeks old, weighing 20-24 g, were obtained from Charles River Laboratories. The mice were randomized into two groups of twelve animals, and housed in groups of 12 per cage, and acclimatized for at least three days prior to entering the study. Animal rooms were set to maintain a minimum of 12 to 15 air changes per hour, with an automatic timer for a light/dark cycle of 12 hours on/off, and fed with Labdiet 5053 sterile rodent chow, with water administered ad libitum.

Cecal Cannulation

The animals were placed under isoflurane anesthesia, with the cecum exposed via a midline incision in the abdomen. A small point incision was made in the distal cecum where 1-2 cm of the cannula was inserted. The incision was closed with a purse string suture using 5-0 silk. An incision was then made in the left abdominal wall through which the distal end of the cannula was inserted and pushed subcutaneously to the dorsal aspect of the back. The site was then washed copiously with warmed saline prior to closing the abdominal wall. A small incision was also made in the skin of the back between the shoulder blades, exposing the tip of the cannula. The cannula was secured in place using suture, wound clips, and tissue glue. All animals received 1 mL of warm sterile saline (subcutaneous injection) and were monitored closely until recovery before returning to their cage. All animals received 0.6 mg/kg BID buprenorphine for the first 3 days, and Baytril® at 10 mg/kg every day for the first 5 days post-surgery.

Dosing

Animals were dosed IC at a volume of 0.075 mL/animal on Days 0 as indicated in Table 16.

Sacrifice

All animals were euthanized by $CO_2$ inhalation three hours after dosing on Day 0.

Sample Collection

Terminal blood was collected and prepared for plasma using K2EDTA as the anti-coagulant. The plasma will be split into two cryotubes, with 50 µL in one tube (PK analysis) and the remainder in another (other). Both samples were flash-frozen in liquid nitrogen. Plasma was stored at −80° C. for downstream analysis. Mesenteric lymph nodes (mLN) were collected, weighed, and flash-frozen in liquid nitrogen. Mesenteric lymph nodes were stored at −80° C. for downstream analysis. The small intestine was excised and rinsed, and the most distal 1 cm of ilium was dissected, weighed, and flash-frozen in liquid nitrogen. The samples were stored at −80° C. for downstream analysis. The cecum and colon were removed from each animal and contents collected, weighed, and snap frozen in separate cryovials. The samples were stored at −80° C. for downstream analysis. The colon was rinsed, and the most proximal 1 cm of colon was weighed and flash-frozen in liquid nitrogen. The snap frozen tissues were stored at −80° C.

TABLE 16

Study Design

| Group | No Animals | Treatment | Route | Schedule | Terminal Collections Day 0 |
|---|---|---|---|---|---|
| 1 | 12 | Vehicle (PBS) | IC | Day 0 ** | Blood (plasma) Small intestine mLN |

TABLE 16-continued

Study Design

| Group | No Animals | Treatment | Route | Schedule | Terminal Collections Day 0 |
|---|---|---|---|---|---|
| 2 | 12 | DATK32 (625 µg)* | | | Colon Colon Contents Cecum Contents |

*Per mouse. TA was administered in 0.075 mL/animal. DATK32 was delivered in sterile PBS.
** Animals were dosed on Day 0 and collections were performed 3 hours later.

Results

The data in FIGS. 63A-63F show no significant differences in clinical observations. No gastrointestinal-specific or adverse effects were found in the group administered DATK32 via intra-cecal administration as compared to the group administered a vehicle control. No toxicity resulting from the treatments was reported. The level of DATK32 in the group intra-cecally administered DATK32 was significantly higher in cecum and colon content, and colon tissue compared to the group administered a vehicle control at 3 h post-dose. A small amount of DATK32 was also detected in plasma, small intestine, and mesenteric lymph node in the group intra-cecally administered DATK32.

Example 6—Pharmacokinectics/Pharmacodynamics and Bioavailability of Adalimumab When Applied to a TNBS-damaged Mucosal Surface (Induced Colitis) in Swine The purpose of this non-Good Laboratory Practice (GLP) study was to explore the PK/PD, and bioavailability of adalimumab when applied to a TNBS-damaged mucosal surface (induced colitis) in Yorkshire-Cross farm swine, and to determine an appropriate dose and frequency for studies where a drug will be delivered by the ingestible device system. The ingestible device system will be capable of delivering a TNF inhibitor (adalimumab) topically and locally to damaged mucosa in human patients with inflammatory bowel disease (IBD). The TNBS-induced colitis model was validated when a single administration on Day 1 of 40 mL of 100% ethanol (EtOH) mixed with 5 grams of TNBS diluted in 10 mL of water via an enema using a rubber catheter resulted in the intended reproducible induction of damaged mucosal surface (induced colitis) in Yorkshire-Cross farm swine.

This study investigated whether topical delivery of adalimumab would result in increased local mucosal tissue levels with limited drug reaching systemic circulation, as compared to subcutaneous administration; whether local mucosal tissue levels of drug would be greater in damaged tissues when compared to normal tissues; whether increasing the dose of drug would result in increased mucosal tissue levels in local and distal TNBS-damaged tissues; and whether topical delivery of adalimumab would result in reductions in inflammatory cytokines such as TNF-α in damaged tissues, feces, and possibly blood.

Figure 49:
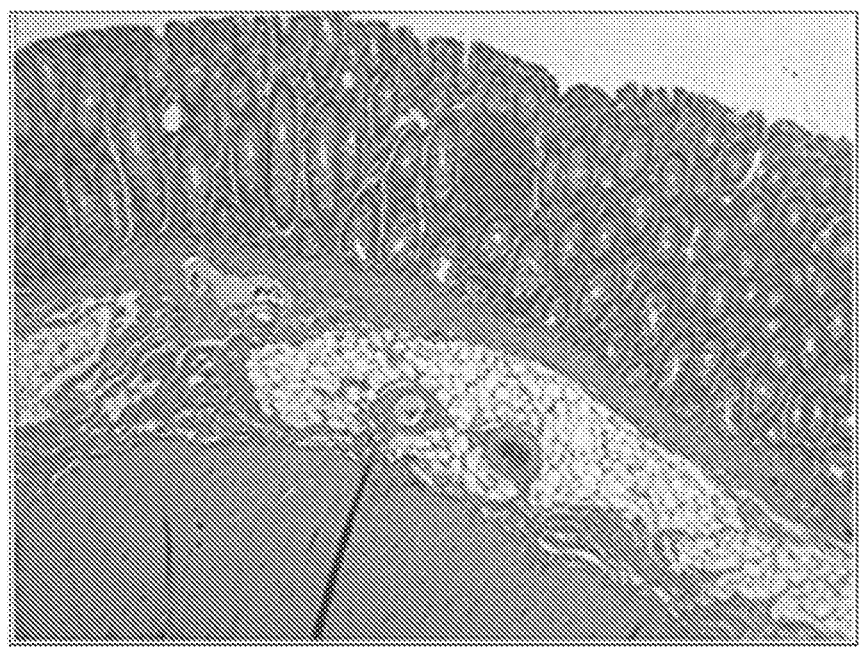
FIG. 49 is an exemplary image of a histological section of a distal transverse colon of Animal 1501 showing no significant lesions (i.e., normal colon).
Figure 50:
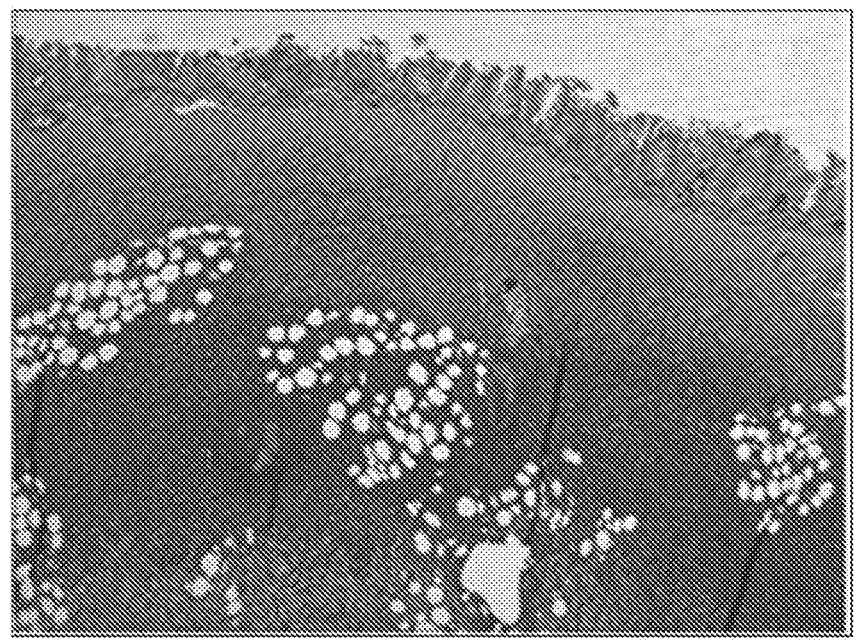
FIG. 50 is an exemplary image of a histological section of a distal transverse colon of Animal 2501 (treated with TNBS) showing areas of necrosis and inflammation.

All animals were subjected to intra-rectal administration of trinitrobenzene sulfonic acid (TNBS) to induce chronic colitis on day-2. All animals were fasted prior to colitis induction. Bedding was removed and replaced with rubber mats on day-3 to prevent ingestion of straw bedding material. The dose was 40 mL of 100% EtOH mixed with 5 grams of TNBS diluted in 10 mL of water, then instilled into the colon intra-rectally using a flexible gavage tube by a veterinary surgeon (deposited in a 10-cm portion of the distal colon and proximal rectum, and retained for 12 minutes by use of two Foley catheters with 60-mL balloons). Approximately 3 days after induction, macroscopic and microscopic alterations of colonic architecture were apparent: some necrosis, thickening of the colon, and substantial histologic changes were observed (FIGS. 49 and 50). The study employed 15 female swine (approximately 35 to 45 kg at study start) allocated to one of five groups. Group 1 employed three animals that were the treated controls. Each animal in Group 1 was administered adalimumab by subcutaneous injection at 40 mg in 0.8 mL saline. Groups 2, 3, 4, and 5 employed 3 animals in each group. Animals in these groups were administered intra-rectal adalimumab at 40 mg in 0.8 mL saline. The test drug (adalimumab) was administered to all groups on study day 1. The intra-rectal administrations (Groups 2-5) were applied to damaged mucosal surface of the bowel vial intra-rectal administration by a veterinary surgeon. Blood (EDTA) was collected from all animals (cephalic, jugular, or catheter) on day −3 (n=15), −1 (n=15), and 6 (n=15), 12 (n=12), 24 (n=9), and 48 (n=6) hours post-dose (87 bleeds total). The EDTA samples were split into two aliquots, and one was centrifuged for PK plasma, and stored frozen (−80° C.) for PK analyses and reporting. Fecal samples were collected for the same timepoints (87 fecal collections). Fecal samples were flash-frozen in liquid nitrogen and stored at −80° C. for analysis of drug levels and inflammatory cytokines. Groups 2, 3, 4, and 5 were euthanized and subjected to gross necropsy and tissue collection 6, 12, 24, and 48 hours post-dose, respectively. Group 1 was similarly euthanized and necropsied 48 hours post-dose. The animals were euthanized via injection of a veterinarian-approved euthanasia solution as per the schedule. Immediately after euthanasia in order to avoid autolytic changes, colon tissues were collected, opened, rinsed with saline, and a detailed macroscopic examination of the colon were performed to identify macroscopic findings related to TNBS-damage. Tissue samples were taken from the proximal, mid, and distal transverse colon; the dose site; and the distal colon. Each tissue sample was divided into two approximate halves; one tissue section was placed into 10% neutral buffered formalin (NBF) and evaluated by a Board certified veterinary pathologist, and the remaining tissue section was flash frozen in liquid nitrogen and stored frozen at −80° C. Clinical signs (ill health, behavioral changes, etc.) were recorded daily beginning on day-3. Additional pen-side observations were conducted once or twice daily. Animals observed to be in ill health were examined by a veterinarian. Body weight was measured for all animals on day −3, and prior to scheduled euthanasia. Table 17, depicted below, shows the study design.

Materials and Methods

Test Article

Adalimumab (EXEMPTIA™) is a tumor necrosis factor (TNF) inhibitor. A single dose was pre-filled in a syringe (40 mg in a volume of 0.8 mL).

TABLE 17

Study Design Table

| General | Sample size | Dose | Route | Days −3 | −2 | −1 | 1 | Hours 0.5 | 1 | 2 | 4 | 6 | 8 | 12 | 24 | 48 |
|---|---|---|---|---|---|---|---|---|---|---|---|---|---|---|---|---|
| Fast | | | | • | | | | | | | | | | | | |
| Food/Water | | ad libidum | oral | | • | • | • | • | • | • | • | • | • | • | • | • |
| Observations | | | | | | | | | | | | | | | | |
| clinical observations | | | | | • | • | • | • | | | | | | | • | • |
| body weight | | | | | • | | • | | | | | | | | • | • |
| Treatments (groups) | | | | | | | | | | | | | | | | |
| TNBS (all animals) | | | intra rectal | | | | • | | | | | | | | | |
| 1. Treated control | n = 3 | 40 mg in 0.8 mL saline | sub-cutaneous | | | | | • | | | | | | | | |
| euthanized | | | | | | | | | | | | | | | | n = 3 |
| 2. Adalimumab | n = 3 | 40 mg in 0.8 mL saline | intra rectal | | | | | • | | | | | | | | |
| euthanized | | | | | | | | | | | | n = 3 | | | | |
| 3. Adalimumab | n = 3 | 40 mg in 0.8 mL saline | intra rectal | | | | | • | | | | | | | | |
| euthanized | | | | | | | | | | | | | | n = 3 | | |
| 4. Adalimumab | n = 3 | 40 mg in 0.8 mL saline | intra rectal | | | | | • | | | | | | | | |
| euthanized | | | | | | | | | | | | | | | n = 3 | |
| 5. Adalimumab | n = 3 | 40 mg in 0.8 mL saline | intra rectal | | | | | • | | | | | | | | |
| euthanized | | | | | | | | | | | | | | | | n = 3 |
| Adalimumab (required) | | 600 | | | | | | | | | | | | | | |
| Samples | | | | | | | | | | | | | | | | |
| PBMCs | | | cephalic, jugularor catheter | | | • | | | | | | • | | • | • | • |
| Serum | | | cephalic, jugularor catheter | • | • | • | | | | | | • | | • | • | • |
| Fecal | | | rectal | | • | • | | | | | | • | | • | • | • |
| Tissue | | | necropsy | | | | | | | | | • | | • | • | • |
| Analysis | | | | | | | | | | | | | | | | |
| Histopathology | 1 location | 4 locations | | | | | | | | | | | | | | |
| inflammed | 45 | 180 | H&E | | | | | | | | | | | | | |
| normal | 45 | 180 | H&E | | | | | | | | | | | | | |

TABLE 17-continued

Study Design Table

| General | Sample size | Dose | Route | Days -3 | -2 | -1 | 1 | Hours 0.5 | 1 | 2 | 4 | 6 | 8 | 12 | 24 | 48 |
|---|---|---|---|---|---|---|---|---|---|---|---|---|---|---|---|---|
| Blood | | | | | | | | | | | | | | | | |
| adalimumab | 57 | | pbl | | | | 15 | | | | | 15 | | 12 | 9 | 6 |
| TNFα | 87 | | pbl | 15 | | 15 | 15 | | | | | 15 | | 12 | 9 | 6 |
| Feces | | | | | | | | | | | | | | | | |
| adalimumab | 57 | | pbl | | | | 15 | | | | | 15 | | 12 | 9 | 6 |
| TNFα | 87 | | pbl | 15 | | 15 | 15 | | | | | 15 | | 12 | 9 | 6 |
| Tissue Inflammed | | | | | | | | | | | | | | | | |
| adalimumab | 45 | 180 | pbl | | | | | | | | | 3 | | 3 | 3 | 6 |
| TNFα | 45 | 180 | pbl | | | | | | | | | 3 | | 3 | 3 | 6 |
| HER2 | 45 | 180 | pbl | | | | | | | | | 3 | | 3 | 3 | 6 |
| Normal | | | | | | | | | | | | | | | | |
| adalimumab | 45 | 180 | pbl | | | | | | | | | 3 | | 3 | 3 | 6 |
| TNFα | 45 | 180 | pbl | | | | | | | | | 3 | | 3 | 3 | 6 |
| HER2 | 45 | 180 | pbl | | | | | | | | | 3 | | 3 | 3 | 6 |

Results

Figure 51:
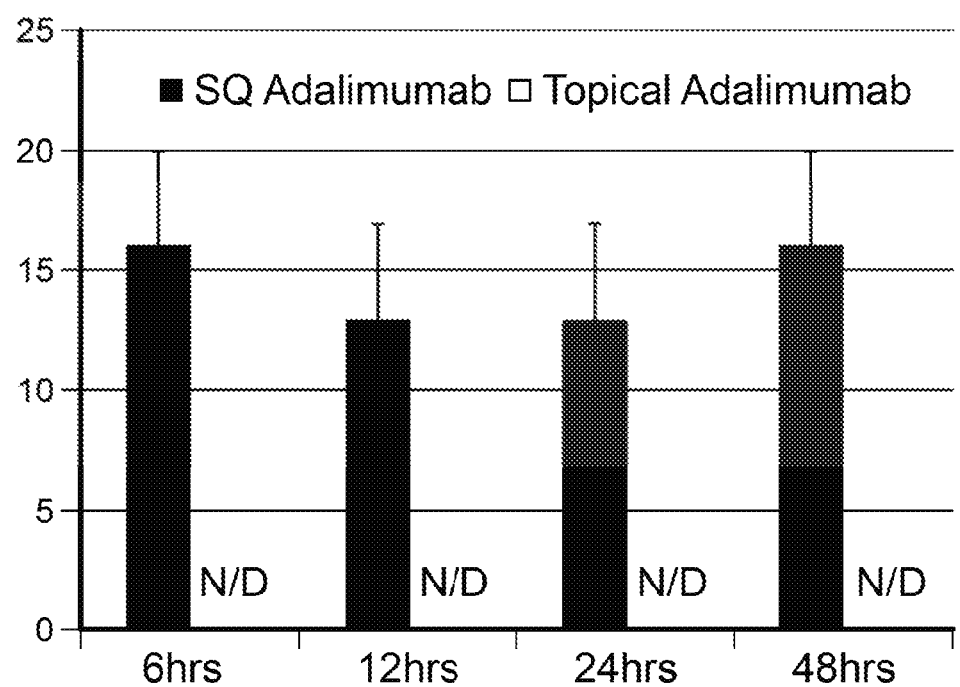
FIG. 51 is a representative graph of plasma adalimumab concentrations over time following a single subcutaneous (SQ) or topical administration of adalimumab. The plasma concentrations of adalimumab were determined 6, 12, 24, and 48 hours after administration of adalimumab. N/D=not detectable.
Figure 53:
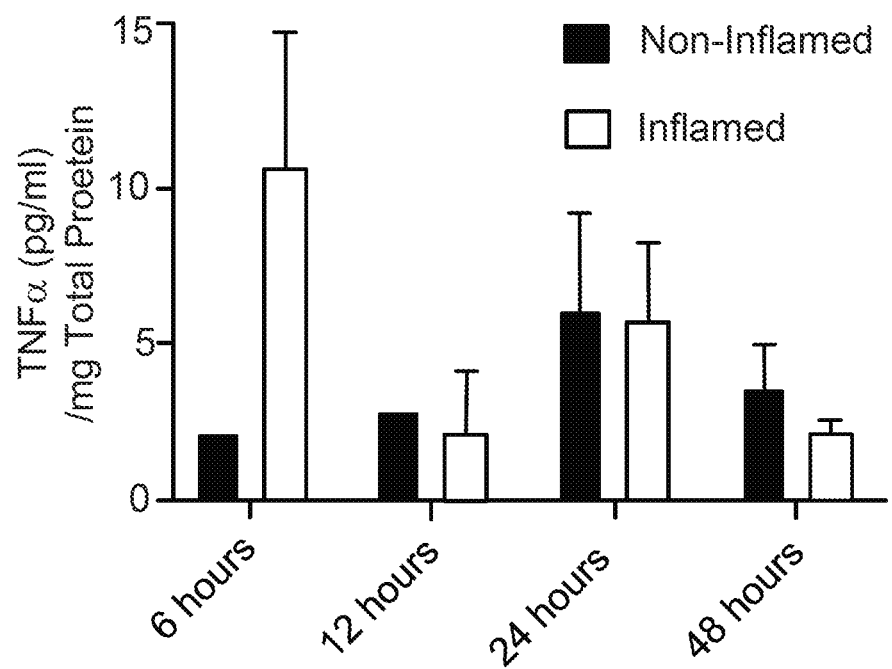
FIG. 53 is a graph showing the concentration of TNFα (pg/mL per mg of total protein) in non-inflamed and inflamed colon tissue after intracecal administration of adalimumab, as measured 6, 12, 24, and 24 hours after the initial dosing.
Figure 54:
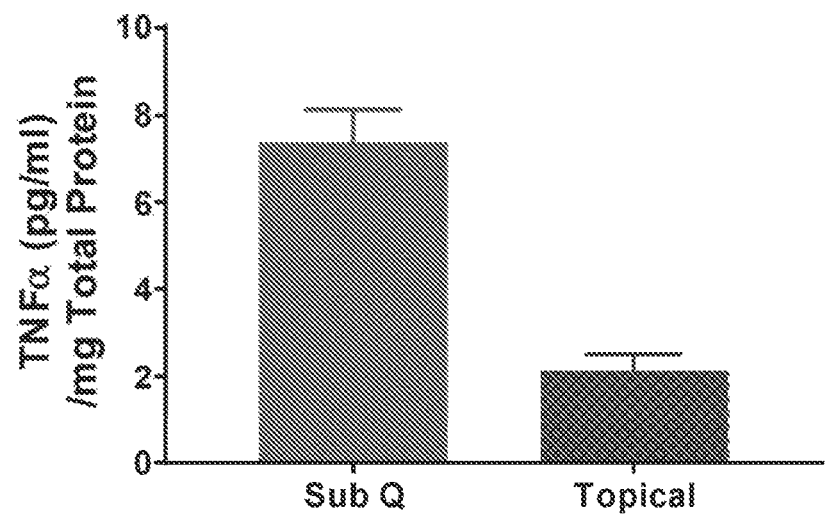
FIG. 54 is a graph showing the concentration of TNFα (pg/mL per mg of total protein) in colon tissue after subcutaneous or intracecal (topical) administration of adalimumab, as measured 48 hours after the initial dosing.

While subcutaneously administered adalimumab was detected at all times points tested in plasma, topically administered adalimumab was barely detectable in plasma (FIGS. 51 and 52). Both topical delivery and subcutaneous delivery of adalimumab resulted in reduced levels of TNF-α in colon tissue of TNBS-induced colitis animals, yet topical delivery of adalimumab was able to achieve a greater reduction in TNF-α levels (FIGS. 53 and 54).

Either subcutaneous or intra-rectal administration of adalimumab was well tolerated and did not result in death, morbidity, adverse clinical observations, or body weight changes. A decreased level of total TNBS-related inflammatory response was observed by adalimumab treatment via intra-rectal administration when applied to the damaged mucosal surface of the bowel when compared to subcutaneous delivery. A significantly higher concentration of adalimumab was measured in blood following subcutaneous delivery as compared to the blood concentration following intra-rectal administration. Intra-rectal administration of adalimumab decreased the total and normalized TNFα concentration over time (6~48h) and was more effective at reducing TNFα at the endpoint (48h) as compared to groups administered adalimumab subcutaneously.

In sum, these data show that the compositions and devices provided herein can suppress the local immune response in the intestine, while having less of a suppressive effect on the systemic immune response of an animal. For example, these data show that intracecal administration of adalimumab using a device as described herein can provide for local delivery of adalimumab to the site of disease, without suppressing the systemic immune response. These data also show that local administration of adalimumab using a device as described herein can result in a significant reduction of the levels of TNFα in diseases animals.

Example 7—Comparison of Systemic Versus Intracecal Delivery of Cyclosporin A

The objective of this study was to compare the efficacy of an immunosuppressant agent (cyclosporin A; CsA) when dosed systemically versus intracecally to treat dextran sulfate sodium salt (DSS)-induced colitis in male C57Bl/6 mice.

Experimental Design

A minimum of 10 days prior to the start of the experiment a cohort of animals underwent surgical implantation of a cecal cannula. A sufficient number of animals underwent implantation to allow for 44 cannulated animals to be enrolled in the main study (e.g., 76 animals). Colitis was induced in 60 male C5B1/6 mice by exposure to 3% DSS-treated drinking water from day 0 to day 5. Two groups of eight additional animals (cannulated and non-cannulated) served as no-disease controls (Groups 1 and 2). Animals were dosed with cyclosporin A via intraperitoneal injection (IP), oral gavage (PO), or intracecal injection (IC) from day 0 to 14 as indicated in Table 18. All animals were weighed daily and assessed visually for the presence of diarrhea and/or bloody stool at the time of dosing. Mice underwent video endoscopy on days 10 and 14 to assess colitis severity. Images were captured from each animal at the most severe region of disease identified during endoscopy. Additionally, stool consistency was scored during endoscopy using the parameters defined in Table 19. Following endoscopy on day 14, animals from all groups were sacrificed and underwent terminal sample collection.

Specifically, animals in all treatment groups dosed on day 14 were sacrificed at a pre-dosing time point, or 1, 2, and 4 hours after dosing (n=3/group/time point). Terminal blood was collected via cardiac puncture and prepared for plasma using K2EDTA as the anti-coagulant. The blood cell pellet was retained and snap frozen while the resulting plasma was split into two separate cryotubes, with 100 μL in one tube and the remainder in the second. Additionally, the cecum and colon were removed from all animals; the contents were collected, weighed, and snap frozen in separate cyrovials. The colon was then rinsed, measured, weighed, and then trimmed to 6 cm in length and divided into five pieces. The most proximal 1 cm of colon was snap frozen for subsequent bioanalysis of cyclosporin A levels. Of the remaining 5 cm of colon, the most distal and proximal 1.5-cm sections were each placed in formalin for 24 hours, then transferred to 70% ethanol for subsequent histological evaluation. The middle 2-cm portion was bisected longitudinally and placed into two separate cryotubes, weighed, and snap frozen in liquid nitrogen. All plasma and frozen colon tissue were stored at −80° C. for selected end point analysis. For all control animals in Groups 1-4, there was an additional collection of 100 μL of whole blood from all animals which was then processed for FACS analysis of α4 and β7 expression on TH memory cells. The details of the study are shown in Table 18.

Animals Found Dead or Moribund

Animals were monitored on a daily basis and those exhibiting weight loss greater than 30% were euthanized, and samples were not collected from these animals.

Endoscopy

Each mouse underwent video endoscopy on days 10 and 14 using a small animal endoscope (Karl Storz Endoskope, Germany) under isoflurane anesthesia. During each endoscopic procedure still images as well as video were recorded to evaluate the extent of colitis and the response to treat-

TABLE 18

Study Design

| Group Number | 1 | 2 | 3 | 4 | 13 | 14 | 15 |
|---|---|---|---|---|---|---|---|
| Number of Animals | 8 | 8 | 12 | 12 | 12 | 12 | 12 |
| Cecal Cannula | NO | YES | NO | YES | NO | YES | YES |
| DSS | N/A | N/A | 3% DSS on Day 0 to Day 5 | | | | |
| Treatment | none | none | vehicle | vehicle | CsA | CsA | CsA |
| Dose (mg/kg) | N/A | N/A | N/A | N/A | 10 | 10 | 3 |
| Route | N/A | N/A | N/A | N/A | PO | IC | IC |
| Dosing Schedule | N/A | N/A | QD: Day 0 to 14 | QD: Day 0 to 14 | QD: Day 0 to 14 | QD: Day 0 to 14 | QD: Day 0 to 14 |
| Endoscopy Schedule* | Days 10 and 14 | | | | | | |
| Endpoints | Endoscopy, Colon weight/length, stool score | | | | | | |
| Day 14 | Terminal Collection (all groups): Cecal contents, colon contents, plasma, and colon tissue FACS analysis collection of Groups 1-4: Whole blood for the following FACS panel: CD4, CD44, CD45RB, α4, β7, CD16/32 | | | | | | |
| PK | N = 3/time points | | | | | | |
| Sacrifice (Day 14) | At pre-dose and 1, 2, and 4 hours post-dosing | | | | | | |

*Animals were dosed once (QD) on Day 14 and plasma collected (K2EDTA) at pre-dosing, 1, 2, and 4 hours post-dosing from n = 3/group/time point. Each collection was terminal.

Experimental Procedures

Cecal Cannulation

Animals were placed under isoflurane anesthesia, and the cecum exposed via a mid-line incision in the abdomen. A small point incision was made in the distal cecum through which 1-2 cm of the cannula was inserted. The incision was closed with a purse-string suture using 5-0 silk. An incision was made in the left abdominal wall through which the distal end of the cannula was inserted and pushed subcutaneously to the dorsal aspect of the back. The site was washed copiously with warmed saline prior to closing the abdominal wall. A small incision was made in the skin of the back between the shoulder blades, exposing the tip of the cannula. The cannula was secured in place using suture, wound clips, and tissue glue. All animals received 1 mL of warm sterile saline (subcutaneous injection) and were monitored closely until fully recovered before returning to the cage. All animals received buprenorphine at 0.6 mg/kg BID for the first 3 days, and Baytril® at 10 mg/kg QD for the first 5 days following surgery.

Disease Induction

Colitis was induced on day 0 via addition of 3% DSS (MP Biomedicals, Cat #0260110) to the drinking water. Fresh DSS/water solutions were made on day 3 and any of the remaining original DSS solution was discarded.

Dosing

Animals were dosed by oral gavage (PO), intraperitoneal injection (IP), or intracecal injection (IC) at a volume of 0.1 mL/20 g on days 0 to 14 as indicated in Table 18.

Body Weight and Survival

Animals were observed daily (weight, morbidity, survival, presence of diarrhea, and/or bloody stool) in order to assess possible differences among treatment groups and/or possible toxicity resulting from the treatments.

ment. Additionally, we attempted to capture an image from each animal at the most severe region of disease identified during endoscopy. Colitis severity was scored using a 0-4 scale (0=normal; 1=loss of vascularity; 2=loss of vascularity and friability; 3=friability and erosions; 4=ulcerations and bleeding). Additionally, stool consistency was scored during endoscopy using the parameters defined in Table 19.

TABLE 19

Stool Consistency

| Score | Description |
|---|---|
| 0 | Normal, well-formed pellet |
| 1 | Loose stool, soft, staying in shape |
| 2 | Loose stool, abnormal form with excess moisture |
| 3 | Watery or diarrhea |
| 4 | Bloody diarrhea |

Tissue/Blood for FACS

Tissue and blood were immediately placed in FACS buffer (1× phosphate-buffered saline (PBS) containing 2.5% fetal calf serum (FCS)) and analyzed using the antibody panel in Table 20.

TABLE 20

FACS Antibody Panel

| Antibody Target | Fluorochrome | Purpose |
|---|---|---|
| CD4 | APC-Vio770 | Defines $T_H$ cells |
| CD44 | VioBlue | Memory/Naïve discrimination |
| CD45RB | FITC | Memory/Naïve discrimination |
| α4 | APC | Defines $T_H$-memory subset of interest |

TABLE 20-continued

FACS Antibody Panel

| Antibody Target | Fluorochrome | Purpose |
|---|---|---|
| β7 | PE | Defines $T_H$-memory subset of interest |
| CD16/32 | — | Fc block |

Results

Figure 55:
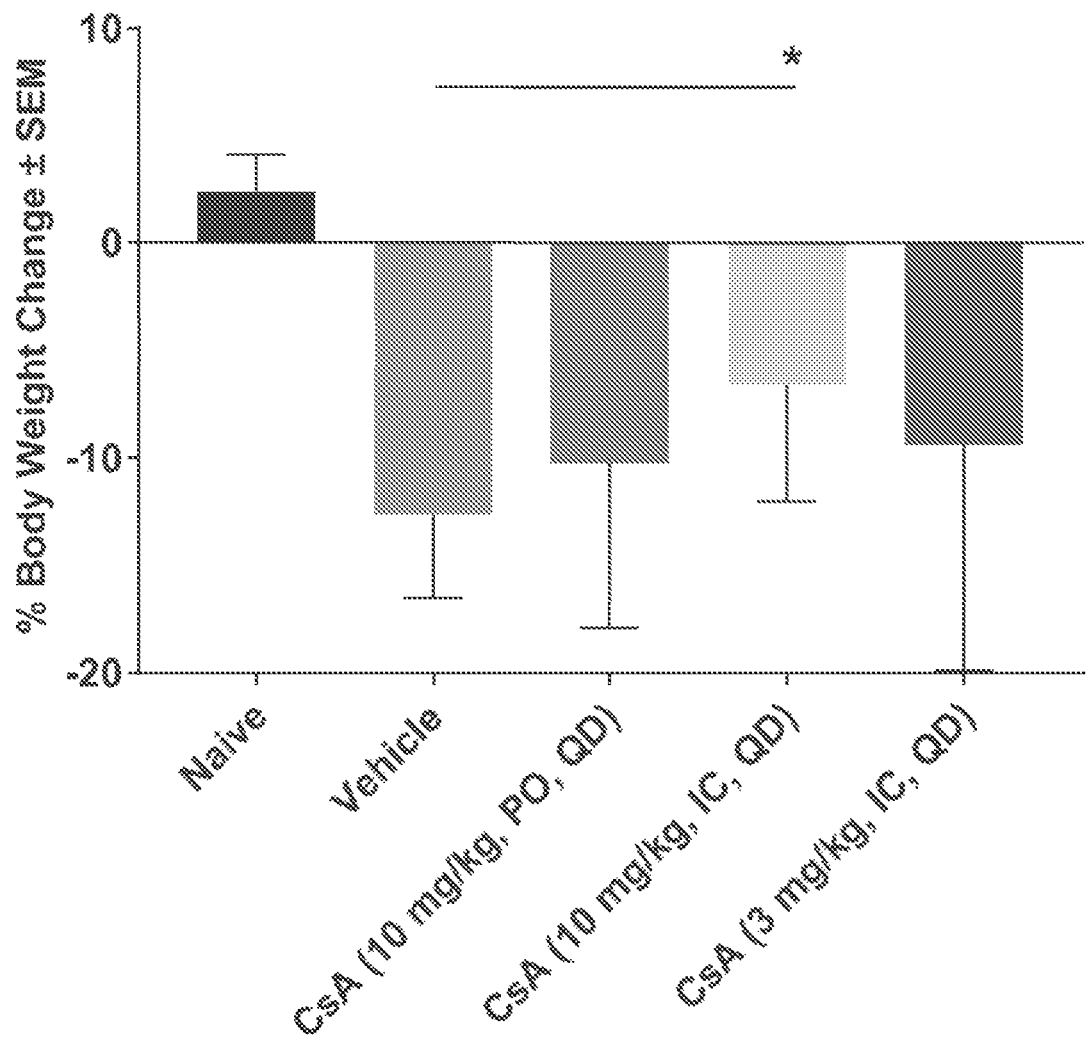
FIG. 55 is a graph showing the percentage (%) change in body weight at day 14 (±SEM) in acute DSS colitis mice treated with cyclosporin A (CsA) orally (10 mg/kg) every third day (Q3D) or intracecally (10 mg/kg or 3 mg/kg) daily (QD), when compared to vehicle control (Vehicle). Data presented as mean±SEM. Mann-Whitney's U-test and Student's t-test were used for statistical analysis on non-Gaussian and Gaussian data respectively. A value of p<0.05 was considered significant (Graph Pad Software, Inc.).
Figure 56:
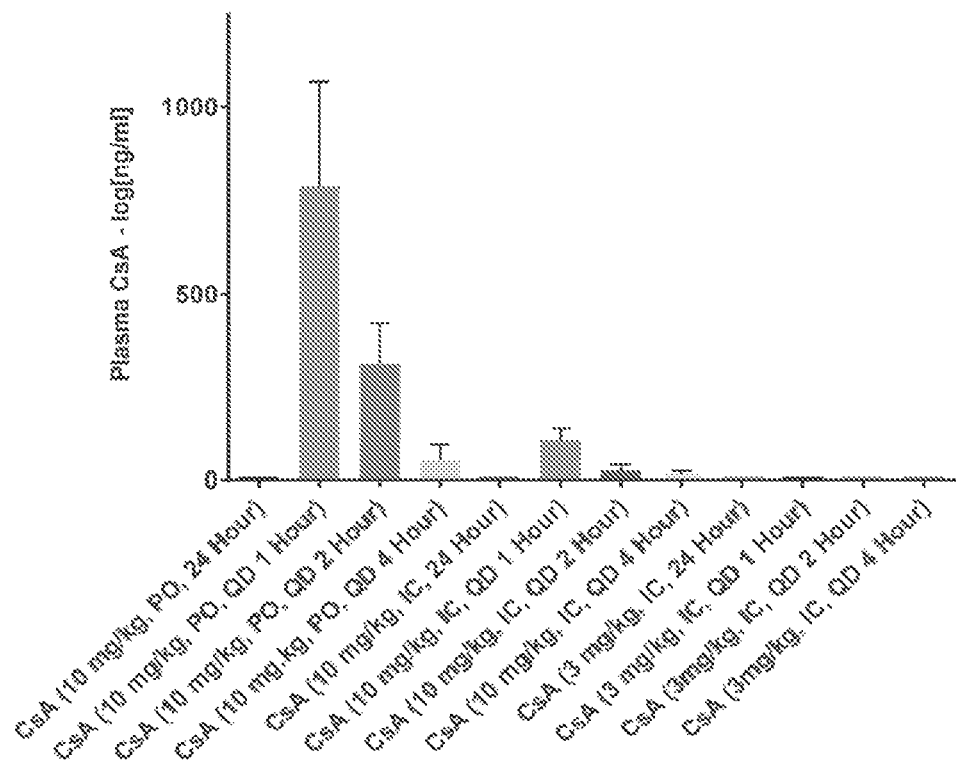
FIG. 56 is a graph showing the plasma cyclosporin A (CsA) (ng/mL) concentration over time (1 h, 2 h, 4 h, and 24 h) in acute DSS colitis mice treated daily (QD) with orally (PO) (10 mg/kg) or intracecally (IC) (10 mg/kg or 3 mg/kg) administered CsA. Data presented as mean±SEM.
Figure 57:
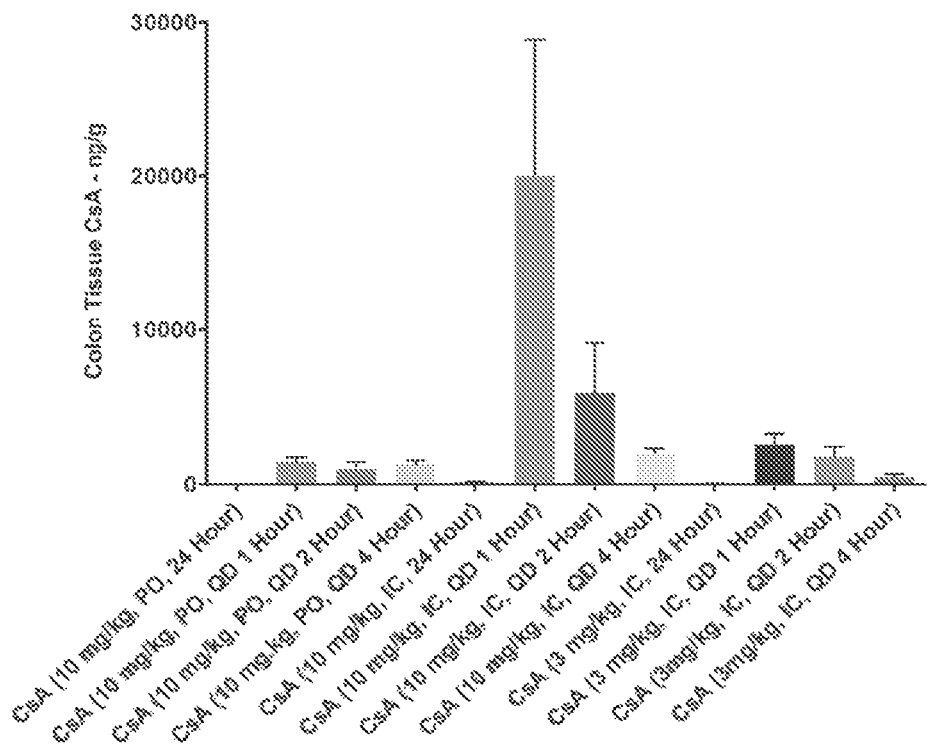
FIG. 57 is a graph showing the colon tissue cyclosporin A (CsA) (ng/g) concentration over time (1 h, 2 h, 4 h and 24 h) in acute DSS colitis mice treated daily (QD) with orally (PO) (10 mg/kg) or intracecally (IC) (10 mg/kg or 3 mg/kg) administered CsA. Data presented as mean±SEM.
Figure 58:
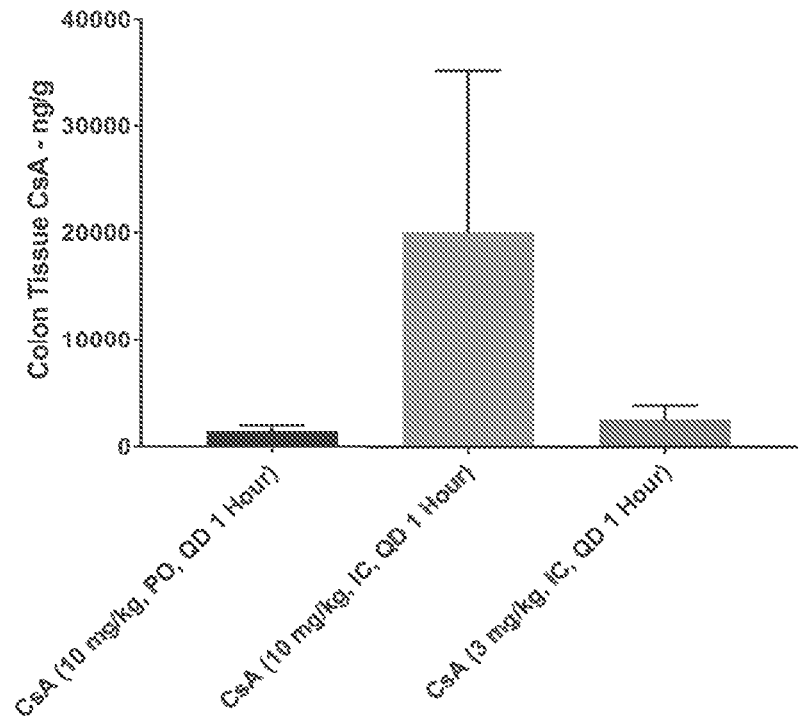
FIG. 58 is a graph showing the peak colon tissue cyclosporin A (CsA) (ng/g) concentration in acute DSS colitis mice treated daily (QD) with orally (PO) (10 mg/kg) or intracecally (IC) (10 mg/kg or 3 mg/kg) administered CsA. Data presented as mean±SEM.
Figure 59:
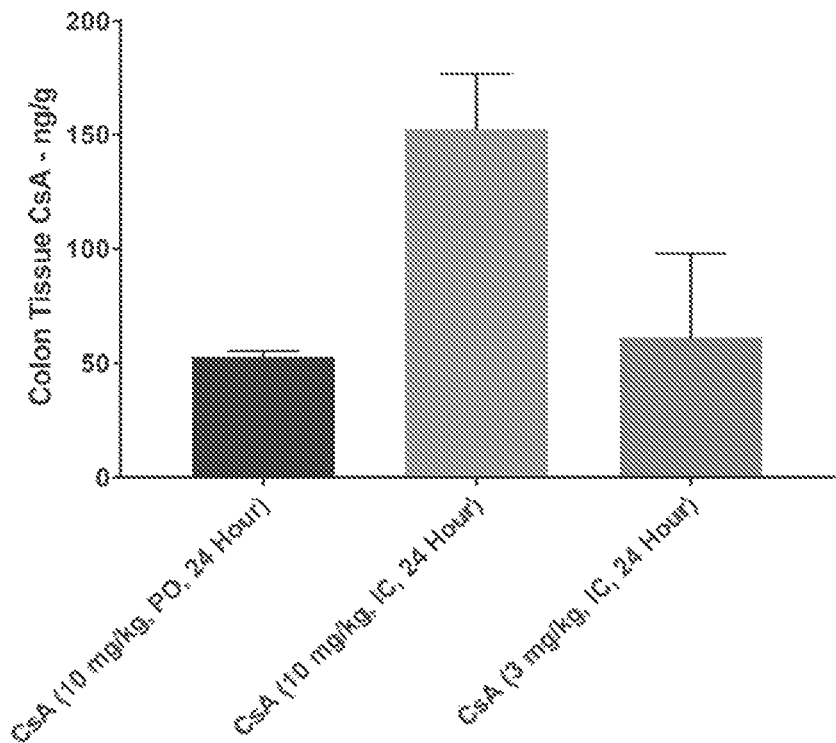
FIG. 59 is a graph showing the trough tissue concentration of cyclosporin (CsA) (ng/g) in colon of acute DSS colitis mice treated daily (QD) with orally (PO) (10 mg/kg) or intracecally (IC) (10 mg/kg or 3 mg/kg) administered CsA. Data presented as mean±SEM.

The data in FIG. 55 show a decrease in weight loss is observed in DSS mice intracecally administered cyclosporin A as compared to DSS mice orally administered cyclosporin A. The data in FIG. 56 show a decrease in plasma concentration of cyclosporin A in DSS mice intracecally administered cyclosporin A as compared to DSS mice orally administered cyclosporin A. The data in FIGS. 57-59 show an increased concentration of cyclosporin A in the colon tissue of DSS mice intracecally administered cyclosporin A as compared to the concentration of cyclosporin A in the colon tissue of DSS mice orally administered cyclosporin A.

Figure 60:
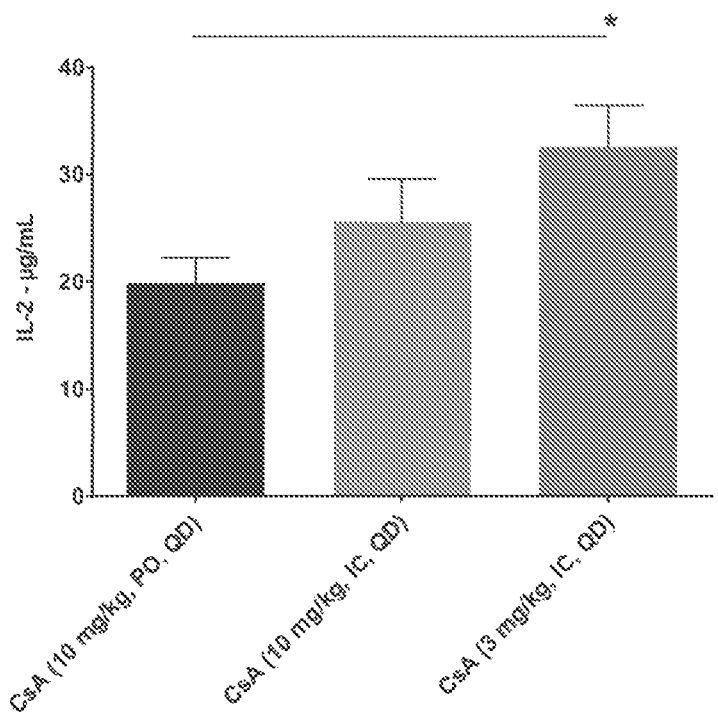
FIG. 60 is a graph showing the interleukin-2 (IL-2) concentration (μg/mL) in colon tissue of acute DSS colitis mice treated daily (QD) with orally (PO) (10 mg/kg) or intracecally (IC) (10 mg/kg or 3 mg/kg) administered CsA, where PO is compared to IC. Data presented as mean±SEM. Mann-Whitney's U-test and Student's t-test were used for statistical analysis on non-Gaussian and Gaussian data respectively. A value of p<0.05 was considered significant (Graph Pad Software, Inc.).
Figure 61:
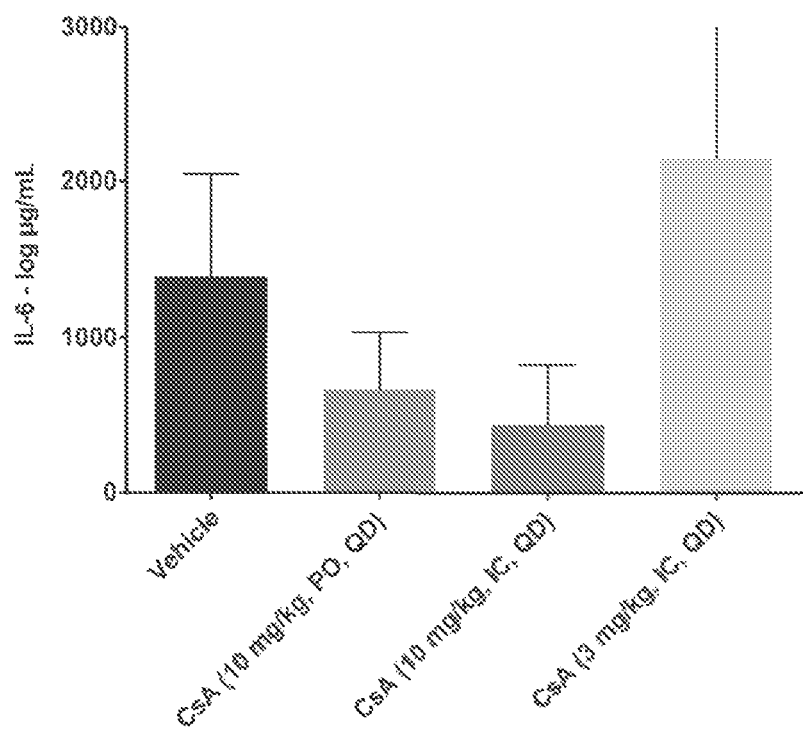
FIG. 61 is a graph showing the interleukin-6 (Il-6) concentration (μg/mL) in colon tissue of acute DSS colitis mice treated daily (QD) with orally (PO) (10 mg/kg) or intracecally (IC) (10 mg/kg or 3 mg/kg) administered CsA. Data presented as mean±SEM.

The data in FIG. 60 show that DSS mice intracecally administered cyclosporin A have an increased concentration of IL-2 in colon tissue as compared to DSS mice orally administered cyclosporin A. The data in FIG. 61 show that DSS mice intracecally administered cyclosporin A have a decreased concentration of IL-6 in colon tissue as compared to DSS mice orally administered cyclosporin A.

In sum, these data show that the compositions and devices provided herein can suppress the local immune response in the intestine, while having less of a suppressive effect on the systemic immune response of an animal. For example, these data demonstrate that the present compositions and devices can be used to release cyclosporin A to the intestine and that this results in a selective immune suppression in the colon, while having less of an effect on the immune system outside of the intestine. These data also suggest that the present compositions and devices will provide for the treatment of colitis and other pro-inflammatory disorders of the intestine.

Example 8—Bellows Testing: Drug Stability Bench Test

Experiments were run to evaluate the effects that bellows material would have on the function of a drug used as the dispensable substance. The experiments also evaluated the effects on drug function due to shelf life in the bellows.

Figure 64:
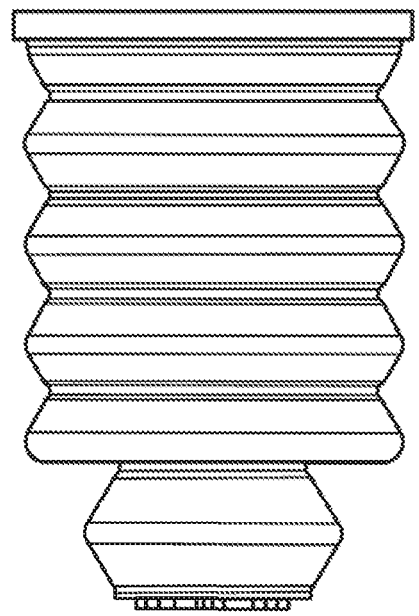
FIG. 64 illustrates a tapered silicon bellows.
Figure 65:
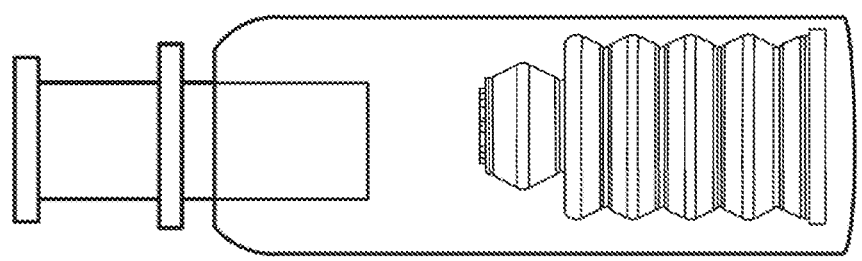
FIG. 65 illustrates a tapered silicone bellows in the simulated device jig.
Figure 66:
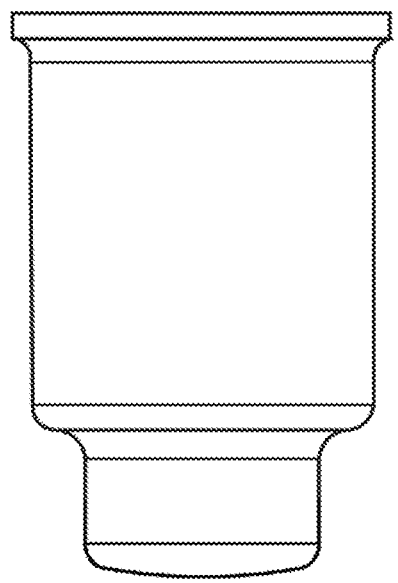
FIG. 66 illustrates a smooth PVC bellows.
Figure 67:
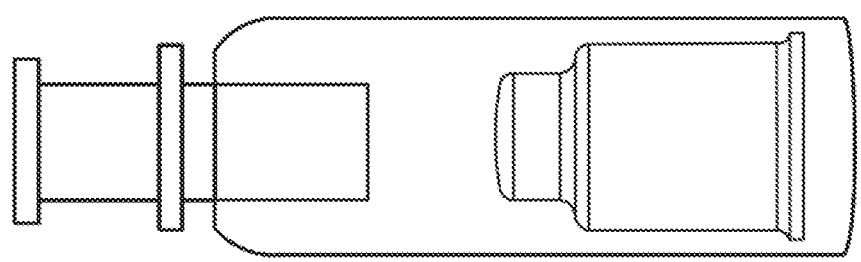
FIG. 67 illustrates a smooth PVC bellows in the simulated device jig.

The adalimumab was loaded into simulated device jigs containing either tapered silicone bellows or smooth PVC bellows and allowed to incubate for 4, 24, or 336 hours at room temperature while protected from light. FIG. 64 illustrates the tapered silicone bellows, and FIG. 65 illustrates the tapered silicone bellows in the simulated device jig. FIG. 66 illustrates the smooth PVC bellows, and FIG. 67 illustrates the smooth PVC in the simulated device jig.

Figure 68:
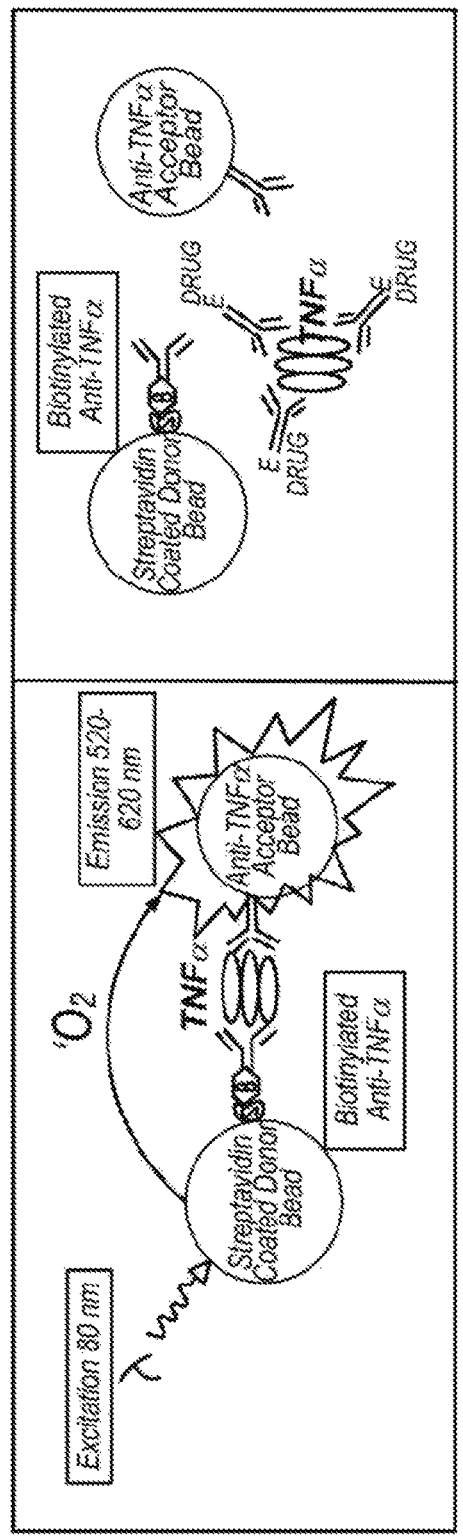
FIGS. 68A-68B demonstrate a principle of a competition assay performed in an experiment.

The drug was subsequently extracted using the respective dispensing systems and tested by a competitive inhibition assay. The test method has been developed from the literature (Velayudhan et al., "Demonstration of functional similarity of proposed biosimilar ABP501 to adalimumab" *BioDrugs* 30:339-351 (2016) and Barbeauct et al., "Application Note: Screening for inhibitors of TNFα/s TNFR1 Binding using AlphaScreen™ Technology." PerkinElmer Technical Note ASC-016. (2002)), as well as pre-testing development work using control drug and experiments using the provided AlphaLISA test kits. FIGS. 68A-68B demonstrate the principle of the competition assay performed in the experiment. FIG. 68A shows binding of anti-TNFα to TNFα receptor without drug, where uninhibited binding brings the Donor and Acceptor beads into close proximity for singlet oxygen transfer detection. FIG. 68B shows binding of anti-TNFα to TNFα that is inhibited by drug binding to TNFα and preventing binding to anti-TNFα antibodies, which prevents proximity oxygen singlet transfer detection.

The bellows were loaded as follows: aseptically wiped the dispensing port of the simulated ingestible device jig with 70% ethanol; allowed to air dry for one minute; used an adalimumab delivery syringe to load each set of bellows with 200 μL of drug; took a photo of the loaded device; gently rotated the device such that the drug is allowed to come in contact with all bellows surfaces; protected the bellows from light; and incubate at room temperature for the predetermined time period to allow full contact of the drug with all bellows' surfaces.

The drug was extracted as follows: after completion of the incubation period; the device jig was inverted such that the dispensing port was positioned over a sterile collection microfuge tube and petri dish below; five cubic centimeters of air was drawn into an appropriate syringe; the lure lock was attached to the device jig; the syringe was used to gently apply positive pressure to the bellow with air such that the drug was recovered in the collection microfuge tube; where possible, a video of drug dispensing was taken; samples were collected from each bellows type; a control drug sample was collected by directly dispensing 200 μL of drug from the commercial dispensing syringe into a sterile microfuge tube; the control drug-free sample was collected by directly dispensing 200 μL of PBS using a sterile pipette into a sterile microfuge tube; the collected drug was protected from light; and the drug was diluted over the following dilution range (250, 125, 25, 2.5, 0.25, 0.025, 0.0125, 0.0025 μg) in sterile PBS to determine the $IC_{50}$ range of the drug.

To determine any effects storage conditions may have on drug efficacy in the device, the drug (stored either in the syringe, silicon bellows, PVC bellows) was stored at room temperature while protected from light for 24 hours and 72 hours. Samples were then extracted and the steps in the preceding paragraph were repeated.

The AlphaLISA (LOCI™) test method was used. Human TNFα standard dilution ranges were prepared as described in Table 21.

TABLE 21

| Tube | Vol. of human TNFα (μL) | Vol. of diluent (μL) * | [human TNFα] in standard curve | |
|---|---|---|---|---|
| | | | (g/mL in 5 μL) | (pg/mL in 5 μL) |
| A | 10 μL of reconstituted human TNFα | 90 | 1E−07 | 100 000 |
| B | 60 μL of tube A | 140 | 3E−08 | 30 000 |
| C | 60 μL of tube B | 120 | 1E−08 | 10 000 |
| D | 60 μL of tube C | 140 | 3E−09 | 3 000 |
| E | 60 μL of tube D | 120 | 1E−09 | 1 000 |

TABLE 21-continued

| Tube | Vol. of human TNFα (μL) | Vol. of diluent (μL) * | [human TNFα] in standard curve (g/mL in 5 μL) | [human TNFα] in standard curve (pg/mL in 5 μL) |
|---|---|---|---|---|
| F | 60 μL of tube E | 140 | 3E−10 | 300 |
| G | 60 μL of tube F | 120 | 1E−10 | 100 |
| H | 60 μL of tube G | 140 | 3E−11 | 30 |
| I | 60 μL of tube H | 120 | 1E−11 | 10 |
| J | 60 μL of tube I | 140 | 3E−12 | 3 |
| K | 60 μL of tube J | 120 | 1E−12 | 1 |
| L | 60 μL of tube K | 140 | 3E−13 | 0.3 |
| M ** (background) | 0 | 100 | 0 | 0 |
| N ** (background) | 0 | 100 | 0 | 0 |
| O ** (background) | 0 | 100 | 0 | 0 |
| P ** (background) | 0 | 100 | 0 | 0 |

The test was performed as follows: the above standard dilution ranges were in a separate 96-well plate; to ensure consistent mixing, samples were mixed up and down gently with a pipette five times; a 384-well test plate was prepared according to the test layout diagram depicted Table 22; five microliters of 10,000 μg/mL TNFα standard from the previously made dilution plate was added to each corresponding concentration as shown in Table 21; five microliters of recovered drug (directly from the commercial syringe (A), from the silicone bellows (B Si), from the PVC bellows (B PVC), or from the PBS control (C) was added into the corresponding wells described in Table 22; the test plate was incubated for one hour at room temperature while protected from light; 10 microliters of acceptor beads were added to each previously accessed well; the wells were incubated for 30 minutes at room temperature while protected from light; 10 μL of biotinylated antibody was added to each previously accessed well; the wells were incubated for 15 minutes at room temperature, while protected from light; the room lights were darkened and 25 microliters of streptavidin (SA) donor beads were added to each previously accessed well; the wells were incubated for 30 minutes at room temperature while protected from light; the plate was read in Alpha Mode; and the results were recorded. Upon addition of reagent(s) in the various steps, each well was pipetted up and down three times to achieve good mixing.

TABLE 22

|   | 1 | 2 | 3 | 4 | 5 | 6 | 7 | 8 | 9 | 10 | 11 | 12 | 13 |
|---|---|---|---|---|---|---|---|---|---|---|---|---|---|
| A | STD2 |  | STD10 | 250 | 250 | 250 | 250 | 250 | 250 | 250 | 250 | 250 | 250 |
| B | 1.00E+05 |  | 10 | A | A | A | A | A | B Si | B Si | B Si | B Si | B Si |
| C | STD3 |  | STD11 | 125 | 125 | 125 | 125 | 125 | 125 | 125 | 125 | 125 | 125 |
| D | 30000 |  | 3 | A | A | A | A | A | B Si | B Si | B Si | B Si | B Si |
| E | STD4 |  | STD12 | 25 | 25 | 25 | 25 | 25 | 25 | 25 | 25 | 25 | 25 |
| F | 10000 |  | 1 | A | A | A | A | A | B Si | B Si | B Si | B Si | B Si |
| G | STD5 |  | STD13 | 2.5 | 2.5 | 2.5 | 2.5 | 2.5 | 2.5 | 2.5 | 2.5 | 2.5 | 2.5 |
| H | 3000 |  | 0.333 | A | A | A | A | A | B Si | B Si | B Si | B Si | B Si |
| I | STD6 |  | Blank | 0.25 | 0.25 | 0.25 | 0.25 | 0.25 | 0.25 | 0.25 | 0.25 | 0.25 | 0.25 |
| J | 1000 |  | 0 | A | A | A | A | A | B Si | B Si | B Si | B Si | B Si |
| K | STD7 |  | Blank | 0.025 | 0.025 | 0.025 | 0.025 | 0.025 | 0.025 | 0.025 | 0.025 | 0.025 | 0.025 |
| L | 300 |  | 0 | A | A | A | A | A | B Si | B Si | B Si | B Si | B Si |
| M | STD8 |  | Blank | 0.013 | 0.013 | 0.013 | 0.013 | 0.013 | 0.013 | 0.013 | 0.013 | 0.013 | 0.013 |
| N | 100 |  | 0 | A | A | A | A | A | B Si | B Si | B Si | B Si | B Si |
| O | STD9 |  | Blank | 0.003 | 0.003 | 0.003 | 0.003 | 0.003 | 0.003 | 0.003 | 0.003 | 0.003 | 0.003 |
| P | 30 |  | 0 | A | A | A | A | A | B Si | B Si | B Si | B Si | B Si |

|   | 14 | 15 | 16 | 17 | 18 | 19 | 20 | 21 | 22 | 23 |
|---|---|---|---|---|---|---|---|---|---|---|
| A | 250 | 250 | 250 | 250 | 250 | 250 | 250 | 250 | 250 | 250 |
| B | B PVC | B PVC | B PVC | B PVC | B PVC | C | C | C | C | C |
| C | 125 | 125 | 125 | 125 | 125 | 125 | 125 | 125 | 125 | 125 |
| D | B PVC | B PVC | B PVC | B PVC | B PVC | C | C | C | C | C |
| E | 25 | 25 | 25 | 25 | 25 | 25 | 25 | 25 | 25 | 25 |
| F | B PVC | B PVC | B PVC | B PVC | B PVC | C | C | C | C | C |
| G | 2.5 | 2.5 | 2.5 | 2.5 | 2.5 | 2.5 | 2.5 | 2.5 | 2.5 | 2.5 |
| H | B PVC | B PVC | B PVC | B PVC | B PVC | C | C | C | C | C |

TABLE 22-continued

| | | | | | | | | | | |
|---|---|---|---|---|---|---|---|---|---|---|
| I | 0.25 B PVC | 0.25 B PVC | 0.25 B PVC | 0.25 B PVC | 0.25 B PVC | 0.25 C | 0.25 C | 0.25 C | 0.25 C | 0.25 C |
| J | | | | | | | | | | |
| K | 0.025 B PVC | 0.025 B PVC | 0.025 B PVC | 0.025 B PVC | 0.025 B PVC | 0.025 C | 0.025 C | 0.025 C | 0.025 C | 0.025 C |
| L | | | | | | | | | | |
| M | 0.013 B PVC | 0.013 B PVC | 0.013 B PVC | 0.013 B PVC | 0.013 B PVC | 0.013 C | 0.013 C | 0.013 C | 0.013 C | 0.013 C |
| N | | | | | | | | | | |
| O | 0.003 B PVC | 0.003 B PVC | 0.003 B PVC | 0.003 B PVC | 0.003 B PVC | 0.003 C | 0.003 C | 0.003 C | 0.003 C | 0.003 C |
| P | | | | | | | | | | |

Figure 69:
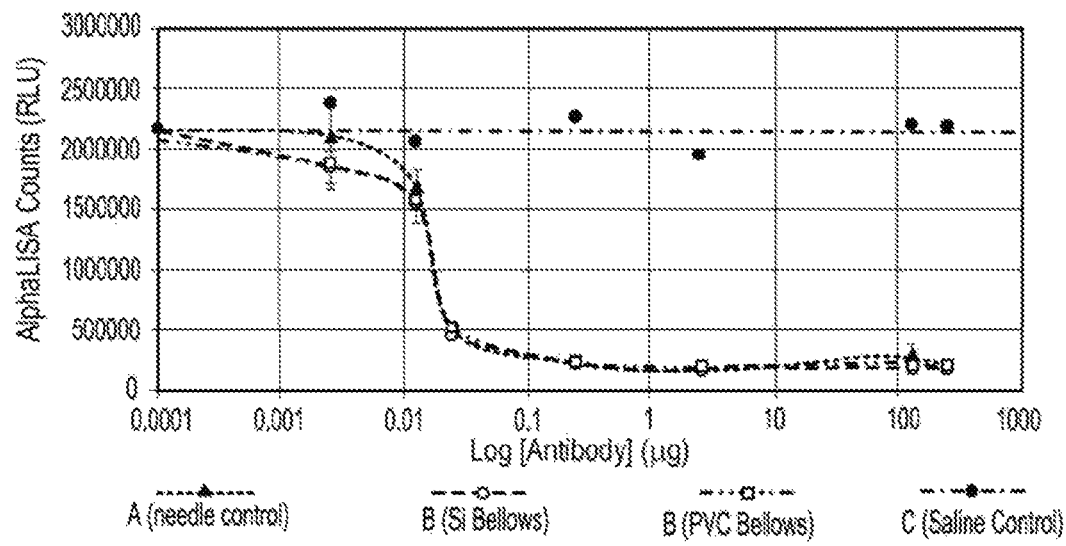
FIG. 69 shows AlphaLISA data. Dose response curves after 4 hours exposure show drug (Exemptia® (adalimumab biosimilar)) binding to TNFα (10,000 pg) of drug dispensed from a standard injector, Si bellows or PVC bellows.
Figure 70:
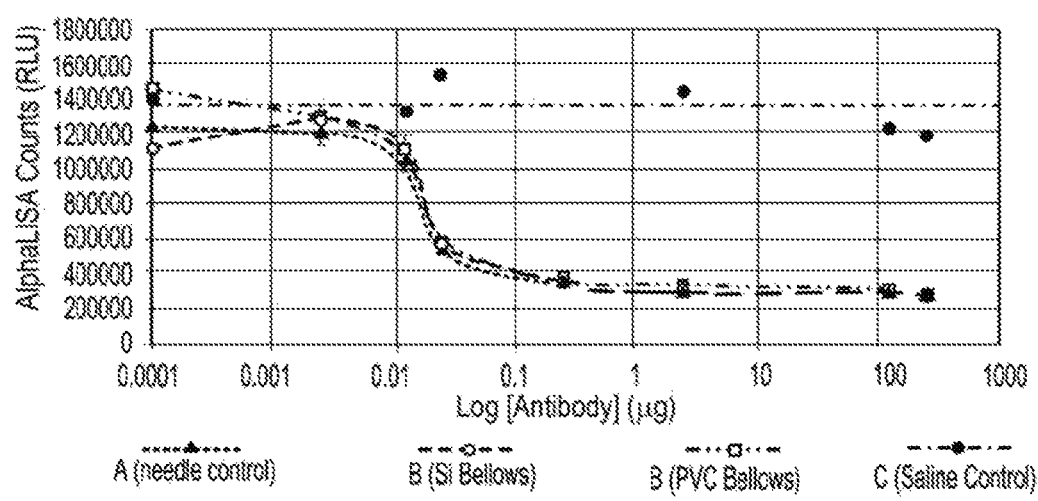
FIG. 70 shows AlphaLISA data. Dose response curves after 24 hours exposure show drug (Exemptia® (adalimumab biosimilar)) binding to TNFα (10,000 pg) of drug dispensed from a standard injector, Si bellows or PVC bellows.
Figure 71:
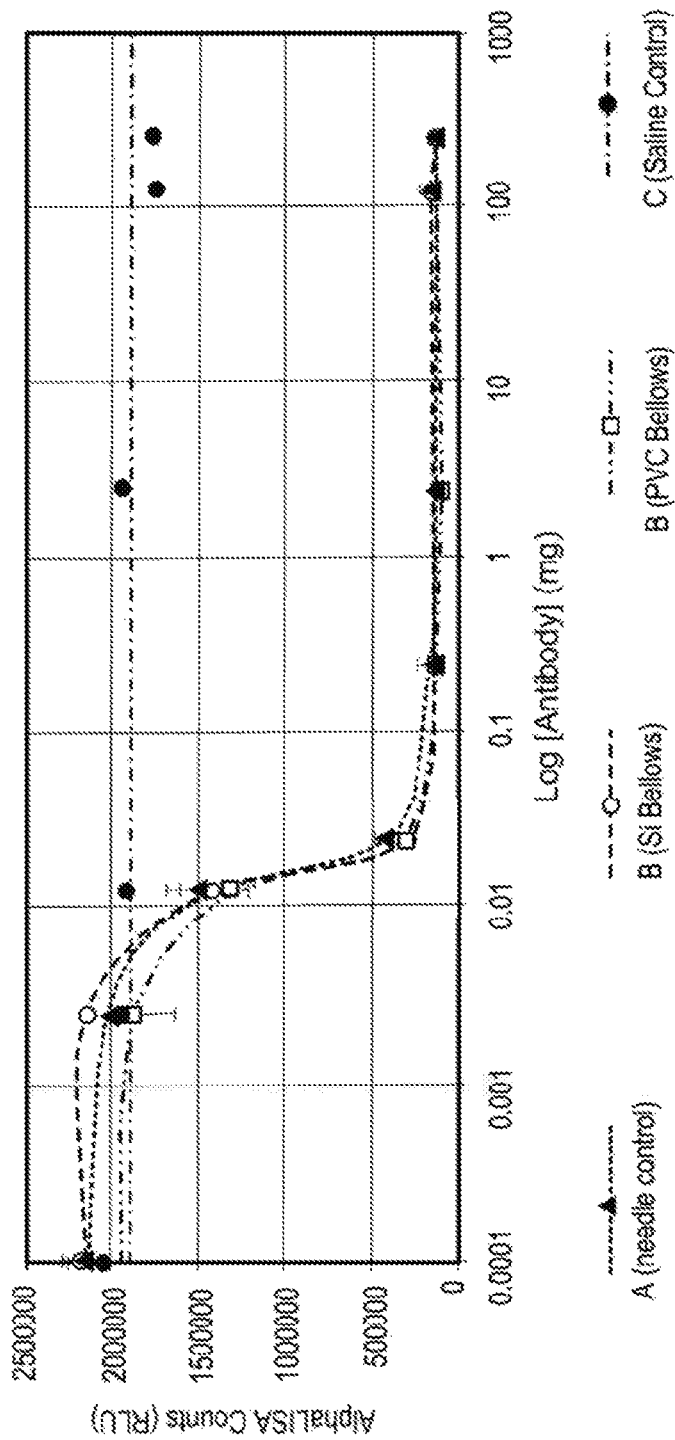
FIG. 71 shows AlphaLISA data. Dose response curves after 336 hours exposure show drug (Exemptia® (adalimumab biosimilar)) binding to TNFα (10,000 pg) of drug dispensed from a standard injector, Si bellows or PVC bellows.

The data are shown in FIGS. 69-71. The data demonstrate that the bellows do not negatively impact the drug function after shelf lives of 4 hours, 24 hours, or 336 hours. The $IC_{50}$ values of the drug dispensed from the bellows were comparable to the $IC_{50}$ values of the standard dispensation method (Table 21). A slight right shift was noted in the bellows curves after 24 hours (FIG. 70), but this shift was well within the error bars of the curves. Tables 23-26 represent data of FIGS. 69-71, respectively. Of note, when comparing mean (n=5) RFU data between test articles over the concentration ranges significant differences ($p<0.05$) were discerned. However, these significant differences did not favor either test article over time, suggesting that they were not related to the performance of the material in response to the drug (FIGS. 69-71).

TABLE 23

| | Needle control (A) | Silicone Bellows (B) | PVC Bellows C |
|---|---|---|---|
| 4 Hours | 0.0174 | 0.0169 | 0.0172 |
| 24 Hours | 0.0180 | 0.0180 | 0.0180 |
| 336 Hours | 0.0144 | 0.0159 | 0.0163 |

TABLE 24

Statistics (Student's T-test, 2 tailed, non-pair-wise, for significance $p < 0.05$)

| Drug (micrograms) | Needle control (A) vs. Silicone (B) | Needle control (A) vs. PVC | Silicone vs. PVC |
|---|---|---|---|
| 0.0001 | 0.911 | 0.008* | 0.268 |
| 0.0025 | 0.138 | 0.390 | 0.822 |
| 0.0125 | 0.122 | 0.118 | 0.771 |
| 0.025 | 0.143 | 0.465 | 0.020* |
| 0.25 | 0.591 | 0.984 | 0.350 |
| 2.5 | 0.243 | 0.124 | 0.169 |
| 125 | 0.867 | 0.688 | 0.182 |
| 250 | 0.681 | 0.184 | 0.108 |

*$p < 0.5$ data set

TABLE 25

Statistics (Student's T-test, 2 tailed, non-pair-wise, for significance $p < 0.05$)

| Drug (micrograms) | Needle control (A) vs. Silicone (B) | Needle control (A) vs. PVC | Silicone vs. PVC |
|---|---|---|---|
| 0.0001 | 0.132 | 0.038* | 0.292 |
| 0.0025 | 0.003* | 0.076 | 0.575 |
| 0.0125 | 0.161 | 0.022* | 0.783 |
| 0.025 | 0.058 | 0.078 | 0.538 |
| 0.25 | 0.974 | 0.384 | 0.198 |
| 2.5 | 0.714 | 0.080 | 0.017* |
| 125 | 0.873 | 0.731 | 0.269 |
| 250 | 0.798 | 0.956 | 0.903 |

*$p < 0.5$ data set

TABLE 26

Statistics (Student's T-test, 2 tailed, non-pair-wise, for significance $p < 0.05$)

| Drug (micrograms) | Needle control (A) vs. Silicone (B) | Needle control (A) vs. PVC | Silicone vs. PVC |
|---|---|---|---|
| 0.0001 | 0.858449 | 0.036847* | 0.026444* |
| 0.0025 | 0.087379 | 0.280302 | 0.046767* |
| 0.0125 | 0.469282 | 0.057232 | 0.117194 |
| 0.025 | 0.02758* | 0.078234 | 0.373419 |
| 0.25 | 0.411548 | 0.258928 | 0.400498 |
| 2.5 | 0.368959 | 0.156574 | 0.006719* |
| 125 | 0.948649 | 0.246702 | 0.463735 |
| 250 | 0.485046 | 0.128993 | 0.705543 |

*$p < 0.5$ data set

Example 9—A Comparison Study of Systemic vs Intracecal Delivery of SMAD7 Bio-Distribution in DSS-Induced Colitis in Male C57Bl/6 Mice The objective of this study was to compare the efficacy of novel test articles, e.g., fluorescent SMAD7 antisense oligonucleotides (SMAD7 AS), when dosed systemically versus intracecally in the treatment of DSS-induced colitis, in male C57Bl/6 mice.

Experimental Design

A minimum of 10 days prior to the start of the experiment a cohort of animals underwent surgical implantation of a cecal cannula. A sufficient number of animals underwent implantation to allow for 12 cannulated animals to be enrolled in the main study (i.e., 16 animals).

Colitis was induced in 12 male C57Bl/6 mice (Groups 4-5) by exposure to 3% DSS-treated drinking water from Day 0 to Day 5. Three groups of six additional animals per group (n=6 cannulated; n=12 non-cannulated; Groups 1-3) served as no-disease controls (Groups 1-3). All animals were weighed daily and assessed visually for the presence of diarrhea and/or bloody stool during this time.

Animals were dosed with test-article via oral gavage (PO) or intracecal injection (IC) once on Day 9 as indicated in Table 27. The animals in Group 0 were not dosed. The animals in Groups 2 and 4 were dosed PO with SMAD7 antisense. The animals in Groups 3 and 5 were dosed IC with SMAD7 antisense.

All animals were euthanized by $CO_2$ inhalation 12 hours after dosing, on Day 10. Terminal blood was collected into two K2EDTA tubes and processed for plasma. Both plasma and pellet samples were snap-frozen in liquid nitrogen and stored at −80° C. Cecum contents were removed and the contents were split into two aliquots. Both aliquots were weighed and snap frozen in separate cryovials in liquid nitrogen. The cecum was excised and bisected longitudinally; each piece is separately weighed and flash-frozen in liquid nitrogen. The colon contents were removed and the contents were split into two aliquots. Both aliquots were weighed and snap frozen in separate cryovials in liquid nitrogen. The colon was then rinsed, and the most proximal 2 cm of colon was collected. This 2-cm portion was bisected longitudinally; each piece was separately weighed and flash-frozen in liquid nitrogen. Snap-frozen blood pellet, cecum/colon contents, and tissue samples were used for downstream fluorimetry or RP-HPLC. The details of the study design are shown in Table 27.

tored closely until recovery before returning to their cage. All animals were administered 0.6 mg/kg BID buprenorphine for the first 3 days, and Baytril® at 10 mg/kg every day for the first 5 days post-surgery.

Disease Induction

Colitis was induced on Day 0 via addition of 3% DSS (MP Biomedicals, Cat #0260110) to the drinking water. Fresh DSS/water solutions was provided on Day 3 and any of the remaining original DSS solution is discarded.

Body Weight and Survival

Animals were observed daily (weight, morbidity, survival, presence of diarrhea and/or bloody stool) in order to assess possible differences among treatment groups and/or possible toxicity resulting from the treatments.

Animals Found Dead or Moribund

Animals were monitored on a daily basis. Animals exhibiting weight loss greater than 30% were euthanized, and samples were not collected from these animals.

Dosing

Animals were dosed with test-article via oral gavage (PO) or intracecal injection (IC) once on Day 9 as indicated in Table 12. Animals in Group 0 were not dosed. Animals in

TABLE 27

Study design

| Group | № Animals | Cecal Cannula | Colitis Induction | Treatment | Route | Schedule | Terminal Collections Day 10 |
|---|---|---|---|---|---|---|---|
| 1 | 6 | NO | — | — | — | — | Whole blood, |
| 2 | 6 | NO | | Fluorescently | PO | QD | plasma, cecal |
| 3 | 6 | YES | | labeled | IC | Day 9** | contents, colon |
| 4 | 6 | NO | 3% DSS | SMAD7 | PO | | contents, cecal |
| 5 | 6 | YES | Days 0-5 | antisense 50 μg* | IC | | tissue colon tissue |

*Per mouse. TA is administered in 0.075 mL/animal.
**Animals are dosed on Day 9 and collections are performed 12 hours later.

Materials and Methods

Mice

Normal male C57Bl/6 mice between the ages of 6-8 weeks old, weighing 20-24 g, were obtained from Charles River Laboratories. The mice were randomized into five groups of six mice each, and housed in groups of 8-15 per cage, and acclimatized for at least three days prior to entering the study. Animal rooms were set to maintain a minimum of 12 to 15 air changes per hour, with an automatic timer for a light/dark cycle of 12 hours on/off, and fed with Labdiet 5053 sterile rodent chow, with water administered ad libitum.

Cecal Cannulation

The animals were placed under isoflurane anesthesia, with the cecum exposed via a midline incision in the abdomen. A small point incision was made in the distal cecum, where 1-2 cm of the cannula was inserted. The incision was closed with a purse string suture using 5-0 silk. An incision was then made in the left abdominal wall through which the distal end of the cannula was inserted and pushed subcutaneously to the dorsal aspect of the back. The site was then washed copiously with warmed saline prior to closing the abdominal wall. A small incision was also made in the skin of the back between the shoulder blades, exposing the tip of the cannula. The cannula was secured in place using suture, wound clips, and tissue glue. All animals were administered 1 mL of warm sterile saline (subcutaneous injection) and were moni- Groups 2 and 4 were dosed PO with SMAD7 antisense. Animals in Groups 3 and 5 were dosed IC with SMAD7 antisense.

Sacrifice

All animals were euthanized by $CO_2$ inhalation 12 hours after dosing, on Day 10.

Sample Collection

Intestinal contents, peripheral blood and tissue were collected at sacrifice on Day 10, as follows:

Blood/Plasma

Terminal blood was collected into two K2EDTA tubes and processed for plasma. The approximate volume of each blood sample was recorded prior to centrifugation. Both plasma and pellet samples were snap-frozen in liquid nitrogen and stored at −80° C. The first pellet sample (sample 1) was used for fluorimetry. The second pellet sample (sample 2) was used for RP-HPLC.

Cecum Contents

Cecum contents was removed and contents were split into two aliquots. Both aliquots were weighed and snap frozen in separate cryovials in liquid nitrogen. The first sample (sample 1) was used for fluorimetry. The second sample (sample 2) was used for RP-HPLC.

Cecum

The cecum was excised and bisected longitudinally; each piece was separately weighed and snap-frozen. The first sample (sample 1) was used for fluorimetry. The second sample (sample 2) was used for RP-HPLC.

Colon Contents

Colon contents were removed and contents were split into two aliquots. Both aliquots were weighed and snap frozen in separate cryovials in liquid nitrogen. The first sample (sample 1) was used for fluorometry. The second sample (sample 2) was used for RP-HPLC.

Colon

The colon was rinsed, and the most proximal 2 cm of colon was collected and bisected longitudinally. Each piece was separately weighed and flash-frozen in liquid nitrogen. The first sample (sample 1) was used for fluorometry. The second sample (sample 2) was used for RP-HPLC.

SMAD7 Antisense Bioanalysis

Samples flash-frozen for fluorimetry were homogenized in 0.5 mL buffer RLT+ (Qiagen). Homogenate was centrifuged (4000× g; 10 minutes), and supernatant was collected. Forty microliters of the sample was diluted 1:6 in 200 µL of bicarbonate solution and 100 µL of diluted supernatant was analyzed on a fluorescent plate reader (485 excitation; 535 emission) in duplicate.

Prior to the above, assay development was performed as follows. Samples (as indicated in Sample Collection) were harvested from a naïve animal and flash-frozen. Samples were then homogenized in 0.5 mL buffer RLT+, homogenate was centrifuged (4000×g; 10 minutes) and supernatant was collected and diluted 1:6 with bicarbonate solution (i.e., 0.5 mL supernatant was added to 2.5 mL of PBS). An aliquot (0.200 mL (90 µL for each duplicate) of each diluted sample was pipetted into 15 (14 dilution of FAM-AS-SAMD7+ blank control) Eppendorf tubes. One tube was set-aside to be used as a blank sample. Ten microliters of fluorescently-labeled SMAD7 antisense was then spiked into all other sample to achieve final concentrations of 50 µg/mL, 16.67 µg/mL, 5.56 µg/mL, 1.85 µg/mL, 0.62 µg/mL, 0.21 µg/mL, 0.069 µg/mL, 0.023 µg/mL, 7.6 ng/mL, 2.5 ng/mL, 0.847 ng/mL, 0.282 ng/mL, 0.094 ng/mL, and 0.024 ng/mL respectively. The fluorescently-labeled SMAD7 antisense was prepared and serially diluted such that the volume added to each organ homogenate sample was the same for each of the above concentrations. These samples were analyzed on a fluorescent plate reader (485 excitation; 535 emission) in duplicate.

Processing for RP-HPLC

Samples flash-frozen for RP-HPLC were homogenized in buffer RLT+ (Qiagen). Homogenate was centrifuged (4000× g; 10 minutes), and supernatant was used to perform RP-HPLC analysis.

Results

Figure 73:
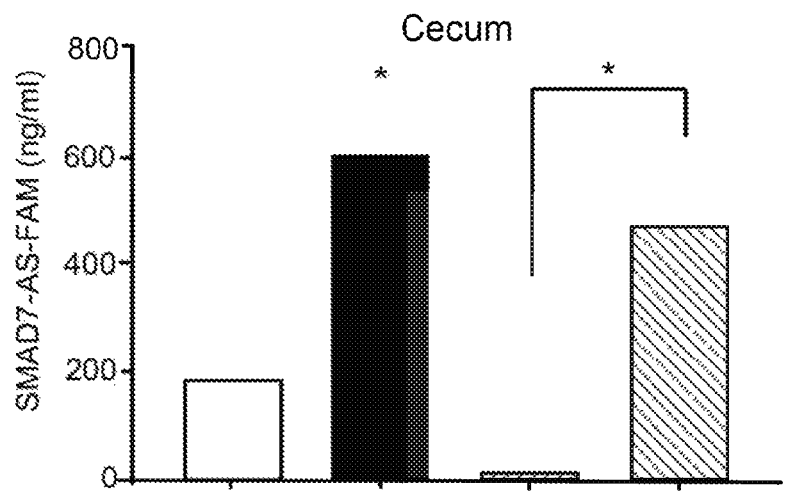
FIG. 73 is a graph showing the level of FAM-SMAD7-AS oligonucleotide in the cecum tissue of DSS-induced colitis mice at 12-hours. The bars represent from left to right, Groups 2 through 5 in the experiment described in Example 9.
Figure 74:
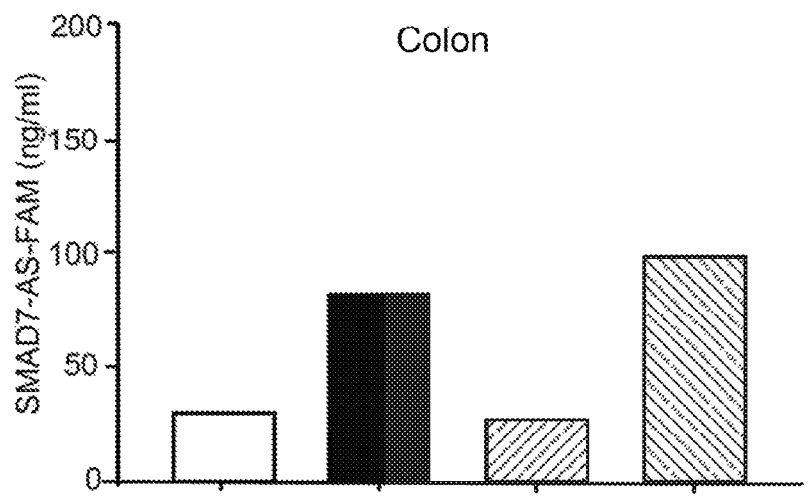
FIG. 74 is a graph showing the level of FAM-SMAD7-AS oligonucleotide in the colon tissue of DSS-induced colitis mice at 12-hours. The bars represent from left to right, Groups 2 through 5 in the experiment described in Example 9.
Figure 75:
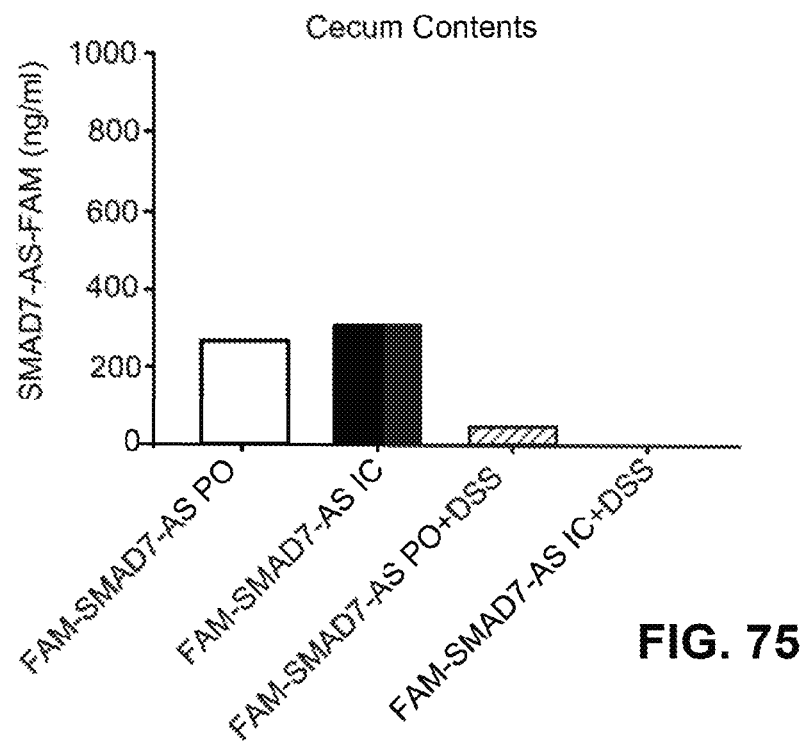
FIG. 75 is a graph showing the level of FAM-SMAD7-AS oligonucleotide in the cecum contents of DSS-induced colitis mice at 12-hours. The bars represent from left to right, Groups 2 through 5 in the experiment described in Example 9.

The data in FIGS. 73 and 74 show that significantly more SMAD7 antisense oligonucleotide was present in cecum tissue and colon tissue for mice with or without DSS treatment that were intra-cecally administered the SMAD7 antisense oligonucleotide as compared to mice with or without DSS treatment that were orally administered the SMAD7 antisense oligonucleotide. The data in FIG. 75 show that there is about the same level of SMAD7 antisense oligonucleotide in the cecum contents of mice with or without DSS treatment that were orally or intra-cecally administered the SMAD7 antisense oligonucleotide. No SMAD7 antisense oligonucleotide was found in the plasma or white blood cell pellet of SMAD7 antisense oligonucleotide treated mice.

Figure 83:
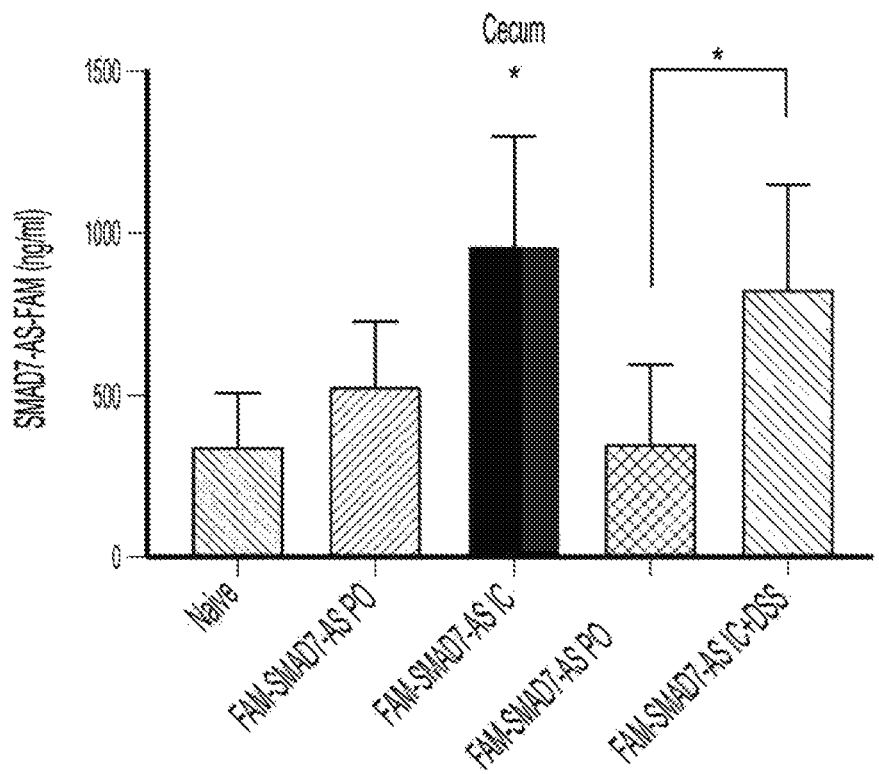
FIG. 83 is a graph showing the mean concentration of a SMAD7 antisense molecule (SMAD7-AS-FAM) in the cecum tissue in untreated swine or in swine after intracecal (IC) or oral administration (PO) of SMAD7-AS-FAM as described in Example 9.
Figure 84:
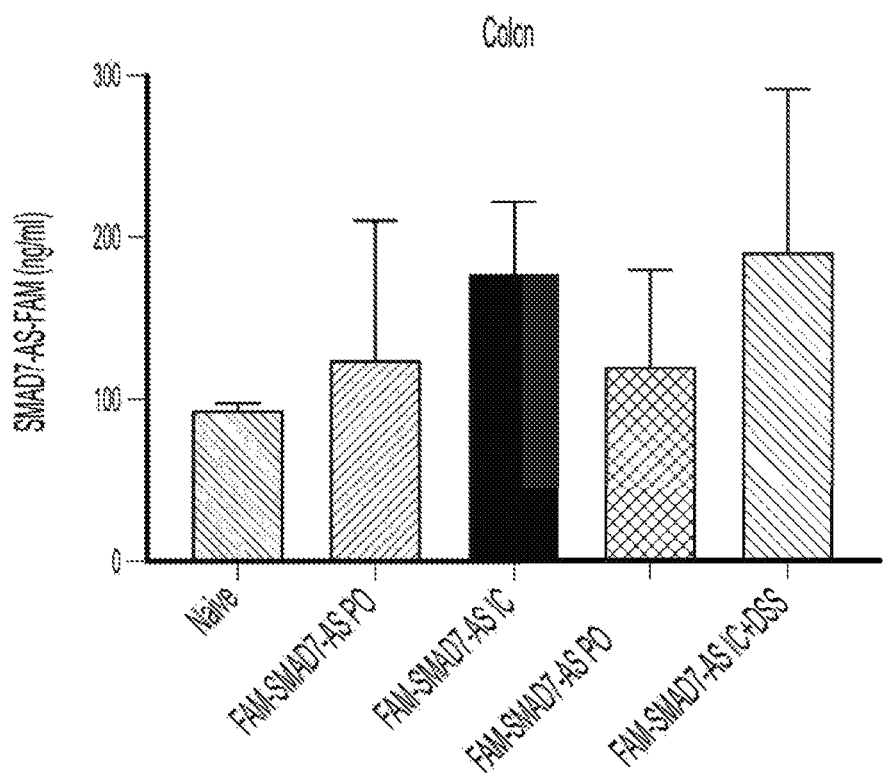
FIG. 84 is a graph showing the mean concentration of SMAD7-AS-FAM in the colon tissue in untreated swine or in swine after intracecal (IC) or oral administration (PO) of SMAD7-AS-FAM as described in Example 9.
Figure 85:
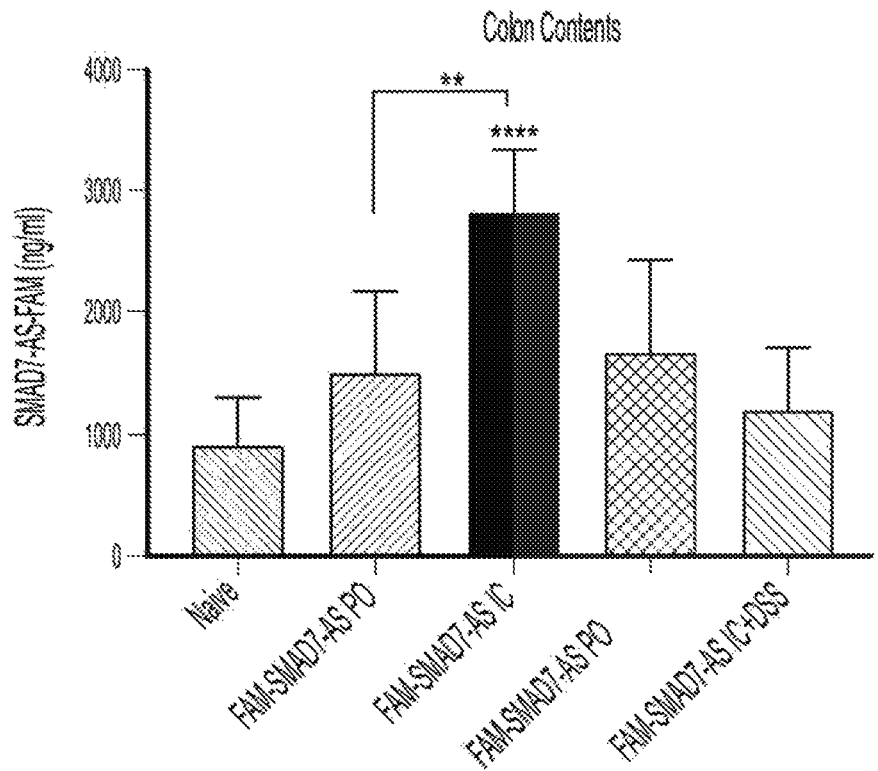
FIG. 85 is a graph showing the mean concentration of SMAD7-AS-FAM in the colon contents in untreated swine or in swine after intracecal (IC) or oral administration (PO) of SMAD7-AS-FAM as described in Example 9.
Figure 86:
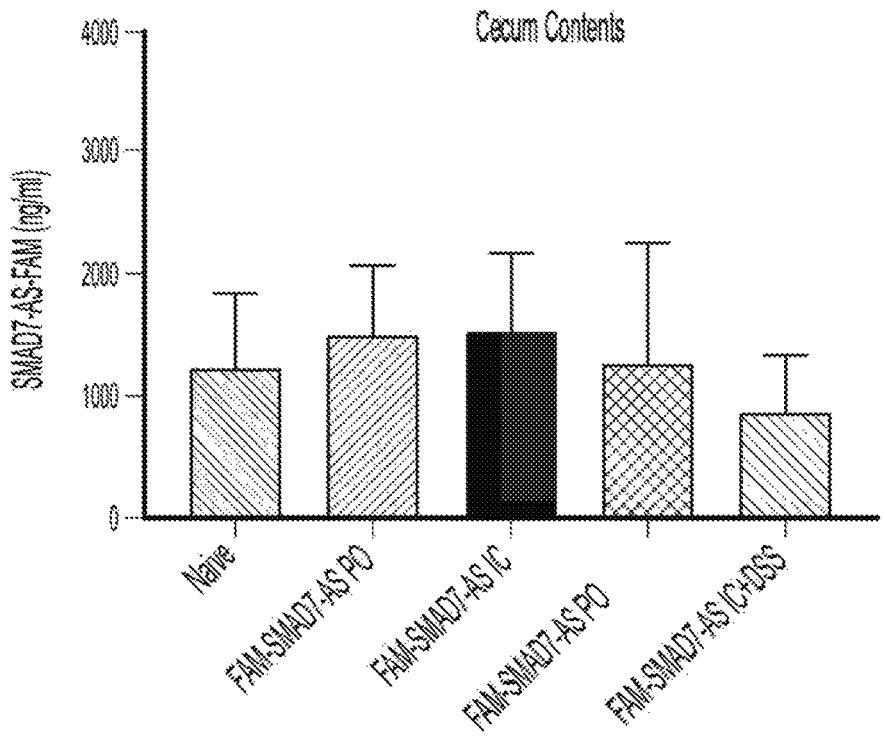
FIG. 86 is a graph showing the mean concentration of SMAD7-AS-FAM in the cecum contents in untreated swine or in swine after intracecal (IC) or oral administration (PO) of SMAD7-AS-FAM as described in Example 9.

No significant differences were observed in clinical observations, GI-specific adverse effects or toxicity due to FAM-AS-SMAD7 treatment via PO vs IC. No fluorescent detection of FAM-AS-SMAD7 was found in plasma and whole blood cell pellets across all treatment groups. A significant higher fluorescent signal (RFU) of FAM-AS-SMAD7 was found in cecum tissue when delivered intra-cecally compared with PO in both normal and DSS-induced models (FIG. 83). A slight higher RFU was also found in colon tissue when delivered intra-cecally, however, the overall signal is 10 times lower (FIG. 84). A significant higher RFU was found in colon content when delivered intra-cecally compared with PO in a normal mouse model (FIG. 85). This result was not seen in cecum content across all treatment groups (FIG. 86), indicating a better tissue absorption of oligos in cecum tissue from cecal content when delivered intra-cecally, but not in colon content at 12 hours post-treatment.

Example 10—Comparison of the Tissue, Plasma, and GI Content Pharmacokinetics of Tacrolimus through Oral vs. Intra-Cecal Ingestible Device Delivery in Yorkshire-Cross Farm Swine The primary objective of this study was to compare the tissue, plasma, rectal sample, and GI content pharmacokinetics of tacrolimus through oral versus intra-cecal ingestible device delivery in normal Yorkshire-Cross farm swine.

This study compares the effects of administration of: a single intra-cecal administration of an ingestible device containing 0.8 mL sterile vehicle solution (80% alcohol, 20% castor oil (HCO-60)); a single oral dose of tacrolimus at 4 mg/0.8 mL (in sterile vehicle solution); and a single intra-cecal administration of an ingestible device containing either 1 mg/0.8 mL (in sterile vehicle solution), 2 mg/0.8 mL (in sterile vehicle solution), or 4 mg/0.8 mL (in sterile vehicle solution).

This study employed five groups of three female swine weighing approximately 45 to 50 kg at study start. Swine were randomly placed into animal rooms/pens as they are transferred from the delivery vehicle without regard to group. Group numbers were assigned to the rooms in order of room number. No further randomization procedure was employed. The study design is provided in Table 28.

TABLE 28

Study Design Table

| General | Group size | Dose | Route | Days Pre-Dose | | | | | Hours Post-dose | | | | | | |
|---|---|---|---|---|---|---|---|---|---|---|---|---|---|---|---|
| | | | | -11 | -10 | -5 | -1 | 1 | 0.5 | 1 | 2 | 3 | 4 | 6 | 12 |
| Fast Food/Water Observations | | ad libidum | | • | | | • | • | • | • | • | • | • | • | • |
| clinical observations | | daily from Day -10~-5 | | | | • | | • | • | • | • | • | • | • | • |
| body weight* | | | | | • | • | • | | | | | | | | • |

TABLE 28-continued

Study Design Table

| General | Group size | Dose | Route | Days Pre-Dose -11 | -10 | -5 | -1 | 1 | Hours Post-dose 0.5 | 1 | 2 | 3 | 4 | 6 | 12 |
|---|---|---|---|---|---|---|---|---|---|---|---|---|---|---|---|
| Treatments (Groups) | | | | | | | | | | | | | | | |
| 1. Vehicle control | n = 3 | 0.8 mL (20% HCO-HCO-60, 80% EtOH) | IC | | | • | | | | | | | | | |
| Surgical placement of IC port** | | (1 Capsule) | | | • | | | | | | | | | | |
| Euthanized | | | | | | | | | | | | | | | n = 3 |
| 2. Tacrotimus (PO) | n = 3 | 4 mg in 0.8 mL ~0.08 mg/kg | Oral | | | | • | | | | | | | | |
| Surgical placement of IC port** | | (solution) | | | • | | | | | | | | | | |
| Euthanized | | | | | | | | | | | | | | | n = 3 |
| 3. Tacrolimus (IC) | n = 3 | 1 mg in 0.8 mL ~0.02 mg/kg | IC | | | | • | | | | | | | | |
| Surgical placement of IC port** | | (1 capsule) | | | • | | | | | | | | | | |
| Euthanized | | | | | | | | | | | | | | | n = 3 |
| 4. Tacrolimus (IC) | n = 3 | 2 mg in 0.8 mL ~0.04 mg/kg | IC | | | | • | | | | | | | | |
| Surgical placement of IC port** | | (1 capsule) | | | • | | | | | | | | | | |
| Euthanized | | | | | | | | | | | | | | | n = 3 |
| 5. Tacrolimus (IC) | n = 3 | 4 mg in 0.8 mL ~0.08 mg/kg | IC | | | | • | | | | | | | | |
| Surgical placement of IC port** | | (1 capsule) | | | • | | | | | | | | | | |
| Euthanized Samples***** | | | | | | | | | | | | | | | n = 3 |
| Plasma | | | cephatic, jugular or catheter | | | | | | • | • | • | • | • | • | • |
| Rectal contents | | | rectal | | | | | | | • | | • | | • | • |
| Tissue*** | ×5 | | necropsy | | | | | | | | | | | | • |
| Luminal contents**** | ×5 | | necropsy | | | | | | | | | | | | • |

*Animal weight was ~45-50 kg for drug doses proposed.
**Surgical placement of IC port in all animals to control.
***Tissue samples [drug] (five GI section cecum (CAC); proximal colon (PCN); transverse colon (TCN); distal colon (DCN); rectum (RTM), plus mesenteric lymph nodes and Peyer's Patch).
****Luminal contents (cecum (CAC); proximal colon (PCN); transverse colon (TCN); distal colon (DCN); rectum (RTM)).

Animals in Group 1 received an ingestible device containing 0.8 mL of vehicle solution (80% alcohol, 20% HCO-60). Animals in Group 2 received orally 4 mL liquid formulation of tacrolimus at 4 mg/0.8 mL per animal (Prograf: 5 mg/mL). Animals in Group 3 received intra-cecally an ingestible device containing tacrolimus at 1 mg in 0.8 mL per ingestible device. Animals in Group 4 received intra-cecally an ingestible device containing tacrolimus at 2 mg in 0.8 mL per ingestible device. Animals in Group 5 received intra-cecally an ingestible device containing tacrolimus at 4 mg in 0.8 mL per ingestible device. To control for potential confounding effects of the surgery, all groups fast on Day -11 at least 24 hr before being subjected to anesthesia followed by surgical placements of a cecal port by a veterinary surgeon at Day -10. All animals were fasted for at least 12 hr prior to dosing on Day 1. Animals were dosed via either intra-cecal dosing (IC) or oral dosing (PO) at Day 1 (between 6-8 p.m.). All animals resumed feeding at approximately 4 hours after dose (11-12 p.m. after dosing).

Animals in Group 1 (Vehicle Control) were administered a single intra-cecal ingestible device containing 0.8 mL Vehicle solution (80% alcohol, 20% castor oil (HCO-60)) on Day 1. On Day -10 the animals were anesthetized, and a veterinary surgeon surgically placed an intra-cecal port in each animal. On Day 1, each animal was placed into a sling then a single intra-cecal ingestible device containing 0.8 mL vehicle solution (80% alcohol, 20% castor oil (HCO-60)) is introduced by the veterinary surgeon into the cecum via the cecal port in each animal. Following ingestible device placement, the animals were removed from the slings and placed back into their pens with water. All animals resumed feeding at approximately 4 hours after dose. Samples of rectal contents were collected for pharmacokinetic analyses from each animal at each of 1, 3, 6, and 12 hours post-ingestible device placement using a fecal swab (rectal swab). A total of 60 samples were collected.

Approximately 200~400 mg of rectal content were collected, if available, with a fecal swab (Copan Diagnostics Nylon Flocked Dry Swabs, 502CS01). The fecal swab was pre-weighed and weighed after collection in the collection tube (Sterile Tube and Cap No Media, PFPM913S), and the sample weight was recorded. The fecal swab was broken via the breakpoint, and was stored in the collection tube, and immediately frozen at -70° C. Whole blood (2 mL) was collected into K2EDTA coated tubes for pharmacokinetics at each time-point of pre-dose and 1, 2, 3, 4, 6 and 12 hours post-dose. Immediately following euthanasia, tissue was collected. A total of 105 samples were collected.

For tissue necropsy, small intestine fluid and cecal fluid were collected separately from all the animals into two separate square plastic bottles, and stored at -20° C. The length and diameter of the cecum and the colon was measured from one animal in each group and recorded for reference. Tissues were collected for pharmacokinetic analyses and include mesenteric lymph nodes, a Peyer's Patch, and five gastrointestinal sections, including cecum, proximal colon, transverse colon, distal colon, and rectum. All samples were weighed, and the tissue sample weights were recorded. In each of the five gastrointestinal sections, tissue samples were collected in three different areas where the mucosal surface was visible and not covered by luminal content by using an 8.0-mm punch biopsy tool. Around 3 grams of the total punched sample were collected into a pre-weighed 15-mL conical tube, and the tissue weight was recorded. Three mesenteric lymph nodes were collected from different areas and weighed. At least one Peyer's Patch was collected and weighed. Tissues were snap-frozen in liquid nitrogen and stored frozen at approximately −70° C. or below (total of 105 samples).

Luminal contents were collected for pharmacokinetic analyses from the surface of the tissue from each of five gastrointestinal sections: cecum, proximal colon, transverse colon, distal colon, and rectum (total of 75). The contents were collected in pre-weighed 15-mL conical tubes and the sample weights were recorded. Samples were snap-frozen in liquid nitrogen stored frozen at approximately −70° C. or below.

After removing the luminal content, another set of tissue samples from 3 different areas were collected via an 8.0-mm punch biopsy in each section of the five tissue gastrointestinal sections described above. Around 3 grams of the total punched sample were collected into a pre-weighed 15-mL conical tube, and the tissue weight was recorded (total of 75). Tissues were snap-frozen in liquid nitrogen and stored frozen at approximately −70° C. or below.

A 30-cm length of jejunum (separated into two 15 cm lengths), and the remaining distal and transverse colon tissue sample (after tissue and luminal content were collected for PK) were collected in one animal in each group of treatment, snap-frozen in liquid nitrogen and stored frozen at approximately −70° C. or below. All samples for pharmacokinetic analyses were stored on dry ice before analyses.

Group 2 animals were administered a single oral dose of tacrolimus at 4 mg/0.8 mL (0.08-mg/kg) (in the vehicle solution) on Day 1. Plasma, rectal content sample, tissue collection, GI content collection and related procedures/storage/shipments was the same as those employed in Group 1.

Group 3 animals were administered a single intra-cecal ingestible device containing tacrolimus at 1-mg/0.8 mL (0.02 mg/kg) (in the vehicle solution) on Day 1 by a veterinary surgeon. Plasma, rectal content sample, tissue collection, GI content collection and related procedures/storage/shipments was the same as those employed in Group 1. All samples were analyzed for tacrolimus.

Group 4 animals were administered a single intra-cecal ingestible device of tacrolimus at 2 mg/0.8 mL (0.04 mg/kg) (in sterile vehicle solution) on Day 1 by a veterinary surgeon. Plasma, rectal content sample, tissue collection, GI content collection and related procedures/storage/shipments were the same as those employed in Group 1. All samples were analyzed for tacrolimus.

Group 5 animals are administered a single intra-cecal ingestible device containing tacrolimus at 4 mg/0.8 mL (0.08 mg/kg) (in the vehicle solution) on Day 1 by a veterinary surgeon. Plasma, rectal content sample, tissue collection, GI content collection and related procedures/storage/shipments were the same as those employed in Group 1. All samples were analyzed for tacrolimus.

Detailed clinical observations were conducted daily from Day −10 to −5, and on Day 1. Additional pen-side observations were conducted at least once each day. The animals remained under constant clinical observation for the entire 12 hours from dose until euthanasia. Body weights were collected on Day −10, Day −5, and pre-dose on Day 1. Animals were euthanized via injection of a veterinarian-approved euthanasia.

Test Article and Formulation
 1. Vehicle solution, 20 mL
  Description: 80% alcohol, 20% PEG-60 castor oil
  Physical characteristics: clear liquid solution.
 2. Prograf (tacrolimus injection), 10 ampules
  Description: A sterile solution containing the equivalent of 5 mg anhydrous tacrolimus in 1 mL. Tacrolimus is macrolide immunosuppressant and the active ingredient of Prograf. 0.8 mL of Prograf (5 mg/mL) was administered through oral gavage per animal in group 2. Prograf (5 mg/mL) was diluted 2× folds (2.5 mg/mL) and 4× folds (1.25 mg/mL) by using vehicle solution. 0.8 mL of each concentration, 1.25 mg/mL, 2.5 mg/mL, and 5 mg/mL of Prograf, was injected into a DSS ingestible device for group 3, 4, and 5.
  Formulation: Each mL contained polyoxyl 60 hydrogenated castor oil (HCO-60), 200 mg, and dehydrated alcohol, USP, 80.0% v/v.
  Physical characteristics: clear liquid solution.
 3. DDS ingestible device containing tacrolimus
  Description: Three (3) DDS ingestible devices containing vehicle solution for Group 1, three (3) DSS ingestible devices containing 1 mg tacrolimus for Group 3, three (3) DDS ingestible devices containing 2 mg tacrolimus for Group 4, and three (3) DDS ingestible devices containing 4 mg tacrolimus for Group 5.

Acclimation
 Animals were acclimated prior to study initiation for at least 7 days. Animals in obvious poor health were not placed on study.

Concurrent Medication
 Other than veterinary-approved anesthetics and medications used during surgery to install the ileocecal ports, or for vehicle or test article administration, and analgesia and antibiotics post-surgery, no further medications were employed.

Feed
 All swine were fasted at least 24 hours before being anesthetized and properly medicated for surgery or overnight before dosing. Otherwise, animals were fed ad-libitum. Tap water was pressure-reduced and passed through a particulate filter, then a carbon filter prior to supply to an automatic watering system. Water was supplied ad libitum. There were no known contaminants in the feed or water that would be expected to interfere with this study.

Figure 76:
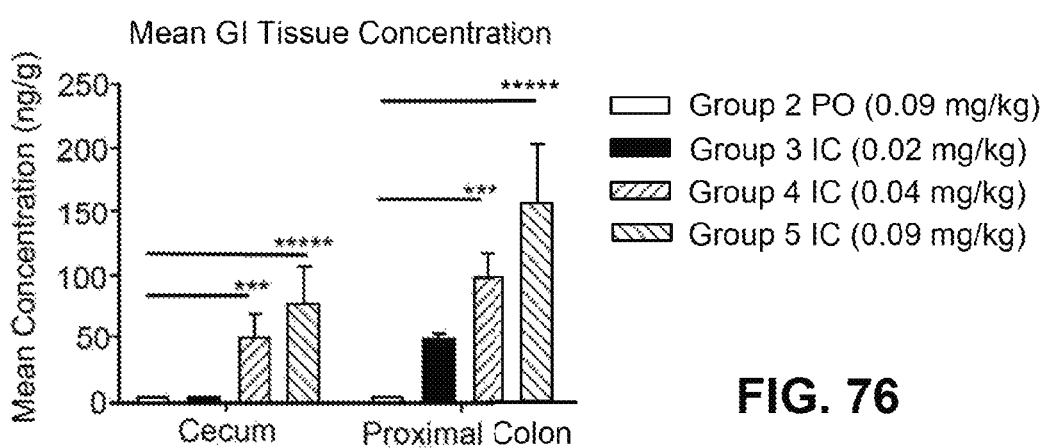
FIG. 76 is a graph showing the mean concentration of tacrolimus in the cecum tissue and the proximal colon tissue 12 hours after intracecal or oral administration of tacrolimus to swine as described in Example 10.
Figure 87:
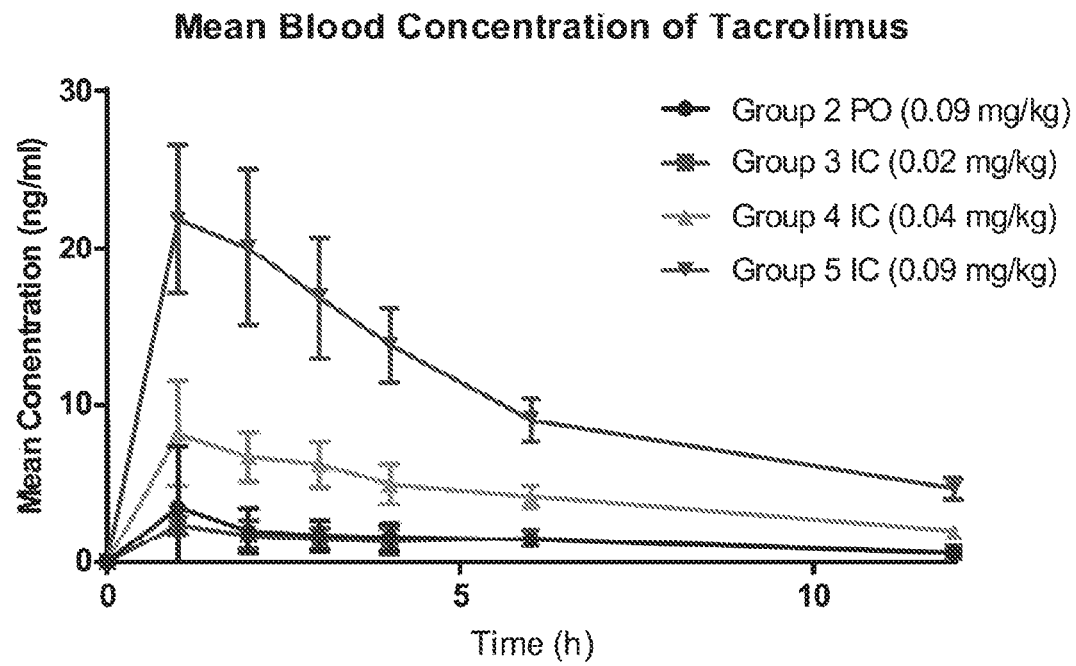
FIG. 87 is a graph showing the mean concentration of tacrolimus in the blood of swine 1 hour, 2 hours, 3 hours, 4 hours, 6 hours, and 12 hours after intracecal (IC) or oral administration (PO) of tacrolimus as described in Example 10.
Figure 88:
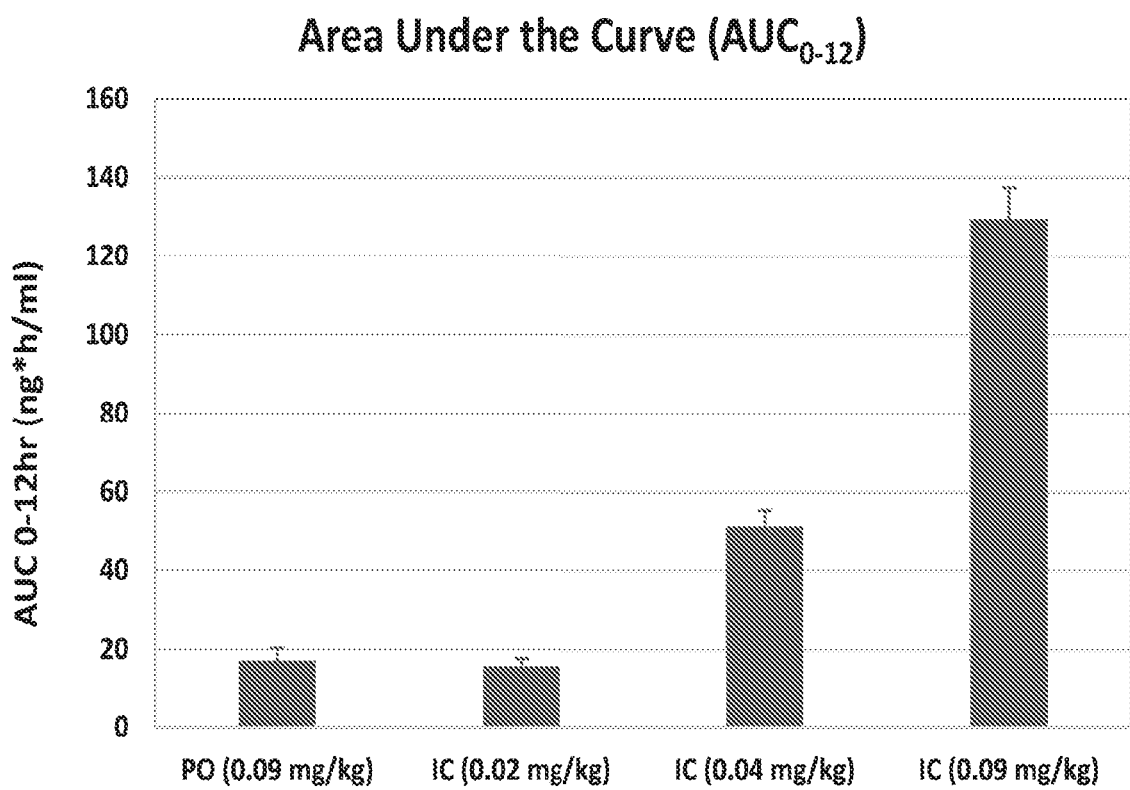
FIG. 88 is a graph showing the $AUC_{0-12\ hours}$ of tacrolimus in the blood of swine after intracecal (IC) or oral administration (PO) of tacrolimus as described in Example 10.
Figures 89, 90:
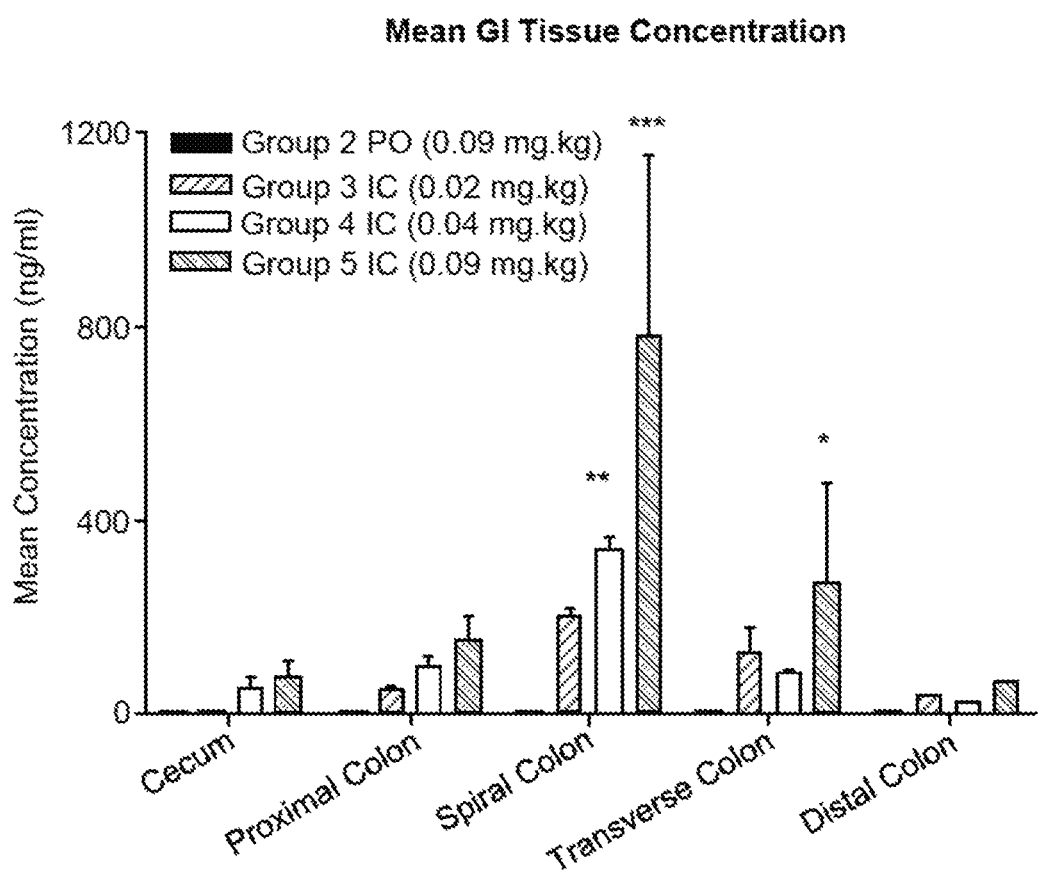
FIG. 89 is a representative table showing the $T_{max}$, $C_{max}$, trough (at 12 hours post-administration), and $AUC_{0-12\ hours}$ of tacrolimus in swine after intracecal (IC) or oral administration (PO) as described in Example 10.
FIG. 90 is a graph showing the mean concentration of tacrolimus in the cecum, the proximal colon, the spiral colon, the transverse colon, and the distal colon of swine after intracecal (IC) or oral administration (PO) of tacrolimus as described in Example 10.

Results
 The data in FIG. 76 show that the mean concentration of tacrolimus in the cecum tissue and the proximate colon tissue were higher in swine that were intra-cecally administered tacrolimus as compared to swine that were orally administered tacrolimus. All blood trough concentrations were <10 ng/mL and exposure AUC<2000-12 ng·h/mL (FIGS. 87-89 and Table 29).

TABLE 29

| Route | PO | IC | IC | IC |
| --- | --- | --- | --- | --- |
| Dose (mg · kg) | 0.09 | 0.02 | 0.04 | 0.09 |
| Tmax | 1 | 1 | 1 | 1 |
| Cmax | 3.531 ± 3.84 | 2.39 ± 0.565 | 9.197 ± 3.30 | 21.8 ± 4.73 |
| Trough (12 hr) | 0.568 ± 0.291 | 0.746 ± 0.038 | 1.96 ± 0.491 | 4.35 ± 0.516 |
| AUC 0-12 hr (ng*h/ml) | 16.83 ± 3.641 | 15.29 ± 2.356 | 51.35 ± 4.04 | 129.6 ± 7.827 |

Figure 91:
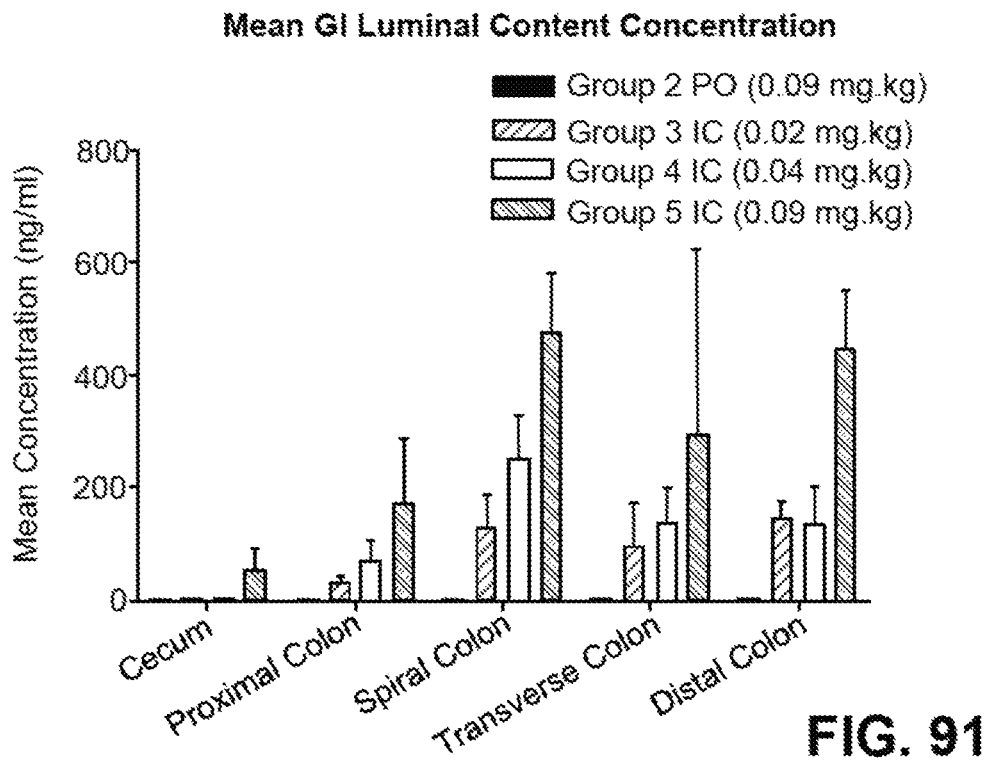
FIG. 91 is a graph showing the mean concentration of tacrolimus in the cecum lumen, the proximal colon lumen, the spiral colon lumen, the transverse colon lumen, and the distal colon lumen of swine after intracecal (IC) or oral administration (PO) of tacrolimus as described in Example 10.
Figure 92:
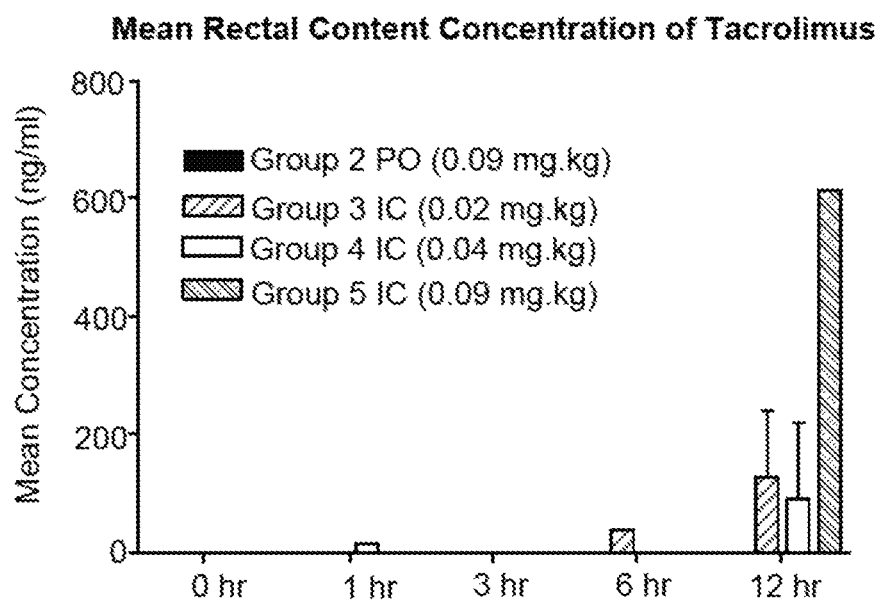
FIG. 92 is a graph showing the mean concentration of tacrolimus in the rectal content of swine at 1 hour, 3 hours, 6 hours, and 12 hours after intracecal (IC) or oral administration (PO) of tacrolimus as described in Example 10.

Significantly higher Cmax values (9.20±3.30 and 21.80±4.73 ng/mL) were observed in groups treated with high (0.09 mg/kg) and moderate (0.04 mg/kg) dose of tacrolimus when delivered through IC capsule as compared to the Cmax values following PO delivery of tacrolimus (0.09 mg/kg). Significantly higher tissue (spiral and transverse colon) and luminal content (spiral, transverse, and distal colon) concentrations were observed in groups treated with high and moderate dose tacrolimus delivered through IC capsule as compared to the levels observed in animals administered tacrolimus via PO. No measurable level of tacrolimus was detected in tissue when animals were delivered tacrolimus via PO, despite systemic concentrations equivalent to low dose IC group (0.02 mg/kg) (FIGS. 90 and 91). A higher rectal content concentration was observed at 12 hours post-treatment in the IC capsule groups (FIG. 92), while no detectable level was observed in the PO group.

These data suggest that intra-cecal administration of tacrolimus is able to locally deliver tacrolimus to the tissues in the GI tract of a mammal, while not decreasing the systemic immune system of a mammal.

Example 11—Comparison of the Tissue, Plasma, and GI Content Pharmacokinetics of Adalimumab through SC vs. Intra-Cecal Ingestible Device Delivery in Yorkshire-Cross Farm Swine in DSS-induced Colitis The purpose of this non-Good Laboratory Practice (GLP) study is to explore the PK/PD and bioavailability of adalimumab when applied to (Dextran Sulfate Sodium Salt) DSS-induced colitis in Yorkshire-cross farm swine, and to evaluate topical Humira (adalimumab or ADA) in DSS-colitis in swine. Colitis was induced in weanling YorkShire-Cross farm swine by administering DSS once daily for 7 consecutive days via oral gastric intubation. The dose levels were chosen based on the doses and regimens used to induce colitis in weanling pigs. The doses of DSS were 1.275 or 2.225 g/k/day for Groups 2 and 3 respectively.

This study used one group of 19- to 21-day old weanling swine, and 2 groups of three, 19- to 20-day old weanling swine that weighed from 6.5 to 7.5 kg on arrival. To induce colitis, on study day 1 through and including day 7, animals in Groups 2 and 3 were administered once daily oral (gastric intubation) doses of DSS at 8.5% or 15% w/v for dose levels of 1.275 or 2.25 g/kg/day, respectively (Groups 2 and 3, respectively, 2 hours before morning feeding). The 10 Group 1 control animal was administered sterile saline only. Each animal was placed in a sling for dosing. Animals were fasted at least 6 hours prior to each dose. See Table 30.

TABLE 30

Study Table [a]

| Group | Route | Animal #[b] | DSS % w/v | mg/mL | Vol. (mL) | Total g[c] | g/kg | Frequency[d] | Total DSS needed | ADA treatment[e] |
|---|---|---|---|---|---|---|---|---|---|---|
| 1 (Animal 1501) | oral/gastric intubation | 1 | 0 | 0 | 105 | 0 | 0 | QD, 7 day | 0 | Day 8 (Vehicle) |
| 2 (Animals 2501, 2502, and 2504) | oral/gastric intubation | 3 | 8.5% | 85 | 105 | 8.925 | 1.275 | QD, 7 day | 187.425 | Day 8 (rectal 13 mg) |
| 3 | oral/gastric intubation | 3 | 15% | 150 | 105 | 15.75 | 2.25 | QD, 7 day | 330.75 | Day 8 (rectal 13 mg) |

[a] Endpoints for each group included body weights, clinical signs, & necropsy and IHC at 3 hr post ADA.[f,g]

[b] Animal weighed around 6.5-7.5 kg.

[c] Daily clinical signs and body weight were closely monitored throughout the study. If severe clinical signs or body weight loss is observed at day 1~3 after dosing, the DSS dosing was shortened to 5 days.

[d] 0.8 mL of ADA solution was dosed rectally to the colon via an endoscope.

[e] Necropsy was done to observe GI inflammation and overall histopathology.

The day following the last DSS dose, using endoscopy and a catheter, at 13 mg adalimumab/0.8 mL/pig (one 40 mg adalimumab/0.8 mL dosage syringe was divided into 3 parts and diluted with PBS) was placed in the proximal portion of the descending colon just past the bend of the transverse colon. Alternatively, 13 mg of adalimumab was diluted with PBS to a volume suitable for dosing post-weanling swine. Prior to dosing, endoscopy photographs were taken of the mucosal surface of the colon. Animals were anesthetized during adalimumab dosing. Prior to adalimumab dosing, animals were housed on rubber mats to prevent ingestion of bedding material, and were fasted at least 24 hours. The colon was cleansed using an enema prior to the procedure.

All animals were properly euthanized approximately 3 hours post-adalimumab-dose for tissue collections and subjected to a gross necropsy with emphasis on the severity of colitis (immediately after euthanasia, in order to avoid autolytic changes). All samples for histology were fixed in a fixation medium and the punch-biopsy sample snap-frozen in liquid nitrogen and stored frozen (−70° C.).

To measure drug content, tissue samples and luminal content were collected by gently removing and collecting luminal content first, then using an 8.0 mm-punch biopsy tool. Biopsies from three different areas at the site of adalimumab administration were collected in each animal. Additional tissue biopsy samples were collected from three different areas at the proximal colon, and the proximal region of transverse colon in each animal. Approximately 3 g of total punched sample and 200 mg of luminal content were collected in a pre-weighed conical tubes and the tissue weighed was recorded.

Approximately, a 5-cm length of open gastrointestinal tissue sample including terminal ileum, cecum (CAC); proximal colon (PCN); transverse colon (TCN); spiral colon, distal colon (DCN), and rectum was collected, gently rinsed in saline to remove luminal material, and individually fixed in fixation buffer (10% neutral buffered formalin). Also, a 5-cm length of open gastrointestinal tissue from 3 different areas near the site of adalimumab administration was collected and fixed in formalin in the same manner for immunohistochemical staining for adalimumab. Tissue samples for histopathology were fixed in 10% neutral buffered formalin for 18~24 hr, and transferred to 70% ethanol.

HUMIRA® was supplied in single-use, 1-mL pre-filled glass syringes, as a sterile, preservative-free solution for subcutaneous administration. The solution of HUMIRA® was clear and colorless, with a pH of about 5.2. Each syringe delivered 0.8 mL (40 mg adalimumab) of drug product. Each vial contained approximately 0.9 mL of solution to deliver 0.8 mL (40 mg adalimumab) of drug product. Each 0.8 mL HUMIRA® contained 40 mg adalimumab, 4.93 mg sodium chloride, 0.69 mg monobasic sodium phosphate dihydrate, 1.22 mg dibasic sodium phosphate dihydrate, 0.24 mg sodium citrate, 1.04 mg citric acid monohydrate, 9.6 mg mannitol, 0.8 mg polysorbate 80, and water for injection. Sodium hydroxide was added as necessary to adjust pH.

All animals were randomized into groups of three. Animals were dosed once with adalimumab via subcutaneous (SC), perirectal (PR), or intracecal (IC) administration.

The concentration of adalimumab and TNFα was measured in plasma at 1, 2, 3, 4, 6, and 12 hours post-dose. The concentration of adalimumab was measured in rectal contents at 1, 3, 6, and 12 hours post-dose and in luminal content at 12 hours post-dose. Concentration of adalimumab and TNFα, HER2, and total protein was measured in gastrointestinal tissue, e.g., cecum sample (CAC), proximal colon sample (PCN), transverse colon sample (TCN), distal colon sample (DCNi) inflamed, distal colon non-inflamed sample (DCNn), and rectum sample (RTM), at 12 hours post-dose.

Treatment with 8.5% DSS (oral; Day 1 to Day 7) induced mild body weight loss, hemorrhage diarrhea, soft bloody stool, and moderate colitis in swine. Necropsy revealed marked edema and full thickness of mucosal erosion from the proximal colon through the distal rectum. The 8.5% DSS-induced animals were treated with adalimumab at day 8. No significant differences in clinical observations, GI-specific adverse effects or toxicity due to adalimumab treatment were observed. The 15% DSS (oral; Day 1 to Day 7)-induced animals had marked mucosal sloughing and hemorrhage from cecum to rectum and severe colitis. All of the animals were euthanized early on Day 5.

Figure 94:
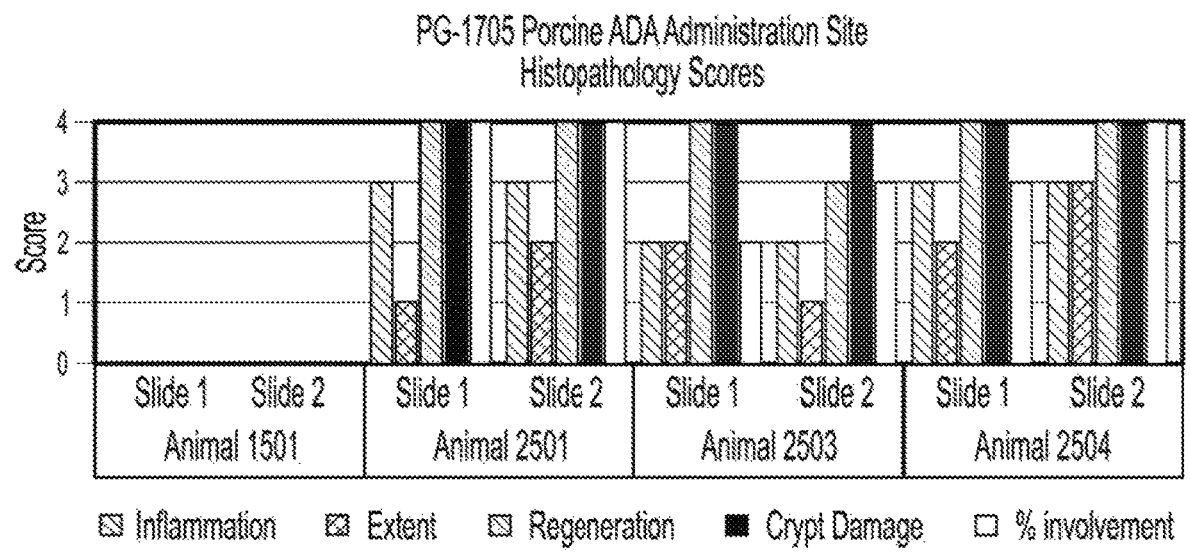
FIG. 94 is a graph showing the histopathological scores of two slides for animal 1502 (healthy control swine treated with placebo), animal 2501 (swine with 8.5% DSS-induced colitis treated with 1.86 mg/kg adalimumab), animal 2503 (swine with 8.5% DSS-induced colitis treated with 1.86 mg/kg adalimumab), and animal 2504 (swine with 8.5% DSS-induced colitis treated with 1.86 mg/kg adalimumab) at the placebo or adalimumab administration site prior to administration of placebo or adalimumab, respectively. Absence of a bar for a particular parameter indicates that the value for this parameter was 0.
Figure 95:
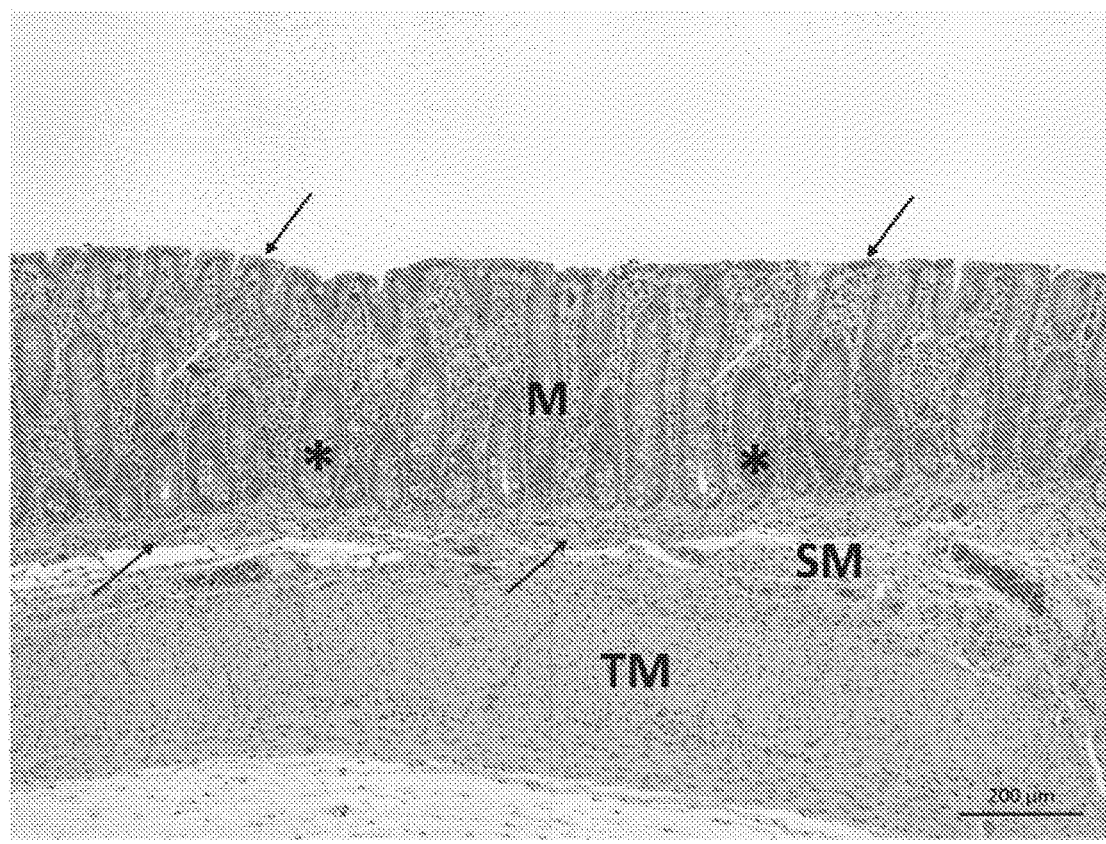
FIG. 95 is a representative hematoxylin- and eosin-stained image of the transverse colon of animal 1501 (healthy control swine). M, mucosa; SM, submucosa; TM, tunica muscularis. Numerous intestinal crypts (asterisks) are present and the surface epithelium (top two arrows) is intact. Mononuclear inflammatory cells are prominent in the lamina propria (light arrows) of the mucosa and extend a short distance into the submucosa (bottom two arrows). This amount of inflammatory cell infiltrate was expected background change and considered unrelated to the experimental protocol.
Figure 96:
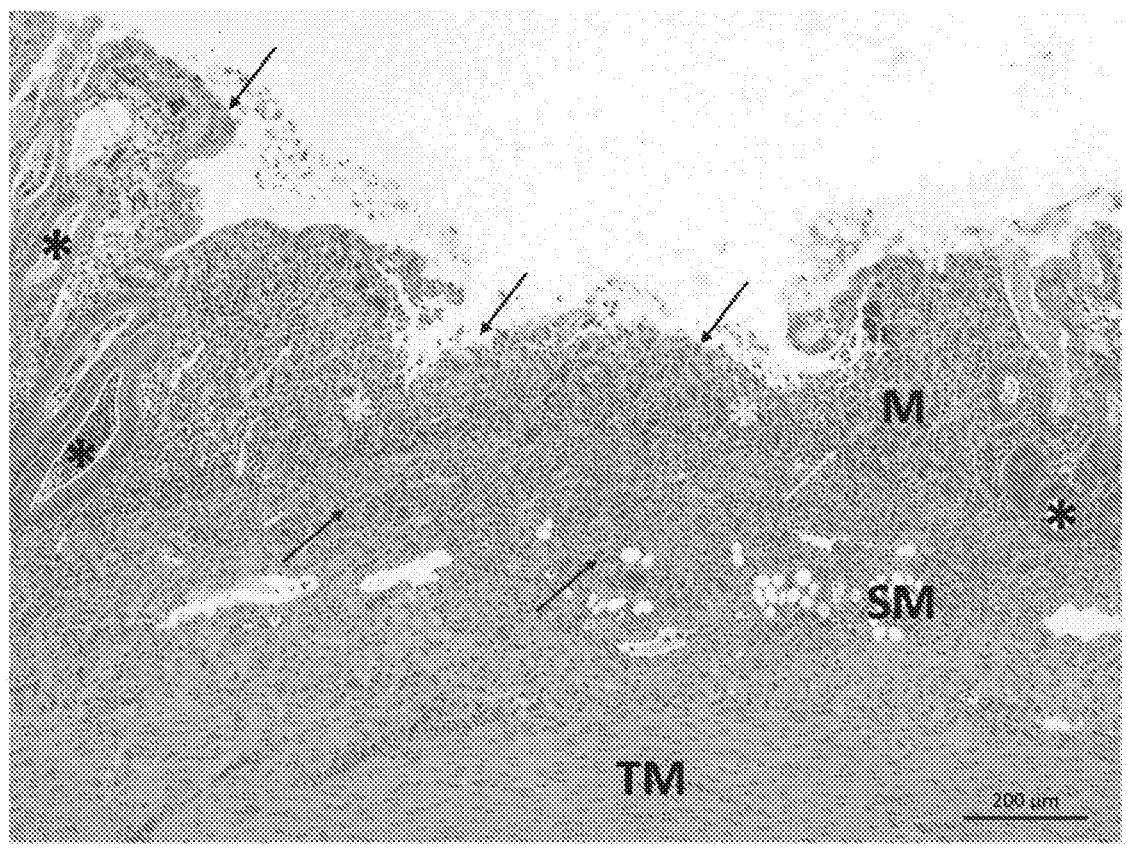
FIG. 96 is a representative hematoxylin- and cosin-stained image of the transverse colon of animal 2504 (8.5% DSS-induced colitis swine administered 1.86 mg/kg adalimumab) prior to administration of adalimumab. M, mucosa; SM, submucosa; TM, tunica muscularis.

Significant lesions of colitis were found in animals treated with 8.5% DSS and were characterized by inflammation that involved mucosa and submucosa, loss of surface epithelium (erosion), and intestinal crypts (FIGS. 93 and 94). Table 31 shows the quantitative histological grading of colitis that was used.

TABLE 31

| Feature graded | Grade | Description |
| --- | --- | --- |
| Inflammation | 0 | None |
| | 1 | Slight |
| | 2 | Moderate |
| | 3 | Severe |
| Extent | 0 | None |
| | 1 | Mucosa |
| | 2 | Mucosa and submucosa |
| | 3 | Transmural |
| Regeneration | 0 | Complete regeneration or normal tissue |
| | 1 | Almost complete regeneration |
| | 2 | Regeneration with crypt depletion |
| | 3 | Surface epithelium not intact |
| | 4 | No tissue repair |
| Crypt damage | 0 | None |
| | 1 | Basal ⅓ damaged |
| | 2 | Basal ⅔ damaged |
| | 3 | Only surface epithelium intact |
| | 4 | Entire crypt and epithelium lost |
| Percent involvement | 1 | 1-25% |
| | 2 | 26-50% |
| | 3 | 51-75% |
| | 4 | 76-100% |

There was little, if any, evidence of regeneration. The ileum and cecum were unremarkable in all animals except cecum from one animal (animal 2504) that was treated with 8.5% DSS, which had lesions of inflammation and loss of surface and crypt epithelium (FIGS. 95-99). Lesions of colitis were significant and consistent in all other segments of the large intestine from animals treated with 8.5% DSS. The severity and character of the changes were not remarkably different among the different segments or among these animals. Staining for human IgG was most consistent and intense at the adalimumab administration site and localized to the luminal surface of the mucosal epithelium or inflammatory exudate at the luminal surface, and penetration of adalimumab is found in the lamina propria near the luminal surface (FIG. 100).

Example 12—Human Clinical Trial of Treatment of Ulcerative Colitis using Adalimumab As a proof of concept, the patient population of this study is patients that (1) have moderate to severe ulcerative colitis, regardless of extent, and (2) have had an insufficient response to a previous treatment, e.g., a conventional therapy (e.g., 5-ASA, corticosteroid, and/or immunosuppressant) or a FDA-approved treatment. In this placebo-controlled eight-week study, patients are randomized. All patient undergo a colonoscopy at the start of the study (baseline) and at week 8. Patients enrolled in the study are assessed for clinical status of disease by stool frequency, rectal bleeding, abdominal pain, physician's global assessment, and biomarker levels such as fecal calprotectin and hsCRP. The primary endpoint is a shift in endoscopy scores from Baseline to Week 8. Secondary and exploratory endpoints include safety and tolerability, change in rectal bleeding score, change in abdominal pain score, change in stool frequency, change in partial Mayo score, change in Mayo score, proportion of subjects achieving endoscopy remission, proportion of subjects achieving clinical remission, change in histology score, change in biomarkers of disease such as fecal calprotectin and hsCRP, level of adalimumab in the blood/tissue/stool, change in cytokine levels (e.g., TNFα, IL-6) in the blood and tissue.

Figure 72:
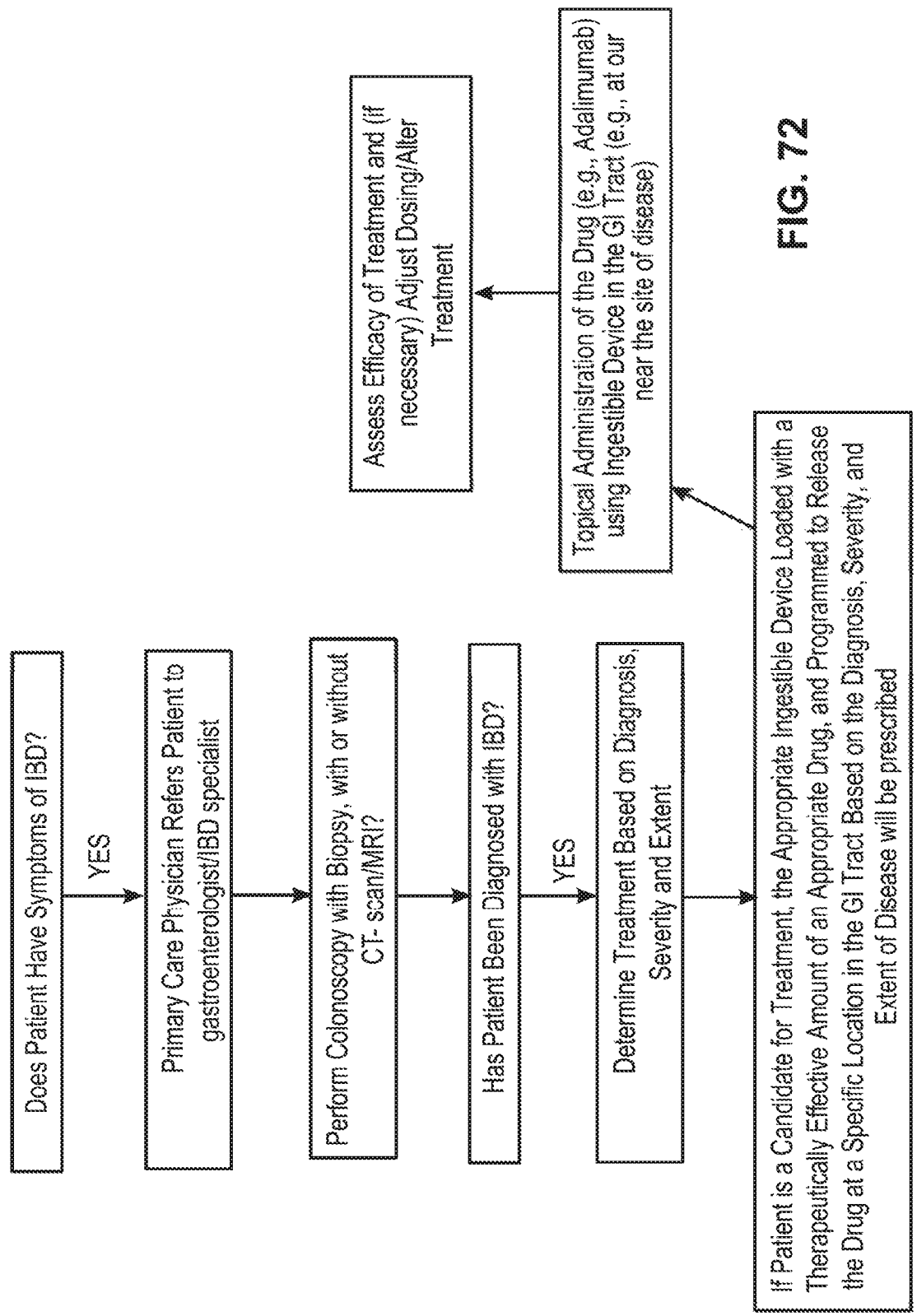
FIG. 72 is a flowchart of illustrative steps of a clinical protocol, in accordance with some embodiments of the disclosure.

FIG. 72 describes an exemplary process of what would occur in clinical practice, and when, where, and how the ingestible device will be used. Briefly, a patient displays symptoms of ulcerative colitis, including but not limited to: diarrhea, bloody stool, abdominal pain, high c-reactive protein (CRP), and/or high fecal calprotectin. A patient may or may not have undergone a colonoscopy with diagnosis of ulcerative colitis at this time. The patient's primary care physician refers the patient. The patient undergoes a colonoscopy with a biopsy, CT scan, and/or MRI. Based on this testing, the patient is diagnosed with ulcerative colitis. Most patients are diagnosed with ulcerative colitis by colonoscopy with biopsy. The severity based on clinical symptoms and endoscopic appearance, and the extent, based on the area of involvement on colonoscopy with or without CT/MRI is documented. Treatment is determined based on diagnosis, severity and extent.

For example, treatment for a patient that is diagnosed with ulcerative colitis is an ingestible device programmed to release a single bolus of a therapeutic agent, e.g., 40 mg adalimumab, in the cecum or proximal to the cecum. Prior to administration of the treatment, the patient is fasted overnight and is allowed to drink clear fluids. Four hours after swallowing the ingestible device, the patient can resume a normal diet. An ingestible device is swallowed at the same time each day. The ingestible device is not recovered.

In some embodiments, there may be two different ingestible devices: one including an induction dose (first 8 to 12 weeks) and a different ingestible device including a different dose or a different dosing interval.

In some examples, the ingestible device can include a mapping tool, which can be used after 8 to 12 weeks of induction therapy, to assess the response status (e.g., based on one or more of the following: drug level, drug antibody level, biomarker level, and mucosal healing status). Depending on the response status determined by the mapping tool, a subject may continue to receive an induction regimen or maintenance regimen of adalimumab.

In different clinical studies, the patients may be diagnosed with Crohn's disease and the ingestible devices (including adalimumab) can be programmed to release adalimumab in the cecum, or in both the cecum and transverse colon.

In different clinical studies, the patients may be diagnosed with illeocolonic Crohn's disease and the ingestible devices (including adalimumab) can be programmed to release adalimumab in the late jejunum or in the jejunum and transverse colon.

Example 13—Pharmacokinetic Study of Oral vs. Intra-Cecal Administration of Tacrolimus in Yorkshire-Cross Farm Swine The primary objective of this study was to study the pharmacokinetics of oral versus intra-cecal administration of tacrolimus in normal Yorkshire-Cross farm swine.

This study compares the effects of administration of: a single intra-cecal administration of a device containing 0.8 mL sterile vehicle solution (80% alcohol, 20% castor oil (HCO-60)); a single oral dose of tacrolimus at 0.09 mg/kg (in sterile vehicle solution); and a single intra-cecal administration of a device containing either 0.02 mg/kg (in sterile vehicle solution), 0.04 mg/kg (in sterile vehicle solution), or 0.09 mg/kg (in sterile vehicle solution).

This study employed five groups of three female swine weighing approximately 45 to 50 kg at study start. Swine were randomly placed into animal rooms/pens as they are transferred from the delivery vehicle without regard to group. Group numbers were assigned to the rooms in order of room number. No further randomization procedure was employed. The study design is provided in Table 32.

TABLE 32

Study Design

| Treatments | | | Dosage mg/kg | HED mg | Route | Endpoints |
|---|---|---|---|---|---|---|
| Group 1 | Vehicle control | n = 3 | 0 | 0 | Intra-cecal capsule | [Tacrolimus] in blood and rectal content at 1~12 hr post dose, and GI tissue & GI content at 12 hr post dose |
| Group 2 | Tacrolimus | n = 3 | 0.09 | 6.60 | Oral solution | |
| Group 3 | Tacrolimus | n = 3 | 0.02 | 1.65 | Intra-cecal capsule | |
| Group 4 | Tacrolimus | n = 3 | 0.04 | 3.30 | Intra-cecal capsule | |
| Group 5 | Tacrolimus | n = 3 | 0.09 | 6.60 | Intra-cecal capsule | |

Animals in Group 1 received intra-cecally a device containing a vehicle solution (80% alcohol, 20% HCO-60). Animals in Group 2 received orally a liquid formulation of tacrolimus at 0.09 mg/kg per animal. Animals in Group 3 received intra-cecally a device containing tacrolimus at 0.02 mg/kg per device. Animals in Group 4 received intra-cecally a device containing tacrolimus 0.04 mg/kg per device. Animals in Group 5 received intra-cecally a device containing tacrolimus 0.09 mg/kg per device.

Samples of rectal contents were collected for pharmacokinetic analyses from each animal at each of 1, 3, 6, and 12 hours post-device placement using a fecal swab (rectal swab).

The concentration of tacrolimus measured was measured in the blood at 1-, 2-, 3-, 4-, 6-, and 12-hours post-dose. The concentration of tacrolimus was measured in rectal contents at 1-, 3-, 6-, and 12-hours post-dose, and in the gastrointestinal tissue and luminal content, e.g., the cecum tissue and lumen, the proximal colon tissue and lumen, the spiral colon tissue and lumen, the transverse colon tissue and lumen, and the distal colon tissue and lumen, at 12 hours post-dose.

Results

Figure 77:
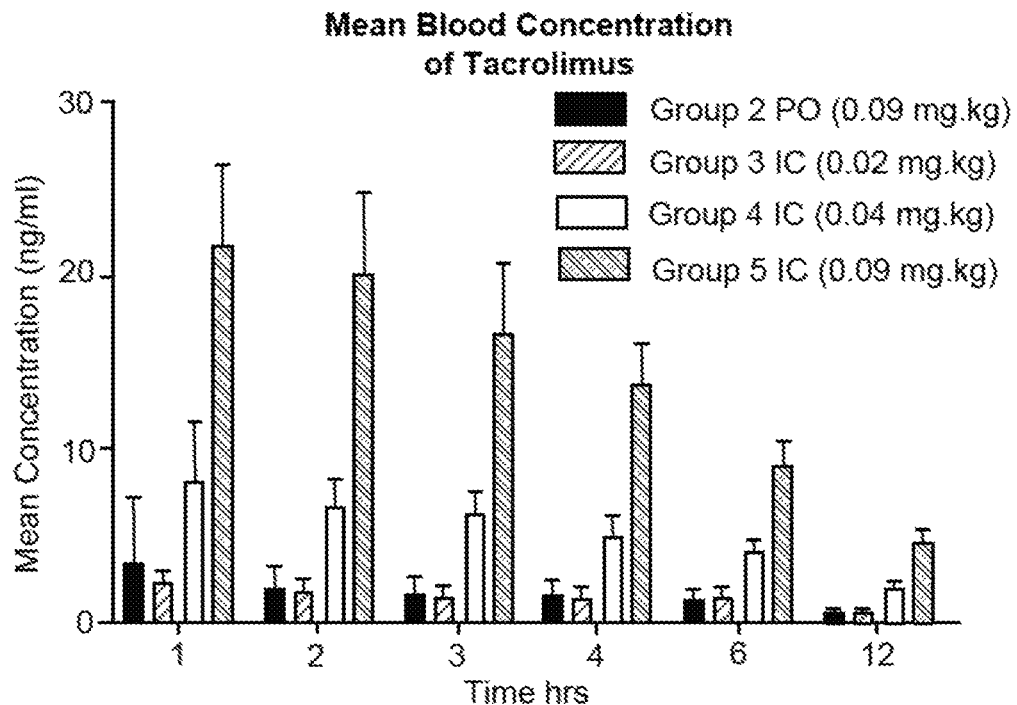
FIG. 77 is a graph showing the mean concentration of tacrolimus in the blood 1 hour, 2 hours, 3 hours, 4 hours, 6 hours and 12 hours after intracecal (IC) or oral administration (PO) of tacrolimus to swine as described in Example 13.
Figure 78:
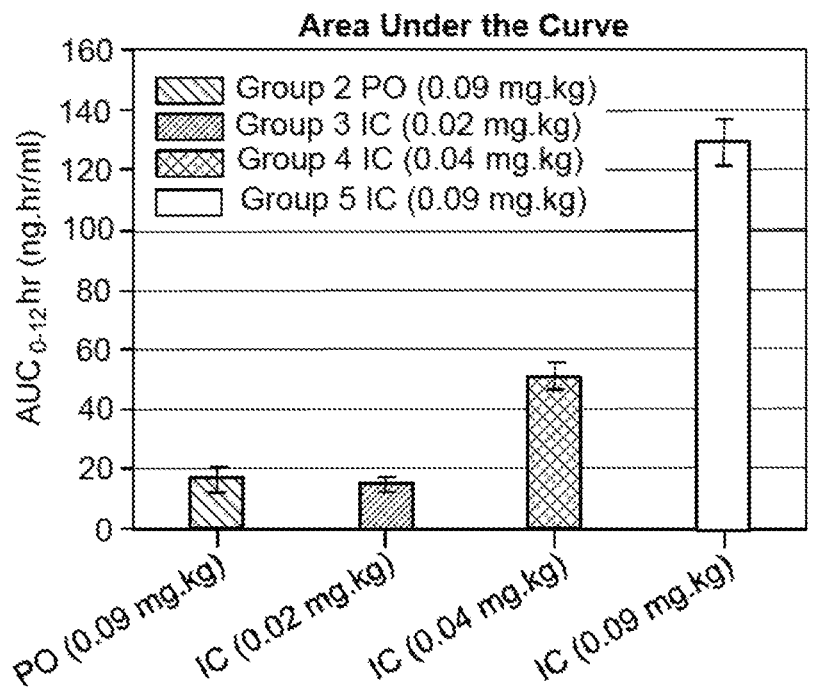
FIG. 78 is a graph showing the $AUC_{0-12\ hours}$ of tacrolimus in the blood after intracecal (IC) or oral administration (PO) of tacrolimus in swine as described in Example 13.
Figure 79:
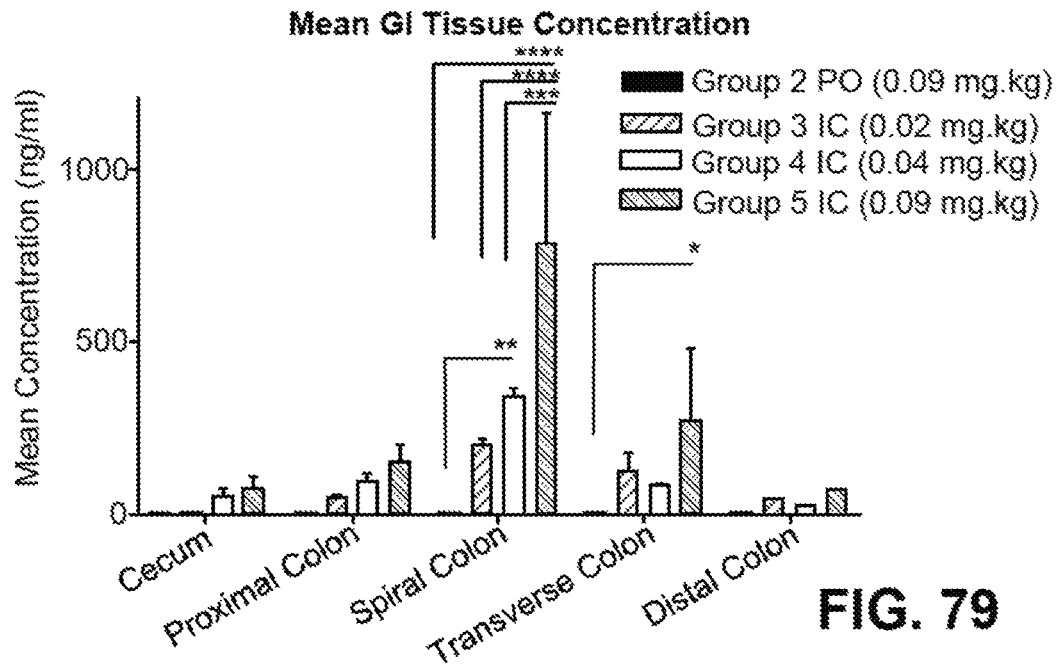
FIG. 79 is a graph showing the mean concentration of tacrolimus in the cecum tissue, the proximal colon tissue, the spiral colon tissue, the transverse colon tissue, and the distal colon tissue after intracecal (IC) or oral administration (PO) of tacrolimus in swine as described in Example 13. **P<0.0001, *P<0.001.
Figure 80:
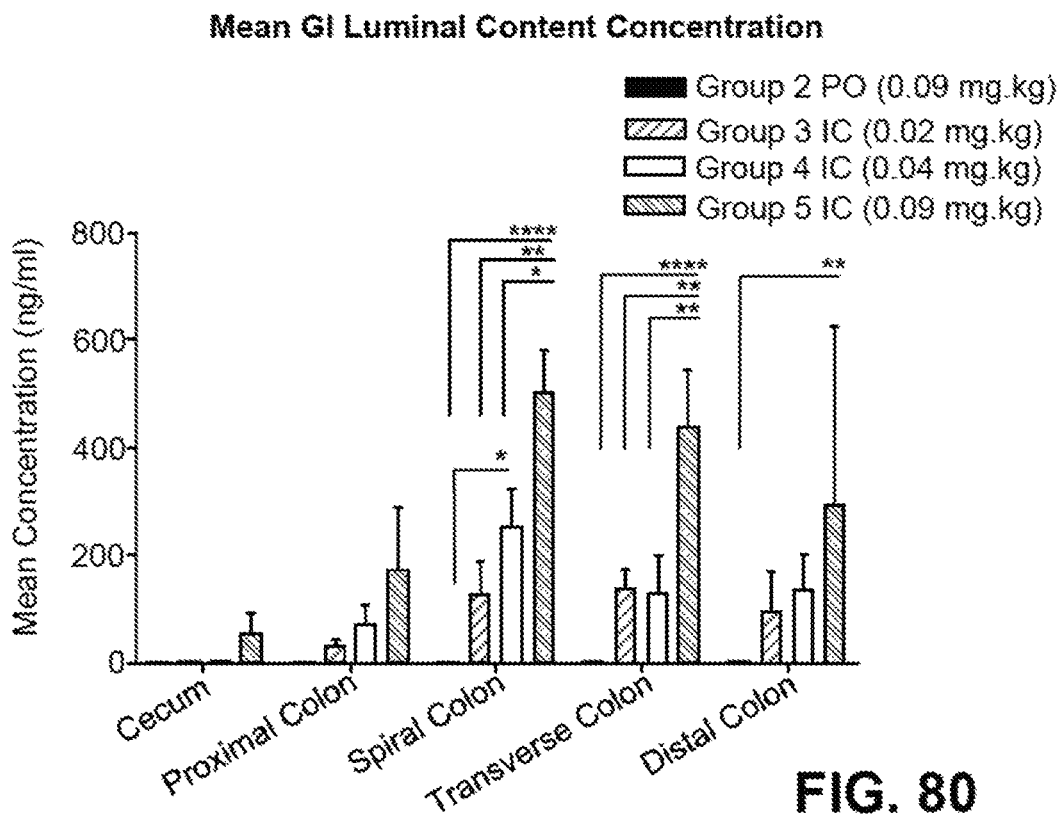
FIG. 80 is a graph showing the mean concentration of tacrolimus in the cecum lumen, the proximal lumen, the spiral colon lumen, the transverse colon lumen, and the distal colon lumen in swine after intracecal (IC) or oral administration (PO) of tacrolimus in swine as described in Example 13. **P<0.0001, *P<0.001
Figure 81:
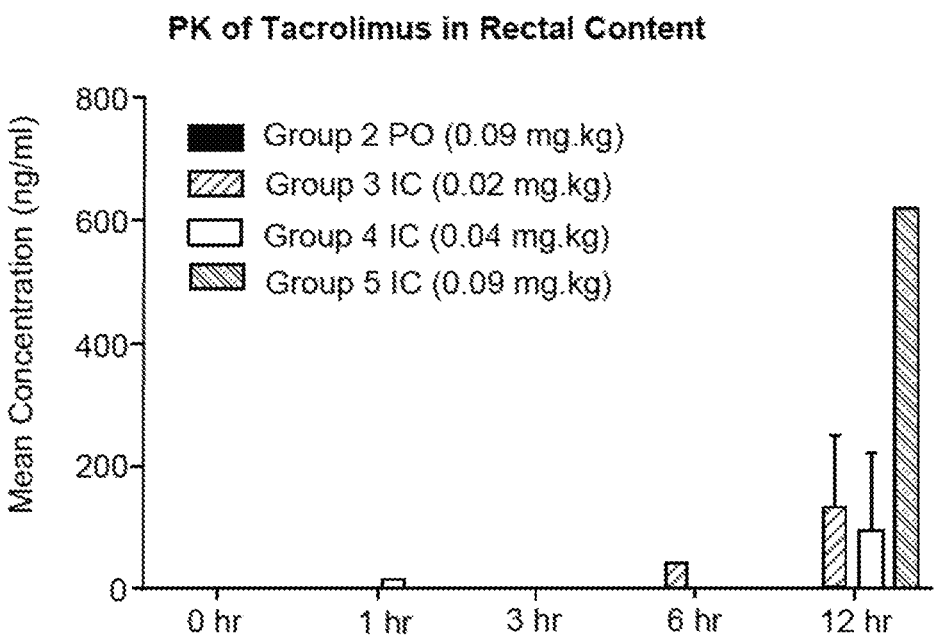
FIG. 81 is a bar graph showing the mean concentration of tacrolimus in the rectal content 1 hour, 3 hours, 6 hours and 12 hours after intracecal (IC) or oral administration (PO) of tacrolimus to swine as described in Example 13.
Figure 82:
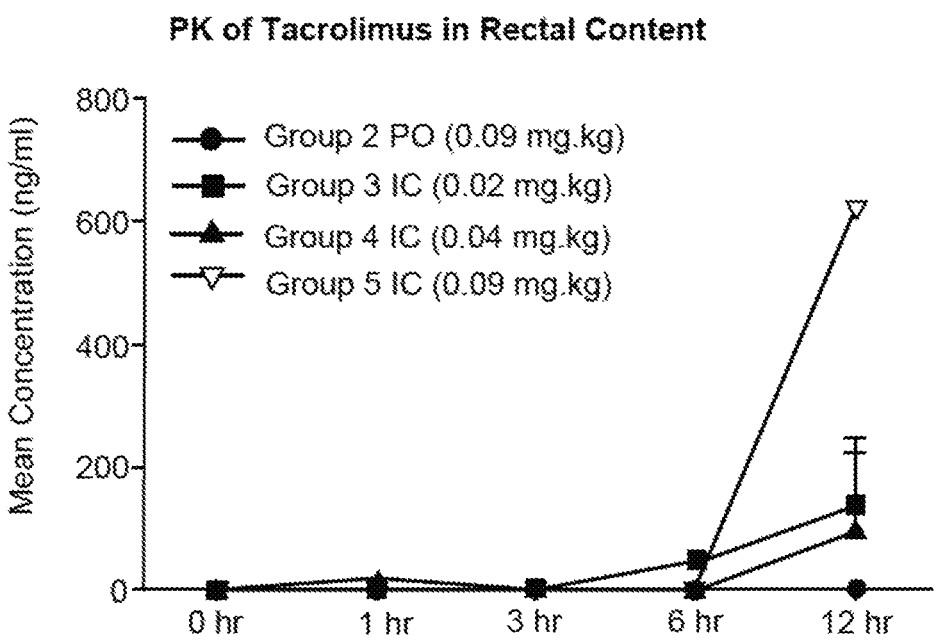
FIG. 82 is a line graph showing the mean concentration of tacrolimus in the rectal content 1 hour, 3 hours, 6 hours and 12 hours after intracecal (IC) or oral administration (PO) of tacrolimus to swine as described in Example 13.

The data in FIGS. 77 and 78 show that the mean concentration and $AUC_{0-12\ hours}$ of tacrolimus in the blood was higher in swine that were intra-cecally administered tacrolimus as compared to swine that were orally administered tacrolimus even at the same concentration (0.09 mg/kg). The data in FIG. 79 show that the mean concentration of tacrolimus in the spiral colon tissue and the transverse colon tissue were statistically higher in swine that were intra-cecally administered tacrolimus as compared to swine that were orally administered tacrolimus. The data in FIG. 80 show that the mean concentration of tacrolimus in the spiral colon lumen, the transverse colon lumen, and the distal colon lumen were statistically higher in swine that were intra-cecally administered tacrolimus as compared to swine that were orally administered tacrolimus. The data in FIGS. 81 and 82 show that the mean concentration of tacrolimus in the rectal content was higher in swine that were intra-cecally administered tacrolimus as compared to swine that were orally administered tacrolimus even at the same concentration, particularly at 12 hours post-dose.

These data suggest that intra-cecal administration of tacrolimus is able to locally deliver tacrolimus to the tissues in the GI tract of a mammal.

A summary of the results are shown in Table 33.

TABLE 33

Summary of Results

| Route | PO | IC | IC | IC |
|---|---|---|---|---|
| Dosage (mg/kg) | 0.09 | 0.02 | 0.04 | 0.09 |
| Cmax (ng/mL) | 3.53 ± 3.84 | 2.39 ± 0.57 | 9.197 ± 3.30 | 21.8 ± 4.73 |
| Trough (12 hr) (ng/mL) | 0.568 ± 0.291 | 0.746 ± 0.038 | 1.96 ± 0.491 | 4.35 ± 0.561 |
| $AUC_{0-12\ hr}$ (ng · hr/mL) | 16.83 ± 3.641 | 15.29 ± 2.36 | 51.35 ± 4.04 | 129.6 ± 7.83 |

Tables 34 and 35 provide the tissue and plasma ratios of the animals in Groups 2-5.

TABLE 34

$Tissue_{(mean)}$ (ng/g)/$AUG_{(0-12\ hr)}$ (ng · hr/mL) ratios

| | Group 2 PO (0.09 mg/kg) | | | Group 3 IC (0.02 mg/kg) | | |
|---|---|---|---|---|---|---|
| | Tissue (ng/g) | AUC 0-12 hr (ng · hr/mL) | Ratio | Tissue (ng/g) | AUC 0-12 hr (ng · hr/mL) | Ratio |
| Cecum | | 16.83 | 0 | | 15.29 | 0.00 |
| Proximal Colon | | 16.83 | 0 | 50.20 | 15.29 | 3.28 |
| Spiral colon | | 16.83 | 0 | 204.00 | 15.29 | 13.34 |
| Transverse colon | | 16.83 | 0 | 128.20 | 15.29 | 8.38 |
| Distal Colon | | 16.83 | 0 | 44.70 | 15.29 | 2.92 |

TABLE 34-continued $Tissue_{(mean)}$ (ng/g)/$AUG_{(0-12\ hr)}$ (ng · hr/mL) ratios

| | Group 4 IC (0.04 mg/kg) | | | Group 5 IC (0.09 mg/kg) | | |
|---|---|---|---|---|---|---|
| | Tissue (ng/g) | AUC 0-12 hr (ng · hr/mL) | Ratio | Tissue (ng/g) | AUC 0-12 hr (ng · hr/mL) | Ratio |
| Cecum | 52.3 | 51.35 | 1.019 | 77.3 | 129.6 | 0.60 |
| Proximal Colon | 98.3 | 51.35 | 1.914 | 157.0 | 129.6 | 1.21 |
| Spiral colon | 342.3 | 51.35 | 6.667 | 783.3 | 129.6 | 6.04 |
| Transverse colon | 85.8 | 51.35 | 1.670 | 272.0 | 129.6 | 2.10 |
| Distal Colon | 28.7 | 51.35 | 0.559 | 67.7 | 129.6 | 0.52 |

TABLE 35

$Tissue_{(mean)}$ (ng/g)/$Trough_{(12\ hr)}$(ng/mL)

| | Group 2 PO (0.09 mg/kg) | | | Group 3 IC (0.02 mg/kg) | | |
|---|---|---|---|---|---|---|
| | Tissue (ng/g) | Trough level (12 hr) | Ratio | Tissue (ng/g) | Trough level (12 hr) | Ratio |
| Cecum | | 0.568 | 0 | | 0.746 | 0.00 |
| Proximal Colon | | 0.568 | 0 | 50.20 | 0.746 | 67.29 |
| Spiral colon | | 0.568 | 0 | 204.00 | 0.746 | 273.46 |
| Transverse colon | | 0.568 | 0 | 128.20 | 0.746 | 171.85 |
| Distal Colon | | 0.568 | 0 | 44.70 | 0.746 | 59.92 |

TABLE 35-continued $Tissue_{(mean)}$ (ng/g)/$Trough_{(12\ hr)}$(ng/mL)

| | Group 4 IC (0.04 mg/kg) | | | Group 5 IC (0.09 mg/kg) | | |
|---|---|---|---|---|---|---|
| | Tissue (ng/g) | Trough level (12 hr) | Ratio | Tissue (ng/g) | Trough level (12 hr) | Ratio |
| Cecum | 52.3 | 1.96 | 26.684 | 77.3 | 4.35 | 17.78 |
| Proximal Colon | 98.3 | 1.96 | 50.136 | 157.0 | 4.35 | 36.09 |
| Spiral colon | 342.3 | 1.96 | 174.660 | 783.3 | 4.35 | 180.08 |
| Transverse colon | 85.8 | 1.96 | 43.759 | 272.0 | 4.35 | 62.53 |
| Distal Colon | 28.7 | 1.96 | 14.643 | 67.7 | 4.35 | 15.56 |

Example 14

An ingestible medical device according to the disclosure ("TLC1") was tested on 20 subjects to investigate its localization ability. TLC1 was a biocompatible polycarbonate ingestible device that contained a power supply, electronics and software. An onboard software algorithm used time, temperature and reflected light spectral data to determine the location of the ingestible device as it traveled the GI tract. The ingestible device is 0.51×1.22 inches which is larger than a vitamin pill which is 0.4×0.85 inches. The subjects fasted overnight before participating in the study. Computerized tomography ("CT") were used as a basis for determining the accuracy of the localization data collected with TLC1. One of the 20 subjects did not follow the fasting rule. CT data was lacking for another one of the 20 subjects. Thus, these two subjects were excluded from further analysis. TLC1 sampled RGB data (radially transmitted) every 15 seconds for the first 14 hours after it entered the subject's stomach, and then samples every five minutes after that until battery dies. TLC1 did not start to record optical data until it reached the subject's stomach. Thus, there was no RGB-based data for the mouth-esophagus transition for any of the subjects.

In addition, a PillCam® SB (Given Imaging) device was tested on 57 subjects. The subjects fasted overnight before joining the study. PillCam videos were recorded within each subject. The sampling frequency of PillCam is velocity dependent. The faster PillCam travels, the faster it would sample data. Each video is about seven to eight hours long, starting from when the ingestible device was administrated into the subject's mouth. RGB optical data were recorded in a table. A physician provided notes on where stomach-duodenum transition and ileum-cecum transition occurred in each video. Computerized tomography ("CT") was used as a basis for determining the accuracy of the localization data collected with PillCam.

Esophagus-Stomach Transition

For TLC1, it was assumed that this transition occurred one minute after the patient ingested the device. For PillCam, the algorithm was as follows:
1. Start mouth-esophagus transition detection after ingestible device is activated/administrated
2. Check whether Green <102.3 and Blue <94.6
   a. If yes, mark as mouth-esophagus transition
   b. If no, continue to scan the data
3. After detecting mouth-esophagus transition, continue to monitor Green and Blue signals for another 30 seconds, in case of location reversal
   a. If either Green >110.1 or Blue >105.5, mark it as mouth-esophagus location reversal
   b. Reset the mouth-esophagus flag and loop through step 2 and 3 until the confirmed mouth-esophagus transition detected
4. Add one minute to the confirmed mouth-esophagus transition and mark it as esophagus-stomach transition For one of the PillCam subjects, there was not a clear cut difference between the esophagus and stomach, so this subject was excluded from future analysis of stomach localization. Among the 56 valid subjects, 54 of them have correct esophagus-stomach transition localization. The total agreement is 54/56=96%. Each of the two failed cases had prolonged esophageal of greater than one minute. Thus, adding one minute to mouth-esophagus transition was not enough to cover the transition in esophagus for these two subjects.

Stomach-Duodenum

For both TLC1 and PillCam, a sliding window analysis was used. The algorithm used a dumbbell shape two-sliding-window approach with a two-minute gap between the front (first) and back (second) windows. The two-minute gap was designed, at least in part, to skip the rapid transition from stomach to small intestine and capture the small intestine signal after ingestible device settles down in small intestine. The algorithm was as follows:
1. Start to check for stomach-duodenum transition after ingestible device enters stomach
2. Setup the two windows (front and back)
   a. Time length of each window: 3 minutes for TLC1; 30 seconds for PillCam
   b. Time gap between two windows: 2 minutes for both devices
   c. Window sliding step size: 0.5 minute for both devices
3. Compare signals in the two sliding windows
   a. If difference in mean is higher than 3 times the standard deviation of Green/Blue signal in the back window
      i. If this is the first time ever, record the mean and standard deviation of signals in the back window as stomach reference
      ii. If mean signal in the front window is higher than stomach reference signal by a certain threshold (0.3 for TLC1 and 0.18 for PillCam), mark this as a possible stomach-duodenum transition
   b. If a possible pyloric transition is detected, continue to scan for another 10 minutes in case of false positive flag
      i. If within this 10 minutes, location reversal is detected, the previous pyloric transition flag is a false positive flag. Clear the flag and continue to check
      ii. If no location reversal has been identified within 10 minutes following the possible pyloric transition flag, mark it as a confirmed pyloric transition
   c. Continue monitoring Green/Blue data for another 2 hours after the confirmed pyloric transition, in case of location reversal
      i. If a location reversal is identified, flag the timestamp when reversal happened and then repeat steps a-c to look for the next pyloric transition
      ii. If the ingestible device has not gone back to stomach 2 hours after previously confirmed pyloric transition, stops location reversal monitoring and assume the ingestible device would stay in intestinal area For TLC1, one of the 18 subjects had too few samples (<3 minutes) taken in the stomach due to the delayed esophagus-stomach transition identification by previously developed localization algorithm. Thus, this subject was excluded from the stomach-duodenum transition algorithm test. For the rest of the TLC1 subjects, CT images confirmed that the detected pyloric transitions for all the subjects were located somewhere between stomach and jejunum. Two out of the 17 subjects showed that the ingestible device went back to stomach after first the first stomach-duodenum transition. The total agreement between the TLC1 algorithm detection and CT scans was 17/17=100%.

For one of the PillCam subjects, the ingestible device stayed in the subject's stomach all the time before the video ended. For another two of the PillCam subjects, too few samples were taken in the stomach to run the localization algorithm. These three PillCam subjects were excluded from the stomach-duodenum transition localization algorithm performance test. The performance summary of pyloric transition localization algorithm for PillCam was as follows:
1. Good cases (48 subjects):
   a. For 25 subjects, our detection matches exactly with the physician's notes b. For 19 subjects, the difference between the two detections is less than five minutes
c. For four subjects, the difference between the two detections is less than 10 minutes (The full transition could take up to 10 minutes before the G/B signal settled)

2. Failed cases (6 subjects):
  a. Four subjects had high standard deviation of Green/Blue signal in the stomach
  b. One subject had bile in the stomach, which greatly affected Green/Blue in stomach
  c. One subject had no Green/Blue change at pyloric transition The total agreement for the PillCam stomach-duodenum transition localization algorithm detection and physician's notes was 48/54=89%.

Duodenum-Jejunum Transition

For TLC1, it was assumed that the device left the duodenum and entered the jejunum three minutes after it was determined that the device entered the duodenum. Of the 17 subjects noted above with respect to the TLC1 investigation of the stomach-duodenum transition, 16 of the subjects mentioned had CT images that confirmed that the duodenum-jejunum transition was located somewhere between stomach and jejunum. One of the 17 subjects had a prolonged transit time in duodenum. The total agreement between algorithm detection and CT scans was 16/17=94%.

For PillCam, the duodenum-jejunum transition was not determined.

Jejunum-Ileum Transition

It is to be noted that the jejunum is redder and more vascular than ileum, and that the jejunum has a thicker intestine wall with more mesentery fat. These differences can cause various optical responses between jejunum and ileum, particularly for the reflected red light signal. For both TLC1 and PillCam, two different approaches were explored to track the change of red signal at the jejunum-ileum transition. The first approach was a single-sliding-window analysis, where the window is 10 minutes long, and the mean signal was compared with a threshold value while the window was moving along. The second approach was a two-sliding-window analysis, where each window was 10 minutes long with a 20 minute spacing between the two windows. The algorithm for the jejunum-ileum transition localization was as follows:

1. Obtain 20 minutes of Red signal after the duodenum-jejunum transition, average the data and record it as the jejunum reference signal
2. Start to check the jejunum-ileum transition 20 minutes after the device enters the jejunum
  a. Normalize the newly received data by the jejunum reference signal
  b. Two approaches:
    i. Single-sliding-window analysis
      1. Set the transition flag if the mean of reflected red signal is less than 0.8
    ii. Two-sliding-window analysis:
      1. Set the transition flag if the mean difference in reflected red is higher than 2× the standard deviation of the reflected red signal in the front window For TLC1, 16 of the 18 subjects had CT images that confirmed that the detected jejunum-ileum transition fell between jejunum and cecum. The total agreement between algorithm and CT scans was 16/18=89%. This was true for both the single-sliding-window and double-sliding-window approaches, and the same two subjects failed in both approaches.

The performance summary of the jejunum-ileum transition detection for PillCam is listed below:

1. Single-sliding-window analysis:
  a. 11 cases having jejunum-ileum transition detected somewhere between jejunum and cecum
  b. 24 cases having jejunum-ileum transition detected after cecum
  c. 19 cases having no jejunum-ileum transition detected
  d. Total agreement: 11/54=20%
2. Two-sliding-window analysis:
  a. 30 cases having jejunum-ileum transition detected somewhere between jejunum and cecum
  b. 24 cases having jejunum-ileum transition detected after cecum
  c. Total agreement: 30/54=56%

Ileum-Cecum Transition

Data demonstrated that, for TLC1, mean signal of reflected red/green provided the most statistical difference before and after the ileum-cecum transition. Data also demonstrated that, for TLC1, the coefficient of variation of reflected green/blue provided the most statistical contrast at ileum-cecum transition. The analysis based on PillCam videos showed very similar statistical trends to those results obtained with TLC1 device. Thus, the algorithm utilized changes in mean value of reflected red/green and the coefficient of variation of reflected green/blue. The algorithm was as follows:

1. Start to monitor ileum-cecum transition after the ingestible device enters the stomach
2. Setup the two windows (front (first) and back (second))
  a. Use a five-minute time length for each window
  b. Use a 10-minute gap between the two windows
  c. Use a one-minute window sliding step size
3. Compare signals in the two sliding windows
  a. Set ileum-cecum transition flag if
    i. Reflected red/green has a significant change or is lower than a threshold
    ii. Coefficient of variation of reflected green/blue is lower than a threshold
  b. If this is the first ileum-cecum transition detected, record average reflected red/green signal in small intestine as small intestine reference signal
  c. Mark location reversal (i.e. ingestible device returns to terminal ileum) if
    i. Reflected red/green is statistically comparable with small intestine reference signal
    ii. Coefficient of variation of reflected green/blue is higher than a threshold
  d. If a possible ileum-cecum transition is detected, continue to scan for another 10 minutes for TLC1 (15 minutes for PillCam) in case of false positive flag
    i. If within this time frame (10 minutes for TLC1, 15 minutes for PillCam), location reversal is detected, the previous ileum-cecum transition flag is a false positive flag. Clear the flag and continue to check
    ii. If no location reversal has been identified within this time frame (10 minutes for TLC1, 15 minutes for PillCam) following the possible ileum-cecum transition flag, mark it as a confirmed ileum-cecum transition
  e. Continue monitoring data for another 2 hours after the confirmed ileum-cecum transition, in case of location reversal i. If a location reversal is identified, flag the timestamp when reversal happened and then repeat steps a-d to look for the next ileum-cecum transition ii. If the ingestible device has not gone back to small intestine 2 hours after previously confirmed ileum-cecum transition, stop location reversal monitoring and assume the ingestible device would stay in large intestinal area The flag setting and location reversal criteria particularly designed for TLC1 device were as follows:

1. Set ileum-cecum transition flag if
   a. The average reflected red/Green in the front window is less than 0.7 or mean difference between the two windows is higher than 0.6
   b. And the coefficient of variation of reflected green/blue is less than 0.02
2. Define as location reversal if
   a. The average reflected red/green in the front window is higher than small intestine reference signal
   b. And the coefficient of variation of reflected green/blue is higher than 0.086

For TLC1, 16 of the 18 subjects had CT images that confirmed that the detected ileum-cecum transition fell between terminal ileum and colon. The total agreement between algorithm and CT scans was 16/18=89%. Regarding those two subject where the ileum-cecum transition localization algorithm failed, for one subject the ileum-cecum transition was detected while TLC1 was still in the subject's terminal ileum, and for the other subject the ileum-cecum transition was detected when the device was in the colon.

Among the 57 available PillCam endoscopy videos, for three subjects the endoscopy video ended before PillCam reached cecum, and another two subjects had only very limited video data (less than five minutes) in the large intestine. These five subjects were excluded from ileum-cecum transition localization algorithm performance test. The performance summary of ileum-cecum transition detection for PillCam is listed below:

1. Good cases (39 subjects):
   a. For 31 subjects, the difference between the PillCam detection and the physician's notes was less than five minutes
   b. For 3 subjects, the difference between the PillCam detection and the physician's notes was less than 10 minutes
   c. For 5 subjects, the difference between the PillCam detection and the physician's notes was less than 20 minutes (the full transition can take up to 20 minutes before the signal settles)
2. Marginal/bad cases (13 subjects):
   a. Marginal cases (9 subjects)
      i. The PillCam ileum-cecum transition detection appeared in the terminal ileum or colon, but the difference between the two detections was within one hour
   b. Failed cases (4 subjects)
      i. Reasons of failure:
         The signal already stabilized in the terminal ileum
         The signal was highly variable from the entrance to exit.
         There was no statistically significant change in reflected red/green at ileum-cecum transition The total agreement between ileocecal transition localization algorithm detection and the physician's notes is 39/52=75% if considering good cases only. Total agreement including possibly acceptable cases is 48/52=92.3%.

Cecum-Colon Transition

Data demonstrated that, for TLC1, mean signal of reflected red/green provided the most statistical difference before and after the cecum-colon transition. Data also demonstrated that, for TLC1, the coefficient of variation of reflected blue provided the most statistical contrast at cecum-colon transition. The same signals were used for PillCam. The cecum-colon transition localization algorithm was as follows:

Obtain 10 minutes of reflected red/green and reflected blue signals after ileum-cecum transition, average the data and record it as the cecum reference signals Start to check cecum-colon transition after ingestible device enters cecum (The cecum-colon transition algorithm is dependent on the ileum-cecum transition flag)

Normalize the newly received data by the cecum reference signals

Two-sliding-window analysis:
   Use two adjacent 10 minute windows
   Set the transition flag if any of the following criteria were met.
      The mean difference in reflected red/green was more than 4× the standard deviation of reflected red/green in the back (second) window.
      The mean of reflected red/green in the front (first) window was higher than 1.03
      The coefficient of variation of reflected blue signal in the front (first) window was greater than 0.23

The threshold values above were chosen based on a statistical analysis of data taken by TLC1.

For TLC1, 15 of the 18 subjects had the cecum-colon transition detected somewhere between cecum and colon. One of the subjects had the cecum-colon transition detected while TLC1 was still in cecum. The other two subjects had both wrong ileum-cecum transition detection and wrong cecum-colon transition detection. The total agreement between algorithm and CT scans was 15/18-83%.

For PillCam, for three subjects the endoscopy video ended before PillCam reached cecum, and for another two subjects there was very limited video data (less than five minutes) in the large intestine. These five subjects were excluded from cecum-colon transition localization algorithm performance test. The performance summary of cecum-colon transition detection for PillCam is listed below:

1. 27 cases had the cecum-colon transition detected somewhere between the cecum and the colon
2. one case had the cecum-colon transition detected in the ileum
3. 24 cases had no cecum-colon transition localized The total agreement: 27/52=52%.

The following table summarizes the localization accuracy results.

| Transition | TLC1 | PillCam |
| --- | --- | --- |
| Stomach-Duodenum | 100% (17/17) | 89% (48/54) |
| Duodenum-Jejunum | 94% (16/17) | N/A |
| Ileum-Cecum | 89% (16/18) | 75% (39/52) |
| Ileum-terminal ileum/cecum/colon | 100% (18/18) | 92% (48/52) |

Example 15

In the following cases, each subject is treated by administering a device as disclosed herein containing a drug, or a pharmaceutical formulation containing a drug, the device having a self-localization mechanism that autonomously determines the device location within the subject's GI tract. The device localization mechanism includes one or more sensors associated with the device that detects light reflectance that is external to the device and present in the GI tract. Based on pre-determined identification of disease site(s) in a particular section or subsection of the GI tract, as disclosed in each case, the device is pre-programmed with instructions to release the drug, or the pharmaceutical formulation containing the drug, to or proximal to the section of the GI tract containing the disease site(s). The instructions are provided from at least one processor and/or at least one controller associated with the at least one sensor. The device contains a therapeutically effective amount of the drug (preferably, tacrolimus, or a pharmaceutically acceptalt salt thereof, optionally formulated as a solution containing ethanol and Cremophor, for example, Prograf® concentrate; or cyclosporin A, or a pharmaceutically acceptable salt thereof).

In some cases, a second agent is administered. In some particular cases, the second agent is a second immunosuppressant, a JAK inhibitor, an SIP modulator, a PDE4 inhibitor, an IL-12/IL-23 inhibitor, an integrin inhibitor, or an anti-TNF agent.

Example 15-1a—Treatment of inflammatory disease site(s) in the duodenum by releasing Drug in the Duodenum In the following 4 cases, based on pre-determined identification of disease site(s) in the duodenum, the device is pre-programmed with instructions to release the drug to the duodenum to treat the disease site(s).

(i) A 34-year old male subject suffering from symptoms of gastrointestinal inflammation walks into a clinic. The subject returns for an endoscopy, which reveals that he has disease site(s) in the tissue in the duodenum. Subsequently, the subject is orally administered the ingestible device containing the therapeutically effective amount of the drug. After ingestion of the device, data collected from at least one of the light sensors, optionally in conjunction with elapsed time through the GI tract after the oral administration, indicate that the device has transitioned from the stomach to the duodenum with at least about 90% accuracy. In this particular case, the light reflectance detected by the sensors includes green light and blue light; an increase in the ratio of the green to blue reflectance is used to determine that the device has transitioned from the stomach to the duodenum. The drug or pharmaceutical formulation containing the drug is then released from the device based on the instructions, providing topical delivery of the drug, or the pharmaceutical formulation containing the drug, to the duodenum containing one or more disease sites. In a follow-up visit, the subject undergoes a repeat endoscopy to determine the effect of the treatment.

(ii) Treatment of diffuse duodenitis associated with pancolonic ulcerative colitis in the duodenum by releasing drug in the duodenum. A 45-year old subject with a history of pancolonic ulcerative colitis undergoes laparoscopy-assisted proctocolectomy due to severe steroid-resistant disease. Two weeks after the surgery, the subject complains of epigastralia and tarry stool. The subject undergoes an endoscopy of the upper gastrointestinal tract with biopsy and histology, which reveals that the subject has disease site(s) in the tissue in the duodenum. Subsequently, the subject is orally administered the ingestible device containing the therapeutically effective amount of the drug. After ingestion of the device, data collected from at least one of the light sensors, optionally in conjunction with elapsed time through the GI tract after the oral administration, indicate that the device has transitioned from the stomach to the duodenum with at least about 90% accuracy. In this particular case, the light reflectance detected by the sensors includes green light and blue light; an increase in the ratio of the green to blue reflectance is used to determine that the device has transitioned from the stomach to the duodenum. The drug, or the pharmaceutical formulation containing the drug, is then released from the device based on the instructions, providing topical delivery of the drug, or the pharmaceutical formulation containing the drug, to the duodenum containing one or more disease sites. The subject subsequently undergoes an endoscopy to determine the effect of the treatment.

(iii) Treatment of gastroduodenal Crohn's disease by releasing drug in the duodenum. A 33-year old subject suffering from one month of epigastric pain and dyspepsia visits an outpatient clinic. The subject undergoes esophago-gastroduodenoscopy (EGD) with biopsy, which reveals multiple progressive ulcers and erosions in the tissue in the duodenum. Subsequently, the subject is orally administered the ingestible device containing the therapeutically effective amount of the drug. After ingestion of the device, data collected from at least one of the light sensors, optionally in conjunction with elapsed time through the GI tract after the oral administration, indicate that the device has transitioned from the stomach to the duodenum with at least about 90% accuracy. In this particular case, the light reflectance detected by the sensors includes green light and blue light; an increase in the ratio of the green to blue reflectance is used to determine that the device has transitioned from the stomach to the duodenum. The drug, or the pharmaceutical formulation containing the drug, is then released from the device based on the instructions, providing topical delivery of the drug, or the pharmaceutical formulation containing the drug, to the duodenum containing one or more disease sites. The subject subsequently undergoes an endoscopy to determine the effect of the treatment.

(iv) Treatment of gastroduodenal Crohn's disease by releasing drug in the duodenum. A 26-year old female subject suffering from nausea, weight loss and loss of appetite sees a gastroenterologist. The subject undergoes an endoscopy, which reveals gastroduodenal Crohn's disease affecting the subject's duodenum. Subsequently, the subject is orally administered the ingestible device containing the therapeutically effective amount of the drug. ingestion of the device, data collected from at least one of the light sensors, optionally in conjunction with elapsed time through the GI tract after the oral administration, indicate that the device has transitioned from the stomach to the duodenum with at least about 90% accuracy. In this particular case, the light reflectance detected by the sensors includes green light and blue light; an increase in the ratio of the green to blue reflectance is used to determine that the device has transitioned from the stomach to the duodenum. The drug, or the pharmaceutical formulation containing the drug, is then released from the device based on the instructions, providing topical delivery of the drug, or the pharmaceutical formulation containing the drug, to the duodenum containing one or more disease sites. In a follow-up visit, the subject undergoes a repeat endoscopy to determine the effect of the treatment.

Example 15-1b—Treatment of Inflammatory
Disease Site(s) in the Jejunum by Releasing Drug
in the Jejunum In the following 2 cases, based on pre-determined identification of disease site(s) in the jejunum, as disclosed in each case, the device is pre-programmed with instructions to release the drug to the jejunum to treat the disease site(s).

(i) A 68-year old female subject suffering from symptoms of gastrointestinal pain and discomfort goes to see her doctor. The subject subsequently undergoes a video endoscopy, which reveals disease site(s) in the tissue in the jejunum. Subsequently, the subject is orally administered the ingestible device containing the therapeutically effective amount of the drug. After ingestion of the device, data collected from at least one of the light sensors, together with elapsed time through the GI tract after the oral administration, indicates that the device has transitioned to the jejunum with at least about 90% accuracy. In this particular case, the light reflectance detected by the sensors includes green light and blue light; an increase in the ratio of the green to blue reflectance is used to determine that the device has transitioned from the stomach to the duodenum; a period of elapsed time (about 3 minutes) after the transition to the duodenum is then used to determine that the device has transitioned from the duodenum to the jejunum. Optionally, peristaltic contraction frequency data are used to corroborate that the device has entered the jejunum. The drug, or the pharmaceutical formulation containing the drug, is then released from the device based on the instructions, providing topical delivery of the drug, or the pharmaceutical formulation containing the drug, to the jejunum containing one or more disease sites. The subject subsequently undergoes an endoscopy to determine the effect of the treatment.

(ii) Treatment of Crohn's disease in the jejunum by releasing drug in the jejunum. A subject having unexplained weight loss and fever goes to urgent care. The subject later undergoes an endoscopy, which reveals that the subject has disease site(s) in the tissue in the jejunum associated with Crohn's disease. Subsequently, the subject is orally administered the ingestible device containing the therapeutically effective amount of the drug. After ingestion of the device, data collected from at least one of the light sensors, together with elapsed time through the GI tract after the oral administration, indicates that the device has transitioned to the jejunum with at least about 90% accuracy. In this particular case, the light reflectance detected by the sensors includes green light and blue light; an increase in the ratio of the green to blue reflectance is used to determine that the device has transitioned from the stomach to the duodenum; a period of elapsed time (about 3 minutes) after the transition to the duodenum is then used to determine that the device has transitioned from the duodenum to the jejunum.

Optionally, peristaltic contraction frequency data are used to corroborate that the device has entered the jejunum. The drug, or the pharmaceutical formulation containing the drug, is then released from the device based on the instructions, providing topical delivery of the drug, or the pharmaceutical formulation containing the drug, to the jejunum containing one or more disease sites. The subject subsequently undergoes an endoscopy to determine the effect of the treatment.

Example 15-1c—Treatment of Inflammatory
Disease Site(s) in the Ileum by Releasing Drug in
the Ileum In the following 3 cases, based on pre-determined identification of disease site(s) in the ileum, as disclosed in each case, the device is pre-programmed with instructions to release the drug to the ileum to treat the disease site(s).

(i) A 42-year old female subject suffering from gastrointestinal cramping and fatigue makes an appointment with a gastroenterologist. The subject undergoes an endoscopy, which reveals that she has disease site(s) in the tissue in the ileum. Subsequently, the subject is orally administered the ingestible device containing the therapeutically effective amount of the drug. After ingestion of the device, data collected from at least one of the light sensors, together with elapsed time through the GI tract after the oral administration, indicates that the device has transitioned from the jejunum to the ileum with at least about 80% accuracy. In this particular case, the light reflectance detected by the sensors includes red light. Once the device has reached the jejunum (essentially as determined in Example 15-1b (i)), a detected decrease in red light reflectance is used to determine that the device has transitioned from the jejunum to the ileum. The drug, or the pharmaceutical formulation containing the drug, is then released from the device based on the instructions, providing topical delivery of the drug, or the pharmaceutical formulation containing the drug, to the ileum containing one or more disease sites. The subject subsequently undergoes an endoscopy to determine the effect of the treatment.

(ii) Treatment of ulcerative colitis with backwash ilcitis by releasing drug in the ileum. A 42-year old female subject with a history of pancolitis visits her treating physician. The subject undergoes an endoscopy, which reveals that the subject has patchy cryptitis and crypt abscesses in the distal ileum thought to be due to backwash of cecal contents ("backwash ileitis"). Subsequently, the subject is orally administered the ingestible device containing the therapeutically effective amount of the drug. After ingestion of the device, data collected from at least one of the light sensors, together with elapsed time through the GI tract after the oral administration, indicates that the device has transitioned from the jejunum to the ileum with at least about 80% accuracy. In this particular case, the light reflectance detected by the sensors includes red light. Once the device has reached the jejunum (essentially as determined in Example 15-1b (i)), a detected decrease in red light reflectance is used to determine that the device has transitioned from the jejunum to the ileum. The drug, or the pharmaceutical formulation containing the drug, is then released from the device based on the instructions, providing topical delivery of the drug, or the pharmaceutical formulation containing the drug, to the ileum containing one or more disease sites. The subject subsequently undergoes an endoscopy to determine the effect of the treatment.

(iii) Treatment of Crohn's disease in the ileum by releasing drug in the ileum. A subject suffering from symptoms of Crohn's disease, including abdominal pain and cramping, walks into a clinic. The subject undergoes an endoscopy, which reveals that the subject has disease site(s) in the tissue in the ileum. Subsequently, the subject is orally administered the ingestible device containing the therapeutically effective amount of the drug. After ingestion of the device, data collected from at least one of the light sensors, together with elapsed time through the GI tract after the oral administration, indicates that the device has transitioned from the jejunum to the ileum with at least about 80% accuracy. In this particular case, the light reflectance detected by the sensors includes red light. Once the device has reached the jejunum (essentially as determined in Example 15-1b (i)), a detected decrease in red light reflectance is used to determine that the device has transitioned from the jejunum to the ileum. The drug, or the pharmaceutical formulation containing the drug, is then released from the device based on the instructions, providing topical delivery of the drug, or the pharmaceutical formulation containing the drug, to the ileum containing one or more disease sites. The subject subsequently undergoes an endoscopy to determine the effect of the treatment.

Example 15-1d—Treatment of Inflammatory Disease Site(s) in the Cecum by Releasing Drug in the Cecum In the following 3 cases, based on pre-determined identification of disease site(s) in the cecum, as disclosed in each case, the device is pre-programmed with instructions to release the drug to the cecum to treat the disease site(s).

(i) A 25-year old male subject suffering from symptoms of gastrointestinal inflammation walks into a clinic. The subject undergoes an endoscopy, which reveals disease site(s) in the tissue in the cecum. Subsequently, the subject is orally administered the ingestible device containing the therapeutically effective amount of the drug. After ingestion of the device, data collected from at least one of the light sensors, optionally in conjunction with elapsed time through the GI tract after the oral administration, indicates that the device has transitioned to the cecum with at least about 80% accuracy. In this particular case, the light reflectance detected by the sensors includes red, green and blue light. A decrease in the ratio of the red to green reflectance, together with a decrease in the ratio of the green to blue reflectance, are used to determine that the device has transitioned from the ileum to the cecum. The drug, or the pharmaceutical formulation containing the drug, is then released from the device based on the instructions, providing topical delivery of the drug, or the pharmaceutical formulation containing the drug, to the cecum containing one or more disease sites. The subject subsequently undergoes an endoscopy to determine the effect of the treatment.

(ii) Treatment of ulcerative colitis in the cecum by releasing drug in the cecum. A subject with a history of ulcerative colitis returns to the clinic. The subject undergoes an endoscopy, which reveals that the subject has disease site(s) in the tissue in the cecum. Subsequently, the subject is orally administered the ingestible device containing the therapeutically effective amount of the drug. After ingestion of the device, data collected from at least one of the light sensors, optionally in conjunction with elapsed time through the GI tract after the oral administration, indicates that the device has transitioned to the cecum with at least about 80% accuracy. In this particular case, the light reflectance detected by the sensors includes red, green and blue light. A decrease in the ratio of the red to green reflectance, together with a decrease in the ratio of the green to blue reflectance, are used to determine that the device has transitioned from the ileum to the cecum. The drug, or the pharmaceutical formulation containing the drug, is then released from the device based on the instructions, providing topical delivery of the drug, or the pharmaceutical formulation containing the drug, to the cecum containing one or more disease sites. The subject subsequently undergoes an endoscopy to determine the effect of the treatment.

(iii) Treatment of Crohn's disease in the cecum by releasing drug in the cecum. A subject suffering from symptoms of Crohn's disease, including fatigue, reduced appetite and frequent, recurring diarrhea goes to a local clinic. The subject undergoes an endoscopy, which reveals that the subject has disease site(s) in the tissue in the cecum. Subsequently, the subject is orally administered the ingestible device containing the therapeutically effective amount of the drug. After ingestion of the device, data collected from at least one of the light sensors, optionally in conjunction with elapsed time through the GI tract after the oral administration, indicates that the device has transitioned to the cecum with at least about 80% accuracy. In this particular case, the light reflectance detected by the sensors includes red, green and blue light. A decrease in the ratio of the red to green reflectance, together with a decrease in the ratio of the green to blue reflectance, are used to determine that the device has transitioned from the ileum to the cecum. The drug, or the pharmaceutical formulation containing the drug, is then released from the device based on the instructions, providing topical delivery of the drug, or the pharmaceutical formulation containing the drug, to the cecum containing one or more disease sites. The subject subsequently undergoes an endoscopy to determine the effect of the treatment.

Example 15-1e—Treatment of Inflammatory Disease Site(s) in the Colon by Releasing Drug in the Colon In the following 3 cases, based on pre-determined identification of disease site(s) in the colon, as disclosed in each case, the device is pre-programmed with instructions to release the drug into the colon to treat the disease site(s).

(i) A 57-year old male subject suffering frequent, recurring diarrhea goes to an outpatient facility for an endoscopy, which reveals disease site(s) in the tissue in the colon. The subject undergoes an endoscopy, which reveals that the subject has disease site(s) in the tissue in the colon. Subsequently, the subject is orally administered the ingestible device containing the therapeutically effective amount of the drug. After ingestion of the device, data collected from at least one of the light sensors, together with elapsed time through the GI tract after the oral administration, indicates that the device has transitioned into the colon with at least about 80% accuracy. In this particular case, the light reflectance detected by the sensors includes red, green light and blue light. Once the device is localized to the cecum (essentially as described in Example 15-1d (i)), a change in the ratio of the red to green reflectance is used to determine that the device has transitioned from the cecum further into the colon. Alternatively or additionally, a change in the coefficient of variation (CV) of the detected blue reflectance is used to determine that the device has transitioned from the cecum further into the colon. The drug, or the pharmaceutical formulation containing the drug, is then released from the device based on the instructions, providing topical delivery of the drug, or the pharmaceutical formulation containing the drug, to the colon containing one or more disease sites. The subject subsequently undergoes an endoscopy to determine the effect of the treatment.

(ii) Treatment of ulcerative colitis in the colon by releasing drug in the colon. A subject suffering from tenesumus and rectal bleeding sees a gastroenterologist. The subject undergoes an endoscopy, which reveals that the subject has disease site(s) in the tissue in the colon. Subsequently, the subject is orally administered the ingestible device containing the therapeutically effective amount of the drug. After ingestion of the device, data collected from at least one of the light sensors, together with elapsed time through the GI tract after the oral administration, indicates that the device has transitioned into the colon with at least about 80% accuracy. In this particular case, the light reflectance detected by the sensors includes red, green light and blue light. Once the device is localized to the cecum (essentially as described in Example 15-1d (i)), a change in the ratio of the red to green reflectance is used to determine that the device has transitioned from the cecum to the colon. Alternatively or additionally, a change in the coefficient of variation (CV) of the detected blue reflectance is used to determine that the device has transitioned from the cecum to the colon. The drug, or the pharmaceutical formulation containing the drug, is then released from the device based on the instructions, providing topical delivery of the drug, or the pharmaceutical formulation containing the drug, to the jejunum containing one or more disease sites. The subject subsequently undergoes an endoscopy to determine the effect of the treatment.

(iii) Treatment of Crohn's disease in the colon by releasing drug in the colon. A subject suffering from Crohn's disease undergoes an endoscopy, which reveals disease site(s) in the tissue in the colon. Subsequently, the subject is orally administered the ingestible device containing the therapeutically effective amount of the drug. After ingestion of the device, data collected from at least one of the light sensors, together with elapsed time through the GI tract after the oral administration, indicates that the device has transitioned into the colon with at least about 80% accuracy. In this particular case, the light reflectance detected by the sensors includes red, green light and blue light. Once the device is localized to the cecum (essentially as described in Example 15-1d (i)), a change in the ratio of the red to green reflectance is used to determine that the device has transitioned from the cecum to the colon. Alternatively or additionally, a change in the coefficient of variation (CV) of the detected blue reflectance is used to determine that the device has transitioned from the cecum to the colon. The drug, or the pharmaceutical formulation containing the drug, is then released from the device based on the instructions, providing topical delivery of the drug, or the pharmaceutical formulation containing the drug, to the colon containing one or more disease sites. The subject subsequently undergoes an endoscopy to determine the effect of the treatment.

Example 15-1f—Treatment of Inflammatory Disease Site(s) in the Stomach by Releasing Drug in the Stomach A subject suffering from nausea, weight loss and loss of appetite sees a gastroenterologist. The subject undergoes an endoscopy, which reveals disease site(s) in the stomach. Subsequently the subject is orally administered an ingestible device as disclosed herein containing a therapeutically effective amount of drug. The device contains a self-localization mechanism that autonomously determines the device location within the subject's GI tract. The device localization mechanism includes one or more sensors associated with the device that detects light reflectance that is external to the device and present in the GI tract. The device is pre-programmed with instructions to release the drug to the stomach. The instructions are provided from at least one processor and/or at least one controller associated with the at least one sensor. After ingestion of the device, data collected from at least one of the light sensors, in conjunction with elapsed time (about 1 minute) after the oral administration, indicates that the device has entered the stomach. The drug, or the pharmaceutical formulation containing the drug, is then released from the device based on the instructions, providing topical delivery of the drug, or the pharmaceutical formulation containing the drug, to the stomach containing one or more disease sites. The subject subsequently undergoes an endoscopy to determine the effect of the treatment.

Example 15-2a—Treatment of Inflammatory Disease Site(s) in the Jejunum by Releasing Drug in the Duodenum In the following 2 cases, based on pre-determined identification of disease site(s) in the jejunum, as disclosed in each case, the device is pre-programmed with instructions to release the drug to the duodenum to treat the disease site(s).

(i) A subject suffering from symptoms of a gastrointestinal inflammatory disease walks sees her doctor. The subject later undergoes an endoscopy with biopsy, which reveals disease site(s) in the tissue in the jejunum. Subsequently, the subject is orally administered the ingestible device containing the therapeutically effective amount of the drug. After ingestion of the device, data collected from at least one of the light sensors, optionally in conjunction with elapsed time through the GI tract after the oral administration, indicate that the device has transitioned from the stomach to the duodenum with at least about 90% accuracy. In this particular case, the light reflectance detected by the sensors includes green light and blue light; an increase in the ratio of the green to blue reflectance is used to determine that the device has transitioned from the stomach to the duodenum. The drug, or the pharmaceutical formulation containing the drug, is then released from the device based on the instructions, providing topical delivery of the drug, or the pharmaceutical formulation containing the drug, to the jejunum containing one or more disease sites. The subject subsequently undergoes an endoscopy to determine the effect of the treatment.

(ii) Treatment of Crohn's disease in the jejunum by releasing drug in the duodenum. A subject suffering from abdominal pain, cramping after meals, and diarrhea is diagnosed by endoscopy with jejunoileitis, a form of Crohn's disease that affects the jejunum. Subsequently, the subject is orally administered the ingestible device containing the therapeutically effective amount of the drug. After ingestion of the device, data collected from at least one of the light sensors, optionally in conjunction with elapsed time through the GI tract after the oral administration, indicate that the device has transitioned from the stomach to the duodenum with at least about 90% accuracy. In this particular case, the light reflectance detected by the sensors includes green light and blue light; an increase in the ratio of the green to blue reflectance is used to determine that the device has transitioned from the stomach to the duodenum. The drug, or the pharmaceutical formulation containing the drug, is then released from the device based on the instructions, providing topical delivery of the drug, or the pharmaceutical formulation containing the drug, to the jejunum containing one or more disease sites. The subject subsequently undergoes an endoscopy to determine the effect of the treatment.

Example 15-2b—Treatment of Inflammatory Disease Site(s) in the Ileum by Releasing Drug in the Jejunum In the following 3 cases, each subject is treated by administering a device as disclosed herein containing a self-localization mechanism that autonomously determines the device location within the subject's GI tract. The device localization mechanism includes one or more sensors associated with the device that detects light reflectance that is external to the device and present in the GI tract. Based on pre-determined identification of disease site(s) in the ileum, as disclosed in each case, the device is pre-programmed with instructions to release the drug to the jejunum to treat the disease site(s). The instructions are provided from at least one processor and/or at least one controller associated with the at least one sensor. The device contains a therapeutically effective amount of drug.

(i) A subject suffering from symptoms of gastrointestinal inflammation and recent weight loss walks into a clinic. The subject undergoes an endoscopy, which reveals that the subject has disease site(s) in the tissue in the ileum. Subsequently, the subject is orally administered the ingestible device containing the therapeutically effective amount of the drug. After ingestion of the device, data collected from at least one of the light sensors, together with elapsed time through the GI tract after the oral administration, indicates that the device has transitioned to the jejunum with at least about 90% accuracy. In this particular case, the light reflectance detected by the sensors includes green light and blue light; an increase in the ratio of the green to blue reflectance is used to determine that the device has transitioned from the stomach to the duodenum; a period of elapsed time (about 3 minutes) after the transition to the duodenum is then used to determine that the device has transitioned from the duodenum to the jejunum. Optionally, peristaltic contraction frequency data are used to corroborate that the device has entered the jejunum. The drug, or the pharmaceutical formulation containing the drug, is then released from the device based on the instructions, providing topical delivery of the drug, or the pharmaceutical formulation containing the drug, to the ileum containing one or more disease sites. The subject subsequently undergoes an endoscopy to determine the effect of the treatment.

(ii) Treatment of ulcerative colitis with backwash ileitis by releasing drug in the jejunum. A 47-year old male subject who previously underwent total proctocolectomy returns to the clinic for a follow-up visit. The subject undergoes an endoscopy, which reveals that the subject has increased neutrophilic and mononuclear inflammation in the lamina propria, along with patchy cryptitis in the ileum. Subsequently, the subject is orally administered the ingestible device containing the therapeutically effective amount of the drug. After ingestion of the device, data collected from at least one of the light sensors, together with elapsed time through the GI tract after the oral administration, indicates that the device has transitioned to the jejunum with at least about 90% accuracy. In this particular case, the light reflectance detected by the sensors includes green light and blue light; an increase in the ratio of the green to blue reflectance is used to determine that the device has transitioned from the stomach to the duodenum; a period of elapsed time (about 3 minutes) after the transition to the duodenum is then used to determine that the device has transitioned from the duodenum to the jejunum. Optionally, peristaltic contraction frequency data are used to corroborate that the device has entered the jejunum. The drug, or the pharmaceutical formulation containing the drug, is then released from the device based on the instructions, providing topical delivery of the drug, or the pharmaceutical formulation containing the drug, to the ileum containing one or more disease sites. The subject subsequently undergoes an endoscopy to determine the effect of the treatment.

(iii) Treatment of Crohn's disease in the ileum (ileocolitis) by releasing drug in the jejunum. A subject suffering from diarrhea and cramping in the lower right part of the abdomen undergoes an endoscopy, which reveals that the subject has ileocolitis. Subsequently, the subject is orally administered the ingestible device containing the therapeutically effective amount of the drug. After ingestion of the device, data collected from at least one of the light sensors, together with elapsed time through the GI tract after the oral administration, indicates that the device has transitioned to the jejunum with at least about 90% accuracy. In this particular case, the light reflectance detected by the sensors includes green light and blue light; an increase in the ratio of the green to blue reflectance is used to determine that the device has transitioned from the stomach to the duodenum; a period of elapsed time (about 3 minutes) after the transition to the duodenum is then used to determine that the device has transitioned from the duodenum to the jejunum. Optionally, peristaltic contraction frequency data are used to corroborate that the device has entered the jejunum. The drug, or the pharmaceutical formulation containing the drug, is then released from the device based on the instructions, providing topical delivery of the drug, or the pharmaceutical formulation containing the drug, to the ileum containing one or more disease sites. The subject subsequently undergoes an endoscopy to determine the effect of the treatment.

Example 15-2c—Treatment of Inflammatory Disease Site(s) in the Cecum by Releasing Drug in the Ileum In the following 3 cases, based on pre-determined identification of disease site(s) in the cecum, as disclosed in each case, the device is pre-programmed with instructions to release the drug to the ileum to treat the disease site(s). The instructions are provided from at least one processor and/or at least one controller associated with the at least one sensor. The device contains a therapeutically effective amount of drug.

(i) A subject having diarrhea, pain and fatigue walks into a clinic. The subject undergoes an endoscopy, which reveals that the subject has disease site(s) in the tissue in the cecum. Subsequently, the subject is orally administered the ingestible device containing the therapeutically effective amount of the drug. After ingestion of the device, data collected from at least one of the light sensors, together with elapsed time through the GI tract after the oral administration, indicates that the device has transitioned from the jejunum to the ileum with at least about 80% accuracy. In this particular case, the light reflectance detected by the sensors includes red light. Once the device has reached the jejunum (essentially as determined in Example 15-1b (i)), a detected decrease in red light reflectance is used to determine that the device has transitioned from the jejunum to the ileum. The drug, or the pharmaceutical formulation containing the drug, is then released from the device based on the instructions, providing topical delivery of the drug, or the pharmaceutical formulation containing the drug, to the cecum containing the one or more disease sites. The subject subsequently undergoes an endoscopy to determine the effect of the treatment.

(ii) Treatment of ulcerative colitis in the cecum by releasing drug in the ileum. A subject suffering from symptoms of ulcerative colitis, including diarrhea, pain and fatigue walks into a clinic. The subject undergoes an endoscopy, which reveals that the subject has disease site(s) in the tissue in the cecum. Subsequently, the subject is orally administered the ingestible device containing the therapeutically effective amount of the drug. After ingestion of the device, data collected from at least one of the light sensors, together with elapsed time through the GI tract after the oral administration, indicates that the device has transitioned from the jejunum to the ileum with at least about 80% accuracy. In this particular case, the light reflectance detected by the sensors includes red light. Once the device has reached the jejunum (essentially as determined in Example 15-1b (i)), a detected decrease in red light reflectance is used to determine that the device has transitioned from the jejunum to the ileum. The drug, or the pharmaceutical formulation containing the drug, is then released from the device based on the instructions, providing topical delivery of the drug, or the pharmaceutical formulation containing the drug, to the cecum containing one or more disease sites. The subject subsequently undergoes an endoscopy to determine the effect of the treatment.

(iii) Treatment of Crohn's disease in the cecum by releasing drug in the ileum. A subject suffering from symptoms of Crohn's disease walks into a clinic. The subject undergoes an endoscopy, which reveals that the subject has disease site(s) in the tissue in the cecum. Subsequently, the subject is orally administered the ingestible device containing the therapeutically effective amount of the drug. After ingestion of the device, data collected from at least one of the light sensors, together with elapsed time through the GI tract after the oral administration, indicates that the device has transitioned from the jejunum to the ileum with at least about 80% accuracy. In this particular case, the light reflectance detected by the sensors includes red light. Once the device has reached the jejunum (essentially as determined in Example 15-1b (i)), a detected decrease in red light reflectance is used to determine that the device has transitioned from the jejunum to the ileum. The drug, or the pharmaceutical formulation containing the drug, is then released from the device based on the instructions, providing topical delivery of the drug, or the pharmaceutical formulation containing the drug, to the cecum containing one or more disease sites. The subject subsequently undergoes an endoscopy to determine the effect of the treatment.

Example 15-2d—Treatment of Inflammatory Disease Site(s) in the Colon by Releasing Drug in the Cecum In the following 3 cases, based on pre-determined identification of disease site(s) in the colon, as disclosed in each case, the device is pre-programmed with instructions to release the drug to the cecum to treat the disease site(s). The instructions are provided from at least one processor and/or at least one controller associated with the at least one sensor. The device contains a therapeutically effective amount of drug.

(i) A subject having abdominal pain and bloody bowel movements sees a gastroenterologist. The subject undergoes an endoscopy, which reveals disease site(s) in the tissue in the colon. Subsequently, the subject is orally administered the ingestible device containing the therapeutically effective amount of the drug. After ingestion of the device, data collected from at least one of the light sensors, optionally in conjunction with elapsed time through the GI tract after the oral administration, indicates that the device has transitioned to the cecum with at least about 80% accuracy. In this particular case, the light reflectance detected by the sensors includes red, green and blue light. A decrease in the ratio of the red to green reflectance, together with a decrease in the ratio of the green to blue reflectance, are used to determine that the device has transitioned from the ileum to the cecum. The drug, or the pharmaceutical formulation containing the drug, is then released from the device based on the instructions, providing topical delivery of the drug, or the pharmaceutical formulation containing the drug, to the colon containing one or more disease sites. The subject subsequently undergoes an endoscopy to determine the effect of the treatment.

(ii) Treatment of ulcerative colitis in the colon by releasing drug in the cecum. A subject suffering from a recurrent urge to have a bowel movement sees a specialist. The subject undergoes an endoscopy, which reveals that the subject has disease site(s) in the tissue in the colon. Subsequently, the subject is orally administered the ingestible device containing the therapeutically effective amount of the drug. After ingestion of the device, data collected from at least one of the light sensors, optionally in conjunction with elapsed time through the GI tract after the oral administration, indicates that the device has transitioned to the cecum with at least about 80% accuracy. In this particular case, the light reflectance detected by the sensors includes red, green and blue light. A decrease in the ratio of the red to green reflectance, together with a decrease in the ratio of the green to blue reflectance, are used to determine that the device has transitioned from the ileum to the cecum. The drug, or the pharmaceutical formulation containing the drug, is then released from the device based on the instructions, providing topical delivery of the drug, or the pharmaceutical formulation containing the drug, to the colon containing one or more disease sites. The subject subsequently undergoes an endoscopy to determine the effect of the treatment.

(iii) Treatment of Crohn's disease in the colon by releasing drug in the cecum. A subject suffering from skin lesions, joint pain, diarrhea, and pain around the anus undergoes an endoscopy and is diagnosed with Crohn's (granulomatous) colitis. Subsequently, the subject is orally administered the ingestible device containing the therapeutically effective amount of the drug. After ingestion of the device, data collected from at least one of the light sensors, optionally in conjunction with elapsed time through the GI tract after the oral administration, indicates that the device has transitioned to the cecum with at least about 80% accuracy. In this particular case, the light reflectance detected by the sensors includes red, green and blue light. A decrease in the ratio of the red to green reflectance, together with a decrease in the ratio of the green to blue reflectance, are used to determine that the device has transitioned from the ileum to the cecum. The drug, or the pharmaceutical formulation containing the drug, is then released from the device based on the instructions, providing topical delivery of the drug, or the pharmaceutical formulation containing the drug, to the colon containing one or more disease sites. The subject subsequently undergoes an endoscopy to determine the effect of the treatment.

Example 15-2e—Treatment of Gastroduodenal Crohn's Disease by Releasing Drug in the Stomach A subject suffering from nausea, weight loss and loss of appetite sees a gastroenterologist. The subject undergoes an endoscopy, which reveals gastroduodenal Crohn's disease affecting the stomach and duodenum. Subsequently the subject is orally administered an ingestible device as disclosed herein containing a therapeutically effective amount of drug. The device contains a self-localization mechanism that autonomously determines the device location within the subject's GI tract. The device localization mechanism includes one or more sensors associated with the device that detects light reflectance that is external to the device and present in the GI tract. The device is pre-programmed with instructions to release the drug into the stomach. The instructions are provided from at least one processor and/or at least one controller associated with the at least one sensor. After ingestion of the device, data collected from at least one of the light sensors, in conjunction with elapsed time (about 1 minute) after the oral administration, indicates that the device has entered the stomach. The drug, or the pharmaceutical formulation containing the drug, is then released from the device based on the instructions, providing topical delivery of the drug, or the pharmaceutical formulation containing the drug, to the stomach and distal to the duodenum containing one or more disease sites. The subject subsequently undergoes an endoscopy to determine the effect of the treatment.

Example 16—Intracecal Administration of Therapeutic Antibodies in a Colitis Animal Model that has Previously Received an Adoptive T-Cell Transfer A set of experiments was performed to compare the efficacy of targeted intracecal (IC) anti-mouse-TNFα antibody (a surrogate for adalimumab) and anti-mouse-interleukin (IL) 12p40 antibody (a surrogate of anti-human-IL12p40 antibody) with systemic intraperitoneal (IP) injection in an adoptive T cell transfer induced chronic colitis mouse model.

Materials
Test System
  Species/strain: Mice, C57Bl/6 (donors) and RAG2$^{-/-}$ (recipients; C57Bl/6 background)
  Physiological state: Normal/immunodeficient
  Age/weight range at start of study: 6-8 weeks (20-24 g)
  Animal supplier: Taconic
  Randomization: Mice were randomized into seven groups of 15 mice each, and two groups of eight mice each.
  Justification: T cells isolated from male C57Bl/6 wild type donors were transferred into male RAG2$^{-/-}$ recipient mice to induce colitis.
  Replacement: Animals were not replaced during the course of the study.
Animal Housing and Environment
  Housing: Mice were housed in groups of 8-15 animals per cage prior to cannulation surgery. After cannulation surgery, cannulated animals were single-housed for seven days post-surgery. After this point, animals were again group-housed as described above. Non-cannulated animals (Group 9) were housed at 8 mice per cage. ALPHA-dri® bedding was used. Prior to colitis induction (i.e., during the cannulation surgeries), bedding was changed a minimum of once per week. After colitis induction, bedding was changed every two weeks, with 1/4 of dirty cage material captured and transferred to the new cage. Additionally, bedding from Group 9 animals was used to supplement the bedding for all other groups at the time of cage change.
  Acclimation: Animals were acclimatized for a minimum of 7 days prior to study commencement. During this period, the animals were observed daily in order to reject animals that presented in poor condition.
  Environmental conditions: The study was performed in animal rooms provided with filtered air at a temperature of 70+/−5° F. and 50%+/−20% relative humidity. Animal rooms were set to maintain a minimum of 12 to 15 air changes per hour. The room was on an automatic timer for a light/dark cycle of 12 hours on and 12 hours off, with no twilight.
  Food/water and contaminants: Animals were maintained with Labdiet 5053 sterile rodent chow. Sterile water was provided ad libitum.
Test Article: IgG Control.
  Name of the Test Article: InVivoMAb polyclonal rat IgG.
  Source: BioXCell, catalog #BP0290
  Storage conditions: 4° C.
  Vehicle: Sterile PBS
  Dose: 0.625 mg/mouse; 0.110 mL/mouse IP and IC
  Formulation:
    Formulation Stability: Prepare fresh daily
    For Group 3: On each day of dosing, dilute stock pAb to achieve 2.145 mL of a 5.68 mg/mL solution.
    For Group 4: On each day of dosing, dilute stock pAb to achieve 2.145 mL of a 5.68 mg/mL solution
Test Article: Anti-IL12 p40.
  Name of the Test Article: InVivoMAb anti-mouse IL-12 p40
  Source: BioXCell, catalog #BE0051
  Storage conditions: 4° C.
  Vehicle: Sterile PBS
  Dose: 0.625 mg/mouse (IP and IC); 0.110 mL/mouse IP and IC
  Formulation:
    Formulation Stability: Prepare fresh daily
    For Group 5: On each dosing day, the stock mAb was diluted to achieve 1.716 mL of a 5.68 mg/mL solution.
    For Group 6: On each dosing day, the stock mAb was diluted to achieve 1.716 mL of a 5.68 mg/mL solution.
Test Article: Anti-TNFα.
  Name of the Test Article: InVivoPlus anti-mouse TNFα, clone XT3.11
  Source: BioXCell, catalog #BP0058
  Storage conditions: 4° C.
  Vehicle: Sterile PBS
  Dose: 0.625 mg/mouse (IP and IC); 0.110 mL/mouse IP and IC
  Formulation:
    Formulation Stability: Prepare fresh daily
    For Group 7: On each dosing day, the stock mAb was diluted to achieve 1.716 mL of a 5.68 mg/mL solution.
    For Group 8: On each dosing day, the stock mAb was diluted to achieve 1.716 mL of a 5.68 mg/mL solution.
Methods The details of the study design are summarized in Table 37. A detailed description of the methods used in this study is provided below.

TABLE 37

Study Design

| Group | No. Animals | Cecal Cannula | Cell Transfer (Day 0) | Treatment | Dose* | Route | Schedule (Days 0-42**) | Blood Collection (RO) | Endoscopy | Endpoints (Day 42) |
|---|---|---|---|---|---|---|---|---|---|---|
| 1 | 8 | YES | — | — | — | — | — | Day 13 | Days 14, 28, 42 | 3 Hours Post Dose: |
| 2 | 15 | | $0.5 \times 10^6$ naïve $T_H$ cells | Vehicle (PBS; IP) Vehicle (PBS; IC) | — | IP; IC | IP: 3×/week IC: QD | | | Colon weight/ length, stool |
| 3 | 15 | | | IgG Control (IP) Vehicle (PBS; IC) | 625 μg | | IP: 3×/week IC: QD | | | score |
| 4 | 15 | | | Vehicle (PBS; IP) IgG Control (IC) | 625 μg | | IP: 3×/week IC: QD | | | Terminal collection |
| 5 | 15 | | | Anti-IL12p40 (IP) Vehicle (PBS; IC) | 625 μg | | IP: 3×/week IC: QD | | | (all groups): Cecal Contents, |
| 6 | 15 | | | Vehicle (PBS; IP) Anti-IL12p40 (IC) | 625 μg | | IP: 3×/week IC: QD | | | Colon Contents, Plasma, small |
| 7 | 15 | | | Anti-TNFα (IP) Vehicle (PBS; IC) | 625 μg | | IP: 3×/week IC: QD | | | intestinal tissue, colon tissue, |
| 8 | 15 | | | Vehicle (PBS; IP) Anti-TNFα (IC) | 625 μg | | IP: 3×/week IC: QD | | | mLN, and Peyer's Patches |
| 9 | 8 | NO | — | — | — | — | — | — | — | — |

*Per mouse;
**Test Article was administered in 0.110 mL/animal IC or IP from Day 0-42;
IC = intracecal injection;
IP = intraperitoneal injection;
QD = once a day;
RO = Retro-Oribital eye bleed A cohort of animals underwent surgical implantation of a cecal cannula at least 10 days to 2 weeks prior to the experiment for the ease of bolus topical delivery to the cecum. A sufficient number of animals underwent implantation to allow for enough cannulated animals to be enrolled in the main study. An additional n=8 animals (Group 9) served as no surgery/no disease controls.

Colitis was induced by intraperitoneal (IP) injection of $0.5 \times 10^6$ CD44/CD62L+ T-cells from C57BL/6 donor mice to male RAG2−/− recipient mice in Groups 2 to 8 on Day 0. The donor cells were processed by first harvesting spleens from 80 C57Bl/6 mice and then isolating the CD44/CD62L$^+$ T cells using Miltenyi Magnetic-Activated Cell Sorting (MACS) columns.

To minimize variation due to methods of administration, animals were treated both by IP injection every third day (3×/wk) and IC injection once daily for 42 consecutive days (qdx42d) of either the test article or the control (vehicle solution or IgG control). Groups were as outlined in Table 37, also summarized as follows: Group 1=untreated (no disease controls); Group 2=vehicle [phosphate buffer saline (PBS)] (IP)+vehicle (IC); Group 3=IgG (IP)+vehicle (IC); Group 4=vehicle (IP)+IgG (IC); Group 5=anti-IL12p40 (IP)+vehicle (IC); Group 6=vehicle (IC)+anti-IL12p40 (IC); Group 7=anti-TNFα (IP)+vehicle (IC); Group 8=vehicle (IP)+anti-TNFα (IC); Group 9=no surgery, untreated (no-cannulation and no-disease controls (sentinel animals for bedding)). Treatment with test article was initiated on Day 0 and was continued until Day 42 as outlined in Table 37.

All recipient mice were weighed daily and assessed visually for the presence of diarrhea and/or bloody stool. The cages were changed every two weeks starting on Day 7, with care taken to capture 1/4 of dirty cage material for transfer to the new cage. On Day 13, blood was collected via RO eye bleed, centrifuged, and plasma was aliquoted (50 μL and remaining) and frozen for downstream analysis. The pelleted cells were re-suspended in buffer to determine the presence of T cells by FACS analysis of CD45$^+$/CD4$^+$ events.

On Day 13, after dosing, peripheral blood from all surviving mice was analyzed by flow cytometry from the presence of CD45+/CD4+ T cells.

The mice underwent high definition video endoscopy on Days 14 (pre-dosing; baseline), 28, and 42 (before euthanasia) to assess the extent of colitis severity. Images were captured from each animal at the most severe region of disease identified during endoscopy. Stool consistency was scored during endoscopy using the parameters described herein on Days 14, 18 and 42.

Disease Activity Index (DAI) was calculated using a combination of body weight (BW) loss score, colitis score, stool consistency score. The DAI (combined value from 0 to 13) was calculated using colitis score, stool consistency score, and BW loss score to provide an overall evaluation of the disease intensity (see Table 38). The score from animals with unscheduled death was carried forward to limit any bias that may be introduced by mortality.

The animals from all groups were euthanized by $CO_2$ inhalation on Day 42 following endoscopy and three hours after dosing. Terminal blood samples were collected for bioanalysis of inflammatory cytokines, and tissues samples were collected and fixed for histopathological evaluation. Plasma obtained from these samples was split into two separate cryotubes, with 50 μL in one tube (Bioanalysis) and the remainder in a second tube (TBD). The cecum and colon contents were removed and the contents collected, weighed, and snap frozen in separate cryovials. The mesenteric lymph nodes were collected and flash-frozen in liquid nitrogen. The small intestine were excised and rinsed, and the most distal 2-cm of ileum was placed in formalin for 24 hours and then transferred to 70% ethanol for subsequent histological evaluation. The Peyer's patches were collected from the small intestine, and were flash-frozen in liquid nitrogen. The colon was rinsed, measured, weighed, and then trimmed to 6-cm in length and divided into 5 pieces as described in the above Examples. The most proximal 1-cm of colon was separately weighed, and flash-frozen for subsequent bioanalysis (PK) of test article levels. Of the remaining 5-cm of colon, the most distal and proximal 1.5-cm sections were each placed in formalin for 24 hours and then transferred to 70% ethanol for subsequent histological evaluation. The middle 2-cm portion was bisected longitudinally, and each piece was weighed, placed into two separate cryotubes, and snap frozen in liquid nitrogen; one of the samples was used for cytokine analysis and the other was used for myeloperoxidase (MPO) analysis. All plasma and frozen colon tissue samples were stored at −80° C. until used for endpoint analysis.

The colon weight (mg) to length (cm) ratio was calculated for individual mice.

A more detailed description of the protocols used in this study are described below.

Cecal Cannulation

Animals were placed under isoflurane anesthesia, and the cecum was exposed via a mid-line incision in the abdomen. A small point incision was made in the distal cecum through which 1-2 cm of the cannula was inserted. The incision was closed with a purse-string suture using 5-0 silk. An incision was made in the left abdominal wall through which the distal end of the cannula was inserted and pushed subcutaneously to the dorsal aspect of the back. The site was washed copiously with warmed saline prior to closing the abdominal wall. A small incision was made in the skin of the back between the shoulder blades, exposing the tip of the cannula. The cannula was secured in place using suture, wound clips, and tissue glue. All of the animals received 1 mL of warm sterile saline (subcutaneous injection) and were monitored closely until fully recovered before returning to the cage. All animals received buprenorphine at 0.6 mg/kg BID for the first 3 days, and Baytril at 10 mg/kg QD for the first 5 days following surgery.

Disease Induction

Colitis was induced on Day 0 in male RAG2$^{-/-}$ mice by IP injection (200 µL) of 0.5×10$^6$ CD44$^-$/CD62L$^+$ T cells (in PBS) isolated and purified from C57Bl/6 recipients.

Donor Cell Harvest

Whole spleens were excised from C57Bl/6 mice and immediately placed in ice-cold PBS. The spleens were dissociated to yield a single cell suspension and the red blood cells were lysed. The spleens were then processed for CD4$^+$enrichment prior to CD44$^-$CD62L$^+$ sorting by MACS.

Dosing

See Table 37.

Body Weight and Survival

The animals were observed daily (morbidity, survival, presence of diarrhea and/or bloody stool) in order to assess possible differences among treatment groups and/or possible toxicity resulting from the treatments. Animals were weighed daily and their percent body weight relative to Day 0 was calculated.

Animals Found Dead or Moribund

The animals were monitored on a daily basis and those exhibiting weight loss greater than 30% were euthanized, and did not have samples collected.

Endoscopy

Each mouse underwent video endoscopy on Days 14 (pre-dosing; baseline), 28, and 42 (before euthanasia) using a small animal endoscope (Karl Storz Endoskope, Germany), under isoflurane anesthesia. During each endoscopic procedure, still images as well as video were recorded to evaluate the extent of colitis and the response to treatment. Additionally, an image from each animal at the most severe region of disease identified during endoscopy was captured. Colitis severity was scored using a 0-4 scale (0=normal; 1=loss of vascularity; 2=loss of vascularity and friability; 3-friability and erosions; 4=ulcerations and bleeding). Additionally, stool consistency was scored during endoscopy using the scoring system described herein.

Sample Collection

Terminal blood (plasma and cell pellet), Peyer's patches (Groups 1-8 only), small intestine and colon mLN (Groups 1-8 only), cecum contents, colon contents, small intestine, and colon were collected at euthanasia, as follows.

Blood: Terminal blood was collected by cardiac puncture and plasma generated from these samples. The resulting plasma was split into two separate cryotubes with 50 µL in one tube (Bioanalysis), and the remainder in a second tube (TBD).

Mesenteric Lymph Nodes: The mesenteric lymph nodes were collected, weighed, snap-frozen in liquid nitrogen, and stored at −80° C.

Small Intestine: The small intestine was excised and rinsed, and the most distal 2-cm of ileum will be placed in formalin for 24 hours and then transferred to 70% ethanol for subsequent histological evaluation.

Peyer's Patches: The Peyer's patches were collected from the small intestine. The collected Peyer's patches were weighed, snap-frozen in liquid nitrogen, and stored at −80° C.

Cecum/Colon Contents: The cecum and colon were removed from each animal and contents collected, weighed, and snap-frozen in separate cryovials.

Colon: Each colon was rinsed, measured, weighed, and then trimmed to 6-cm in length and divided into 5 pieces as outlined herein. The most proximal 1-cm of colon was separately weighed, and snap frozen for subsequent bioanalysis (PK) of test article levels. Of the remaining 5-cm of colon, the most distal and proximal 1.5-cm sections were placed in formalin for 24 hours and then transferred to 70% ethanol for subsequent histological evaluation. The middle 2-cm portion was bisected longitudinally, and each piece weighed, placed into two separate cryotubes, and snap-frozen in liquid nitrogen; one of these samples was used for cytokine analysis and the other sample was used for myeloperoxidase analysis.

Cytokine Levels in Colon Tissue

Cytokine levels (IFNγ, IL-2, IL-4, IL-5, IL-1β, IL-6, IL-12 p40, and TNFα) were assessed in colon tissue homogenate (all groups) by multiplex analysis. Myeloperoxidase levels were assessed by ELISA in colon tissue homogenate (all groups).

Histopathology

Ileum, proximal colon, and distal colon samples from seventy-one mice were fixed in 10% neutral buffered formalin. Samples were trimmed into three cross sections per portion and processed routinely into two blocks per animal (ileum in one block, proximal and distal colon in a second block). One slide from each block was sectioned at approximately 5 microns and stained with hematoxylin and eosin (H&E). Glass slides were evaluated with light microscopy by a board-certified veterinary pathologist. Ileum, proximal colon, and distal colon samples were scored individually. Lesions in H&E-stained samples were given a severity score 0-51 (0=not present/normal, 1=minimal, <10% of tissue affected; 2=mild, 10-25% of tissue affected; 3=moderate, 26-50% of tissue affected; 4=marked, 51-79% of tissue affected; 5=severe, >75% of the tissue affected). Inflammation, crypt damage, erosion, and hyperplasia scores were added together to determine a sum colitis score for each sample.

Lymphocyte counts were performed in a subset of samples: proximal and distal colon from Groups 2 (vehicle), 7 (anti-TNF alpha IP; vehicle IC), and 8 (anti-TNF alpha IC;

vehicle IP). In each piece of tissue, a randomly identified site was divided into approximately four segments extending from the lumen to the muscularis mucosae; 100 μm2 fields were used in the proximal colon, and 50 μm2 fields were used in the distal colon due to the differences in mucosal thickness. Using H&E-stained slides, the number of cells with lymphocyte morphology (small round nucleus with condensed chromatin) were counted within the overlying surface epithelium, in each field from lumen to muscularis mucosae, and within a 100 μm2 field surrounding an adjacent submucosal blood vessel.

Statistical Analysis

As presented in the figures, non-parametric data was analyzed by Kruskal-Wallis test with Dunn's multiple comparisons test used to compare all groups to one another and individual pair-wise comparisons was analyzed by Mann Whitney U-Test. All statistical analyses were performed using GraphPad Prism 7 (La Jolla, CA).

Results

Survival

The observed mortality rate was within the expected range given the design including surgical intervention, T-cell transfer in immunologically compromised animals followed by chronic development of colitis over a 6-week study period (Ostanin D V et al. Am J Physiol Gastrointest Liver Physiol. 2009, 296 (2): G135-G146).

The survival of animals was compared; no significant difference in survival rate was found in treatments of anti-IL12p40 and anti-TNFα with either route of administration compared to vehicle or IgG controls (p>0.08, log-rank; Kaplan-Meier). The timing of animal deaths did not correspond to changes in efficacy endpoints, such as body weight, that were evaluated longitudinally. As noted above, changes in DAI score which includes, BW loss, stool consistency and colitis severity were carried forward to limit any bias that may be introduced by mortality.

Colon Weight: Length Ratio

The mean colon weight: length ratio was significantly elevated in vehicle control animals (Group 2) compared to naïve (Group 1); no other significant differences in mean colon weight: length ratio were observed.

Disease Activity Index

The Disease Activity Index was determined in each mouse using a total score from the scoring system depicted in Table 38.

TABLE 38

Disease Activity Index scoring system

| Disease Activity Index | Description | Score |
|---|---|---|
| Colitis Severity | Normal | 0 |
| | Loss of vascularity | 1 |
| | Loss of vascularity and friability | 2 |
| | Friability and erosions | 3 |
| | Ulcerations and bleeding | 4 |
| Stool Consistency | Normal | 0 |
| | Loose stool, soft, staying in shape | 1 |
| | Abnormal form with excess moisture | 2 |
| | Watery or diarrhea | 3 |
| | Bloody diarrhea | 4 |
| Body Weight Loss (%) | X < 0% or gain weight | 0 |
| | 2% ≤ X < 5% | 1 |
| | 5% ≤ X < 10% | 2 |
| | 10% ≤ X < 15% | 3 |
| | 15% ≤ X < 20% | 4 |
| | 20% ≤ X < 25% | 5 |

TABLE 38-continued

Disease Activity Index scoring system

| Disease Activity Index | Description | Score |
|---|---|---|
| | 25% ≤ X < 30% | 6 |
| | X ≥ 35% | 7 |
| Total Score | | 15 |

The data in FIG. 103 show that mice intracecally administered anti-TNFα antibody (Group 8) had decreased disease activity index (DAI) as compared to mice intraperitoneally administered anti-TNFα antibody (Group 7) at Day 42 of the study. The data in FIG. 105 show that mice intracecally administered anti-IL12 p40 antibody (Group 6) had decreased disease activity index (DAI) as compared to mice intraperitoneally administered anti-IL12 p40 antibody (Group 5) at Day 28 and Day 42 of the study.

Inflammatory Cytokines in Colonic Tissue

The concentration of inflammatory cytokines was evaluated in the colonic tissue in vehicle or IgG control groups.

A significant reduction of inflammatory cytokines, including IL 17A, IL-4, TNFα, and IL-22, were found in groups treated with anti-TNFα (IC (Group 8) or IP (Group 7)) when compared with vehicle (IP/IC) control or its respective IgG controls (IC or IP) in colon tissue (FIG. 104). Mice treated with anti-TNFα antibody IC (Group 8) had decreased levels of TNFα, IL-17A, and IL-4 in colonic tissue as compared to the levels in colonic tissue of mice treated with anti-TNFα IP (Group 7) when assessed at Day 42 of the study.

A significant reduction of IL-22, IL-6, IL17A, TNFα, IL-1b, and IFNγ cytokine was found in groups treated with anti-IL12p40 (IP or IC) when compared with vehicle (IP/IC) control in colon tissue (FIG. 106). Mice intracecally administered anti-IL12 p40 antibody (Group 6) had decreased levels of IFNK, IL-6, IL-17A, TNFα, IL-22, and IL-1b in colonic tissue as compared to the levels in colonic tissue in vehicle-administered control mice (Group 2).

Body Weight Loss

Treatments with either systemic (IP) or topical (IC) administration of an anti-TNFα antibody or anti-IL12p40 antibody led to a significant decrease in body weight (BW) loss over time from Day 0 to Day 42.

The change in body weight over the course of the experiment from Day 0 through Day 42 is shown in FIGS. 107A and 107B. No apparent signs of disease were observed within the first week after induction of colitis. In control groups treated with PBS vehicle and/or IgG, BW loss did not begin until Days 14 through 16 and continued in the 3rd and 4th week following transfer during the acute phase. The weight loss was maintained until study termination on Day 42. Administration of anti-TNFα antibody or anti-IL12p40 antibody through either IP or IC had a significant reduction in AUC of the BW loss (%) from Day 0 to Day 42 along with the weight increase maintained from Day 21 to Day 42 (FIGS. 107A and 107B). Overall, intracecal administration of anti-IL12p40 antibody had the earliest recovery of weight loss and most significant reduction in overall BW loss from Day 0–Day 42 in comparison to the vehicle control group amount of all treatment groups (FIG. 107B).

Histopathology Colitis Score

Lesions of ileitis and colitis, including inflammation, crypt damage, occasional erosions, and epithelial hyperplasia, were induced with the T-cell transfer in this model. Lesions were the least severe in ileum sections and the most severe in the proximal colon. Both IP and IC administration of anti-IL12p40 and anti-TNFα resulted in a reduction in sum ileitis/colitis scores compared to PBS vehicle control.

Targeted IC anti-TNFα treatment showed a significant improvement in the mean histopathologic score when compared with the vehicle controls given by either route (IP or IC) in proximal and distal colon tissues (FIG. 108).

Lymphocyte Counts

Targeted IC anti-TNFα treatment showed the greatest magnitude of lymphocyte reductions in all counted fields, from inner lumen to submucosa of proximal colon when compared to the vehicle control group (Group 8 vs. Group 2, P<0.05*, FIG. 109A). A similar trend in lymphocyte count reductions was found in the distal colon, although to a lesser degree. Results are shown in FIG. 109. Mean counts and scores for all fields were generally the highest in vehicle-treated animals (Group 2, data not shown) and lower in those given anti-TNFα by IP (Group 7, data not shown) or IC (Group 8, FIG. 109B).

Thus, significantly reduced body weight loss (%), decreased Disease Activity Index, improved histological score and reduced tissue inflammatory cytokines were found in animals receiving targeted (IC) anti-TNFα antibody when compared with vehicle controls. Targeted IC delivery was significantly more efficacious when compared to systemic (IP) anti-TNFα antibody in end points of total histologic score and lymphocyte count from inner lumen to submucosa of proximal colon.

Example 17—Pharmacokinetic and Pharmacodynamic Assessment of Tofacitinib Citrate Dosed Orally versus Intracecally in a Dextran Sulfate Sodium (DSS)-Induced Colitis Mouse Model
Study Design The overall study design is summarized in Table 39. Briefly, at least 10 days prior to the start of the study (Day −10), a cohort of male C57BL/6 mice underwent surgical implantation of a cecal cannula. Colitis was induced in 110 mice (Groups 2-7) by exposure to 3% DSS-treated drinking water from Day 0 to Day 5. Five animals (Group 1) served as no-disease controls; the other animals received a single dose of vehicle (Group 2) or tofacitinib citrate suspension containing about 0.5% excipients via oral gavage (PO; Groups 3 and 4) or intracecal injection via the surgically implanted indwelling catheter (IC; Groups 5, 6 and 7) once on Day 12 (peak disease status). All animals were weighed daily and assessed visually for the presence of diarrhea and/or blood in stool. A subset of animals per group was sacrificed for terminal PK collections at various time points post-dose. Terminal samples (plasma, cecal contents, colon contents, cecal tissue and colon tissue) were collected at terminal sacrifice. All $K_2$EDTA plasma and tissue homogenate (proximal colon, cecum and associated lumen contents) were stored at −80° C. until further analysis.

TABLE 39

Description of Treatment Groups

| Group Number | Number of Animals | Cecal Cannula | Colitis Induction | Treatment | Dose (mg/kg) (Day 12)[1] | Route | PK Schedule |
|---|---|---|---|---|---|---|---|
| 1 | 5 | no | (a) | (a) | (a) | (a) | 24 h post-dose (n = 5) |
| 2 | 10 | | 3% DSS in drinking water Days 0-5 | Control vehicle | 0 | PO | 1 and 24 h post-dose (n = 5 per timepoint) |
| 3 | 20 | | | Tofacitinib citrate suspension | 15 | | |
| 4 | 20 | | | | 45 | | |
| 5 | 20 | yes | | | 1 | IC | 1, 3, 12, 24 h post-dose (n = 5 per timepoint) |
| 6 | 20 | | | | 3 | | |
| 7 | 20 | | | | 10 | | |

DSS = dextran sulfate sodium;
IC = Intracecal injection;
PK = Pharmacokinetics;
PO = oral gavage
(a) Five animals served as no-disease controls.
[1]All dose levels are expressed based on tofacitinib citrate salt form.

Sample Bioanalysis

Plasma samples and tissue homogenate (proximal colon, cecum and associated lumen contents) were assessed for tofacitinib. Briefly, samples were analyzed by LC-MS/MS against matrix-matched standard curves. Three additional samples were above their respective quantitation limits, and extrapolated data was reported.

To evaluate pharmacodynamic (PD) effects of tofacitinib in the DSS-induced colitis mouse model, several cytokines involved in the JAK/STAT signaling pathway, i.e., IL-6, GM-CSF, IL-15, IL-2, IL-12, IL-13, TNF-α, and INF-γ, were measured in both plasma and colon tissue by ELISA.

The study design was complex and involved surgical procedure in a disease model The PK/PD parameters were derived from limited time points and should be considered best estimates only.

All PK/PD concentrations are expressed as active drug moiety (anhydrous tofacitinib free base).

Pharmacokinetic Statistical Analysis

PK modeling was performed using mean plasma or tissue concentrations of tofacitinib versus time curves. The following PK parameters were calculated with a one-compartmental model using Excel software: time to maximum concentration: $T_{max}$; half-life: $t_{1/2}$, maximum concentration: $C_{max}$; clearance (Cl), area under the concentration-time curve from the start of dosing to the last protocol-specified time point: $AUC_{(0-24h)}$. The absolute oral bioavailability was estimated to be 74% based on: Xeljanz® (Tofacitinib tablets for oral administration) Prescribing Information Revised 11/2012.

Results

Drug Tissue Concentrations

Animals dosed PO with tofacitinib citrate (Groups 3-4) demonstrated the highest mean plasma tofacitinib concentrations at all time points, while limited blood exposure was observed in animals treated IC (Groups 5-6) (See FIG. 110). Plasma $T_{max}$ occurred between 1.2 and 1.6 h post-dose in all groups, regardless of dosing route. Colon tissue $T_{max}$ occurred between 1.43 and 1.86 h post-dose in all IC groups, and at 2.25 and 2.33 h post-dose in PO groups (Table 40). At similar dose levels, IC delivery of tofacitinib citrate (IC, 10 mg/kg) resulted in an 18-fold higher tofacitinib AUC colon tissue/plasma ratio when compared to PO delivery (PO, 15 mg/kg) (AUC ratio 193.76 vs. 10.6, respectively; Table 40). Plasma and tissue tofacitinib exposure ($AUC_{0-24\ h}$) are also shown in FIG. 111.

group, nor was there a significant difference in GM-CSF levels between IC and PO treatment groups in either plasma or colon tissue, despite high exposure of tofacitinib found in colon tissue of IC groups dosed at 3 and 10 mg/kg (data not shown).

EXEMPLARY EMBODIMENTS

1. A method of treating an an inflammatory disease or condition that arises in a tissue originating from the endoderm in a subject, comprising:
   administering to the subject a pharmaceutical formulation that comprises an immune modulator,
   wherein the pharmaceutical formulation is released at a location in the gastrointestinal tract of the subject.

TABLE 40

Pharmacokinetic and pharmacodynamic parameters for tofacitinib over 24 hours after a single dose administration of tofacitinib citrate suspension on Day 12 in DSS-induced colitis mouse model

| Group | | | Pharmacokinetic parameters | | | | | | Pharmacodynamics | | |
|---|---|---|---|---|---|---|---|---|---|---|---|
| | | | $C_{max}$ | AUC | Tissue/Plasma | $T_{max}$ | $T_{1/2}$ | Clearance | $IC_{50}$ coverage (h)[a] | | |
| Number | Route/Dose | Biological Matrix | (ng/mL) | (ng · h/mL) | ratio | (h) | (h) | (mL/h) | JAK1/3[b] | JAK1/2[c] | JAK2/2[d] |
| 3 | PO/15 mg/kg | Plasma | 65.5 | 372.09 | 10.6 | 1.61 | 2.53 | 656.28 | 1 | 0 | 0 |
| | | Colon tissue | 552.7 | 3954.9 | | 2.25 | 3.23 | 61.82 | 12 | 3 | 0 |
| 4 | PO/45 mg/kg | Plasma | 467.1 | 1976.24 | 7.09 | 1.36 | 1.64 | 370.7 | 1 | 3 | 1 |
| | | Colon tissue | 1774.9 | 14006.55 | | 2.33 | 3.4 | 52.3 | 12 | 12 | 3 |
| 5 | IC/1 mg/kg | Plasma | 1.3 | 6.13 | 253.05 | 1.56 | 1.73 | 2653.91 | 0 | 0 | 0 |
| | | Colon tissue | 271.7 | 1551.21 | | 1.61 | 2.56 | 10.5 | 3 | 3 | 0 |
| 6 | IC/3 mg/kg | Plasma | 33.2 | 115.45 | 128.76 | 1.21 | 1.19 | 423.05 | 1 | 0 | 0 |
| | | Colon tissue | 2960.2 | 14865.55 | | 1.43 | 2.23 | 3.29 | 24 | 3 | 3 |
| 7 | IC/10 mg/kg | Plasma | 57.8 | 223.27 | 193.76 | 1.27 | 1.47 | 729.17 | 3 | 0 | 0 |
| | | Colon tissue | 7644.9 | 43261.18 | | 1.86 | 2.16 | 3.76 | 24 | 12 | 3 |

PO = oral gavage;
IC = Intra-cecal injection;
$IC_{50}$ = Half-maximum inhibitory concentration;
Groups and 2: not applicable
[a]Concentrations above the $IC_{50}$ over the 24-hour period;
[b]$IC_{50}$ of JAK1/3 heterodimer = 56 nM [e] (28.25 ng/mL);
[c]$IC_{50}$ of JAK1/2 heterodimer = 406 nM [e] (204.83 ng/mL);
[d]$IC_{50}$ of JAK2/2 homodimer inhibition = 1377 nM [e] (694.7 ng/mL)
[e] Meyer st al. (2010) J. Inflamm. 7-4.1.

Cytokines

Inflammatory cytokine IL-6 has been shown to play a critical role in the response of uncontrolled intestinal inflammation through JAK1/JAK2 and JAK1/TYK2 signaling pathways (Meyer et al. (2010) J. Inflamm. 7-41).

FIG. 112 shows results obtained for IL-6 in colon tissue on Day 12. IL-6 expression was induced by DSS treatment in both plasma (data not shown) and colon tissue (FIG. 109A) of PO and IC treatment groups; significant induction (p<0.05) was observed on Day 12 when compared with naïve animals (Group 1).

In plasma, inhibition of IL-6 expression was observed in groups treated with tofacitinib citrate via PO or IC administration at 1 h and 3 h post-treatment; recovery of IL-6 expression (50 to 100%) was observed at 12 and 24h post-treatment (data not shown).

In colon tissue, inhibition of IL-6 expression was sustained through 24 h post-dose in colon tissue in all IC treated groups and in the high dose PO group (45 mg/kg) (FIG. 112B). Recovery from IL-6 inhibition was observed in the low dose PO group (15 mg/kg) by 12 h post-dose.

The concentration of GM-CSF was not significantly different between the DSS-treatment groups and the naïve 2. The method of embodiment 1, wherein the pharmaceutical formulation is administered in an ingestible device.

3. The method of embodiment 1, wherein the pharmaceutical formulation is released from an ingestible device.

4. The method of embodiment 2 or 3, wherein the ingestible device comprises a housing, a reservoir containing the pharmaceutical formulation, and a release mechanism for releasing the pharmaceutical formulation from the device,
   wherein the reservoir is releasably or permanently attached to the exterior of the housing or internal to the housing.

5. The method of embodiment 2 or 3, wherein the ingestible device comprises a housing, a reservoir containing the pharmaceutical formulation, and a release mechanism for releasing the pharmaceutical formulation from the device,
   wherein the reservoir is internal to the device.

6. A method of treating a disease of the gastrointestinal tract in a subject, comprising:
   administering to the subject an ingestible device comprising a housing, a reservoir containing a pharmaceutical formulation, and a release mechanism for releasing the pharmaceutical formulation from the device;

wherein the reservoir is releasably or permanently attached to the exterior of the housing or internal to the housing;

wherein the pharmaceutical formulation comprises an immune modulator, and the ingestible device releases the pharmaceutical formulation at a location in the gastrointestinal tract of the subject that is proximate to one or more sites of disease.

7. A method of treating a disease of the gastrointestinal tract in a subject, comprising:

administering to the subject an ingestible device comprising a housing, a reservoir containing a pharmaceutical formulation, and a release mechanism for releasing the pharmaceutical formulation from the device;

wherein the reservoir is internal to the device;

wherein the pharmaceutical formulation comprises an immune modulator, and the ingestible device releases the pharmaceutical formulation at a location in the gastrointestinal tract of the subject that is proximate to one or more sites of disease.

8. The method of any one of embodiments 4 to 7, wherein the housing is non-biodegradable in the GI tract.

9. The method of any one of embodiments 2 to 8, wherein the release of the formulation is triggered autonomously.

10. The method of any one of embodiments 2 to 9, wherein the device is programmed to release the formulation with one or more release profiles that may be the same or different at one or more locations in the GI tract.

11. The method of any one of embodiments 2 to 10, wherein the device is programmed to release the formulation at a location proximate to one or more sites of disease.

12. The method of embodiment 11, wherein the location of one or more sites of disease is predetermined.

13. The method of any one of embodiments 4 to 12, wherein the reservoir is made of a material that allows the formulation to leave the reservoir 14. The method of embodiment 13, wherein the material is a biodegradable material.

15. The method of any one of embodiments 2 to 14, wherein the release of the formulation is triggered by a pre-programmed algorithm.

16. The method of any one of embodiments 2 to 15, wherein the release of the formulation is triggered by data from a sensor or detector to identify the location of the device.

17. The method of embodiment 16, wherein the data is not based solely on a physiological parameter.

18. The method of any one of embodiments 2 to 17, wherein the device comprises a detector configured to detect light reflectance from an environment external to the housing.

19. The method of embodiment 18, wherein the release is triggered autonomously or based on the detected reflectance.

20. The method of any one of embodiments 2 to 19, wherein the device releases the formulation at substantially the same time as one or more sites of disease are detected.

21. The method of any one of embodiments 4 to 20, wherein the release mechanism is an actuation system.

22. The method of embodiment 21, wherein the actuation system is a chemical actuation system.

23. The method of embodiment 21, wherein the actuation system is a mechanical actuation system.

24. The method of embodiment 21, wherein the actuation system is an electrical actuation system.

25. The method of embodiment 21, wherein the actuation system comprises a pump and releasing the formulation comprises pumping the formulation out of the reservoir.

26. The method of embodiment 21, wherein the actuation system comprises a gas generating cell.

27. The method of any one of embodiments 2 to 26, wherein the device comprises an anchoring mechanism.

28. The method of any one of embodiments 1 to 27, wherein the formulation comprises a therapeutically effective amount of the immune modulator.

29. The method of any one of the preceding embodiments, wherein the formulation comprises a human equivalent dose (HED) of the immune modulator.

Additional Exemplary Embodiments

1. A method of treating an inflammatory disease or condition that arises in a tissue originating from the endoderm in a subject, comprising:

releasing an immune modulator at a location in the gastrointestinal tract of the subject, wherein the method comprises administering to the subject a pharmaceutical composition comprising a therapeutically effective amount of the immune modulator.

2 The method of embodiment 1, wherein the pharmaceutical composition is an ingestible device and the method comprises administering orally to the subject the pharmaceutical composition.

3. The method of embodiment 1 or 2, wherein the method does not comprise releasing more than 10% of the immune modulator at a location that is not proximate to the intended site of release.

4. The method of embodiment 1 or 2, wherein the method provides a concentration of the immune modulator at a location that is an intended site of release that is 2-100 times greater than at a location that is not the intended site of release.

5. The method of any one of the preceding embodiments, wherein the method provides a concentration of the immune modulator in the plasma of the subject that is less than 3 µg/mL.

6. The method of embodiment 5, wherein the method provides a concentration of the immune modulator in the plasma of the subject that is less than 0.3 µg/ml.

7. The method of embodiment 6, wherein the method provides a concentration of the immune modulator in the plasma of the subject that is less than 0.01 µg/mL.

8. The method of any one of embodiments 1 to 4, wherein the method provides a $C_{24}$ value of the immune modulator in the plasma of the subject that is less than 3 µg/ml.

9. The method of embodiment 8, wherein the method provides a $C_{24}$ value of the immune modulator in the plasma of the subject that is less than 0.3 µg/mL.

10. The method of embodiment 9, wherein the method provides a $C_{24}$ value of the immune modulator in the plasma of the subject that is less than 0.01 µg/mL.

11. The method of any one of embodiments 1 to 10, wherein the immune modulator is an inhibitory nucleic acid.

12. The method of embodiment 1 or 10, wherein the immune modulator is a small molecule.

13. The method of any one of embodiments 1 to 10, wherein the immune modulator is an antisense nucleic acid.

14. The method of any one of embodiments 1 to 10, wherein the immune modulator is a ribozyme.

15. The method of any one of embodiments 1 to 10, wherein the immune modulator is a siRNA.

16. The method of any one of embodiments 2 to 15, wherein the immune modulator is present in a pharmaceutical formulation within the device.

17. The method of embodiment 16, wherein the formulation is a solution of the immune modulator in a liquid medium.

18. The method of embodiment 17, wherein the formulation is a suspension of the immune modulator in a liquid medium.

19. The method of any one of embodiments 1 to 18, wherein the tissue originating from the endoderm is selected from the group consisting of: the stomach, the colon, the liver, the pancreas, the urinary bladder, the epithelial parts of the trachea, the lungs, the pharynx, the thyroid, the parathyroid, the intestines, and the gallbladder.

20. The method of any one of embodiments 1 to 18, wherein the inflammatory disease or condition originating from the endoderm is selected from the group consisting of: gastritis, Celiac disease, hepatitis, alcoholic lever disease, fatty liver disease (hepatic steatosis), non-alcoholic fatty liver disease (NAFLD), cirrhosis, primary schlerosing cholangitis, pancreatitis, insterstitial cystitits, asthma, chronic obstructic pulmonary disease, pulmonary fibrosis, pharyngitis, thyroiditis, hyperthyroidism, parathyroiditis, nephritis, Hashimoto's disease, Addison's disease, Graves' disease, Sjögren syndrome, type 1 diabetes, pelvic inflammatory disease, auditory canal inflammation, tinnitus, vestibular neuritis, otitis media, auditory canal inflammation, tracheitis, cholestatic liver disease, primary biliary sclerosis, liver parenchyma, an inherited metabolic disorder of the liver, Byler syndrome, cerebrotendinous, xanthomatosis, Zellweger's syndrome, neonatal hepatitis, cystic fibrosis, ALGS (Alagilles syndrome), PFIC (progressive familial intrahepatic cholestasis), autoimmune hepatitis, primary biliary cirrhosis (PBC), liver fibrosis, NAFLD, portal hypertension, general cholestasis, such as in jaundice due to drugs or during pregnancy, intra- and extrahepatic cholestasis, such as hereditary forms of cholestasis, such as PFIC1, gall stones and choledocholithiasis, malignancy causing obstruction of the biliary tree, symptoms (scratching, pruritus) due to cholestasis/jaundice, chronic autoimmune liver disease leading to progressive cholestasis, and pruritus of cholestatic liver disease, duodenal ulcers, enteritis (radiation-, chemotherapy-, or infection-induced enteritis), diverticulitis, pouchitis, cholecystitis, and cholangitis.

21. The method of any one of embodiments 1 to 19, wherein the inflammatory disease or condition that arises in a tissue originating from the endoderm is inflammation of the liver.

22. The method of any one of embodiments 1 to 21, wherein the immune modulator is released at a location in the large intestine of the subject.

23. The method of embodiment 22, wherein the location is in the proximal portion of the large intestine.

24 The method of embodiment 22, wherein the location is in the distal portion of the large intestine.

25. The method of any one of embodiments 1 to 21, wherein the immune modulator is released at a location in the ascending colon of the subject.

26. The method of embodiment 25, wherein the location is in the proximal portion of the ascending colon.

27. The method of embodiment 25, wherein the location is in the distal portion of the ascending colon.

28. The method of any one of embodiments 1 to 21, wherein the immune modulator is released at a location in the cecum of the subject.

29. The method of embodiment 28, wherein the location is in the proximal portion of the cecum.

30. The method of embodiment 28, wherein the location is in the distal portion of the cecum.

31. The method of any one of embodiments 1 to 21, wherein the immune modulator is released at a location in the sigmoid colon of the subject.

32. The method of embodiment 31, wherein the location is in the proximal portion of the sigmoid colon.

33. The method of embodiment 31, wherein the location is in the distal portion of the sigmoid colon.

34. The method of any one of embodiments 1 to 21, wherein the immune modulator is released at a location in the transverse colon of the subject.

35. The method of embodiment 34, wherein the location is in the proximal portion of the transverse colon.

36. The method of embodiment 34, wherein the location is in the distal portion of the transverse colon.

37. The method of any one of embodiments 1 to 21, wherein the immune modulator is released at a location in the descending colon of the subject.

38. The method of embodiment 37, wherein the location is in the proximal portion of the descending colon.

39. The method of embodiment 37, wherein the location is in the distal portion of the descending colon.

40. The method of any one of embodiments 1 to 21, wherein the immune modulator is released at a location in the small intestine of the subject.

41. The method of embodiment 40, wherein the location is in the proximal portion of the small intestine.

42. The method of embodiment 40, wherein the location is in the distal portion of the small intestine.

43. The method of any one of embodiments 1 to 21, wherein the immune modulator is released at a location in the duodenum of the subject.

44. The method of embodiment 43, wherein the location is in the proximal portion of the duodenum.

45. The method of embodiment 43, wherein the location is in the distal portion of the duodenum.

46. The method of any one of embodiments 1 to 21, wherein the immune modulator is released at a location in the jejunum of the subject.

47. The method of embodiment 46, wherein the location is in the proximal portion of the jejunum.

48. The method of embodiment 46, wherein the location is in the distal portion of the jejunum.

49. The method of any one of embodiments 1 to 21, wherein the immune modulator is released at a location in the ileum of the subject.

50. The method of embodiment 49, wherein the location is in the proximal portion of the ileum.

51. The method of embodiment 49, wherein the location is in the distal portion of the ileum.

52. The method of any one of the preceding embodiments, wherein the location at which the immune modulator is released is 10 cm or less from an intended site of release.

53. The method of any one of the preceding embodiments, wherein the location at which the immune modulator is released is 5 cm or less from an intended site of release.

54. The method of any one of the preceding embodiments, wherein the location at which the immune modulator is released is 2 cm or less from an intended site of release.

55. The method of any one of the preceding embodiments, wherein the immune modulator is released by mucosal contact.

56. The method of any one of the preceding embodiments, wherein the immune modulator is delivered to the location by a process that does not comprise systemic transport of the immune modulator.

57. The method of any one of the preceding embodiments, further comprising identifying an intended site of release of the immune modulator using a method that comprises imaging of the gastrointestinal tract.

58. The method of embodiment any one of the preceding embodiments, wherein the method comprises identifying an intended site of release of the immune modulator, prior to administering the pharmaceutical composition.

59. The method of embodiment 58, wherein the method comprises releasing the immune modulator substantially at the same time as identifying the intended site of release of the immune modulator.

60. The method of any one of the preceding embodiments, comprising (a) identifying a subject having an inflammatory disease or condition that arises in a tissue originating from the endoderm, and (b) evaluating the subject for suitability to treatment.

61. The method of any one of embodiments 1 or 3 to 15 or 17 to 60, wherein releasing the immune modulator is triggered by one or more of: a pH in the jejunum from 6.1 to 7.2, a pH in the mid small bowel from 7.0 to 7.8, a pH in the ileum from 7.0 to 8.0, a pH in the right colon from 5.7 to 7.0, a pH in the mid colon from 5.7 to 7.4, a pH in the left colon from 6.3 to 7.7, such as 7.0.

62. The method of any one of embodiments 1 to 60, wherein releasing the immune modulator is not dependent on the pH at or in the vicinity of the location.

63. The method of any one of embodiments 1 or 3 to 15 or 17 to 60, wherein releasing the immune modulator is triggered by degradation of a release component located in the device.

64. The method of any one of embodiments 1 to 60, wherein releasing the immune modulator is not triggered by degradation of a release component located in the device.

65. The method of any one of embodiments 1 to 60, wherein releasing the immune modulator is not dependent on enzymatic activity at or in the vicinity of the location.

66. The method of any one of embodiments 1 to 60, wherein releasing the immune modulator is not dependent on bacterial activity at or in the vicinity of the location.

67. The method of any one of embodiments 1 to 60, wherein the composition comprises a plurality of electrodes comprising a coating, and releasing the immune modulator is triggered by an electric signal by the electrodes resulting from the interaction of the coating with an intended site of release of the immune modulator.

68. The method of any one of embodiments 1 to 60, wherein releasing the immune modulator is triggered by a remote electromagnetic signal.

69. The method of any one of embodiments 1 to 60, wherein releasing the immune modulator is triggered by generation in the composition of a gas in an amount sufficient to expel the immune modulator.

70. The method of any one of embodiments 1 to 60, wherein releasing the immune modulator is triggered by an electromagnetic signal generated within the device according to a pre-determined drug release profile.

71. The method of any one of embodiments 2 to 60, wherein the ingestible device comprises an ingestible housing, wherein a reservoir storing the immune modulator is attached to the housing.

72. The method of embodiment 71, further comprising:
   detecting when the ingestible housing is proximate to an intended site of release,
   wherein releasing the immune modulator comprises releasing the therapeutically effective amount of the immune modulator from the reservoir proximate the respective intended site of release in response to the detection.

73. The method of embodiment 72, wherein detecting comprises detecting via one or more sensors coupled to the ingestible housing.

74. The method of embodiment 73, wherein the one or more sensors comprise a plurality of coated electrodes and wherein detecting comprises receiving an electric signal by one or more of the coated electrodes responsive to the one or more electrode contacting the respective intended site of release.

75. The method of embodiment 72, wherein releasing comprises opening one or more valves in fluid communication with the reservoir.

76. The method of embodiment 0, wherein the one or more valves is communicably coupled to a processor positioned in the housing, the processor communicably coupled to one or more sensors configured to detect the intended site of release.

77. The method of embodiment 72, wherein releasing comprises pumping the therapeutically effective amount of the immune modulator from the reservoir via pump positioned in the ingestible housing.

78. The method of embodiment 0, wherein the pump is communicably coupled to a processor positioned in the housing, the processor communicably coupled to one or more sensors configured to detect an intended site of release of the immune modulator.

79. The method of embodiment 71, wherein the therapeutically effective amount of the immune modulator is stored in the reservoir at a reservoir pressure higher than a pressure in the gastrointestinal tract of the subject.

80. The method of embodiment 71, further comprising anchoring the ingestible housing at a location proximate to the intended site of release in response to the detection.

81. The method of embodiment 0, wherein anchoring the ingestible housing comprises one or more legs to extend from the ingestible housing.

82. The method of any one of the preceding embodiments, wherein the amount of the immune modulator that is administered is from about 1 mg to about 500 mg.

83. The method of any one of the preceding embodiments, wherein the immune modulator is an antibody or an antigen-binding antibody fragment.

84. The method of embodiment 83, wherein the antibody is a humanized antibody.

85. The method of any one of embodiments 1 to 84, wherein the amount of the immune modulator is less than an amount that is effective when the immune modulator is administered systemically.

86. The method of any one of the preceding embodiments, comprising administering (i) an amount of the immune modulator that is an induction dose.

87. The method of embodiment 86, further comprising (ii) administering an amount of the immune modulator that is a maintenance dose following the administration of the induction dose.

88. The method of embodiment 86 or 87, wherein the induction dose is administered once a day.

89. The method of embodiment 86 or 87, wherein the induction dose is administered once every three days.

90. The method of embodiment 86 or 87, wherein the induction dose is administered once a week.

91. The method of embodiment 87, wherein step (ii) is repeated one or more times.

92. The method of embodiment 87, wherein step (ii) is repeated once a day over a period of about 6-8 weeks.

93. The method of embodiment 87, wherein step (ii) is repeated once every three days over a period of about 6-8 weeks.

94. The method of embodiment 87, wherein step (ii) is repeated once a week over a period of about 6-8 weeks.

95. The method of embodiment 87, wherein the induction dose is equal to the maintenance dose.

96. The method of embodiment 87, wherein the induction dose is greater than the maintenance dose.

97. The method of embodiment 87, wherein the induction dose is 5 times greater than the maintenance dose.

98. The method of embodiment 87, wherein the induction dose is 2 times greater than the maintenance dose.

99. The method of any one of the preceding embodiments, wherein the method comprises releasing the immune modulator at the location in the gastrointestinal tract as a single bolus.

100. The method of any one of embodiments 1 to 98, wherein the method comprises releasing the immune modulator at the location in the gastrointestinal tract as more than one bolus.

101. The method of any one of embodiments 1 to 98, wherein the method comprises delivering the immune modulator at the location in the gastrointestinal tract in a continuous manner.

102. The method of embodiment 101, wherein the method comprises delivering the immune modulator at the location in the gastrointestinal tract over a time period of 20 or more minutes.

103. The method of any one of embodiments 1 to 102, wherein the method does not comprise delivering an immune modulator rectally to the subject.

104. The method of any one of embodiments 1 to 102, wherein the method does not comprise delivering an immune modulator via an enema to the subject.

105. The method of any one of embodiments 1 to 102, wherein the method does not comprise delivering an immune modulator via suppository to the subject.

106. The method of any one of embodiments 1 to 102, wherein the method does not comprise delivering an immune modulator via instillation to the rectum of the subject.

107. The method of any one of embodiments 1 to 102, wherein the method does not comprise surgical implantation.

108. The method of any one of the preceding embodiments, wherein the immune modulator is a IL-12/IL-23 inhibitor.

109. The method of any one of the preceding embodiments, wherein the immune modulator is a TNFα inhibitor.

110. The method of any one of the preceding embodiments, wherein the immune modulator is a IL-6 receptor inhibitor.

111. The method of any one of the preceding embodiments, wherein the immune modulator is a CD40/CD40L inhibitor.

112. The method of any one of the preceding embodiments, wherein the immune modulator is a IL-1 inhibitor.

113. The method of any one of embodiments 1 to 67 or 69 to 112, wherein the composition is an autonomous device.

114. The method of any one of embodiments 1 to 113, wherein the composition comprises a mechanism capable of releasing the immune modulator.

115. The method of any one of embodiments 1 to 114, wherein the composition comprises a tissue anchoring mechanism for anchoring the composition to the location.

116. The method of embodiment 115, wherein the tissue anchoring mechanism is capable of activation for anchoring to the location.

117. The method of embodiment 115 to 116, wherein the tissue anchoring mechanism comprises an osmotically-driven sucker.

118. The method of embodiment 115, 116, or 117, wherein the tissue anchoring mechanism comprises a connector operable to anchor the composition to the location.

119. The method of embodiment 118, wherein the connector is operable to anchor the composition to the location using an adhesive, negative pressure and/or fastener.

120. The method of embodiment 71, wherein the reservoir is an anchorable reservoir.

121. The method of any one of embodiments 1 to 60, wherein the pharmaceutical composition is an ingestible device, comprising:
a housing;
a reservoir located within the housing and containing the immune modulator,
a mechanism for releasing the immune modulator from the reservoir;
and;
an exit valve configured to allow the immune modulator to be released out of the housing from the reservoir.

122. The method of embodiment 121, wherein the ingestible device further comprises:
an electronic component located within the housing; and
a gas generating cell located within the housing and adjacent to the electronic component,
wherein the electronic component is configured to activate the gas generating cell to generate gas.

123. The method of embodiment 121 or 122, wherein the ingestible device further comprises:
a safety device placed within or attached to the housing,
wherein the safety device is configured to relieve an internal pressure within the housing when the internal pressure exceeds a threshold level.

124. The method of embodiment 1 to 60, wherein the pharmaceutical composition is an ingestible device, comprising:
a housing defined by a first end, a second end substantially opposite from the first end, and a wall extending longitudinally from the first end to the second end;
an electronic component located within the housing;
a gas generating cell located within the housing and adjacent to the electronic component,
wherein the electronic component is configured to activate the gas generating cell to generate gas;
a reservoir located within the housing,
wherein the reservoir stores a dispensable substance and a first end of the reservoir is attached to the first end of the housing;
an exit valve located at the first end of the housing,
wherein the exit valve is configured to allow the dispensable substance to be released out of the first end of the housing from the reservoir; and
a safety device placed within or attached to the housing,
wherein the safety device is configured to relieve an internal pressure within the housing when the internal pressure exceeds a threshold level.

125. The method of embodiment 1 to 60, wherein the pharmaceutical composition is an ingestible device, comprising:
a housing defined by a first end, a second end substantially opposite from the first end, and a wall extending longitudinally from the first end to the second end;

an electronic component located within the housing,
a gas generating cell located within the housing and adjacent to the electronic component,
  wherein the electronic component is configured to activate the gas generating cell to generate gas;
a reservoir located within the housing,
  wherein the reservoir stores a dispensable substance and a first end of the reservoir is attached to the first end of the housing;
an injection device located at the first end of the housing,
  wherein the jet injection device is configured to inject the dispensable substance out of the housing from the reservoir; and
a safety device placed within or attached to the housing,
  wherein the safety device is configured to relieve an internal pressure within the housing.

126. The method of embodiment 1 to 60, wherein the pharmaceutical composition is an ingestible device, comprising:
a housing defined by a first end, a second end substantially opposite from the first end, and a wall extending longitudinally from the first end to the second end;
an optical sensing unit located on a side of the housing,
  wherein the optical sensing unit is configured to detect a reflectance from an environment external to the housing;
an electronic component located within the housing;
a gas generating cell located within the housing and adjacent to the electronic component,
  wherein the electronic component is configured to activate the gas generating cell to generate gas in response to identifying a location of the ingestible device based on the reflectance;
a reservoir located within the housing,
  wherein the reservoir stores a dispensable substance and a first end of the reservoir is attached to the first end of the housing;
a membrane in contact with the gas generating cell and configured to move or deform into the reservoir by a pressure generated by the gas generating cell; and
a dispensing outlet placed at the first end of the housing,
  wherein the dispensing outlet is configured to deliver the dispensable substance out of the housing from the reservoir.

127. The method of any one of embodiments 1 to 60, wherein the pharmaceutical composition is an ingestible device as disclosed in U.S. Patent Application Ser. No. 62/385,553, incorporated by reference herein in its entirety.

128. The method of any one of embodiments 1 to 60, wherein the pharmaceutical composition is an ingestible device comprising a localization mechanism as disclosed in international patent application PCT/US2015/052500, incorporated by reference herein in its entirety.

129. The method of any one of embodiments 1 to 60, wherein the pharmaceutical composition is not a dart-like dosage form.

130. A method of treating an inflammatory disease or condition that arises in a tissue originating from the endoderm of a subject, comprising:
releasing an immune modulator at a location in the large intestine of the subject,
  wherein the method comprises administering endoscopically to the subject a therapeutically effective amount of the immune modulator, wherein the method does not comprise releasing more than 20% of the immune modulator at a location that is not an intended site of release.

131. A method of treating a disease or condition that arises in a tissue originating from the endoderm in a subject, comprising:
releasing an immune modulator at a location in the proximal portion of the large intestine of the subject,
  wherein the method comprises administering endoscopically to the subject a pharmaceutical composition comprising a therapeutically effective amount of the immune modulator, wherein the pharmaceutical composition is an ingestible device.

132. The method of embodiment 130 or 131, wherein the method does not comprise releasing more than 20% of the immune modulator at a location that is not proximate to an intended site of release.

133. The method of embodiment 130, 131 or 132 wherein the method does not comprise releasing more than 10% of the immune modulator at a location that is not proximate to an intended site of release.

134. The method of any one of embodiments 130, 131 or 132, wherein the method provides a concentration of the immune modulator at a location that is an intended site of release that is 2-100 times greater than at a location that is not the intended site of release.

135. The method of any one of embodiments 130 to 134, wherein the method provides a concentration of the immune modulator in the plasma of the subject that is less than 3 µg/ml.

136. The method of embodiment 135, wherein the method provides a concentration of the immune modulator in the plasma of the subject that is less than 0.3 µg/mL.

137. The method of embodiment 136, wherein the method provides a concentration of the immune modulator in the plasma of the subject that is less than 0.01 pg/mL.

138. The method of any one of embodiments 130 to 134, wherein the method provides a $C_{24}$ value of the immune modulator in the plasma of the subject that is less than 3 µg/mL.

139. The method of any one of embodiments 130 to 134, wherein the method provides a $C_{24}$ value of the immune modulator in the plasma of the subject that is less than 0.3 µg/mL.

140. The method of any one of embodiments 130 to 134, wherein the method provides a $C_{24}$ value of the immune modulator in the plasma of the subject that is less than 0.01 µg/mL.

141. The method of any one of embodiments 130 to 134, wherein the composition does not comprise an enteric coating.

142. The method of any one of embodiments 130 to 141, wherein the immune modulator is not a cyclic peptide.

143. The method of any one of embodiments 130 to 141, wherein the immune modulator is present in a pharmaceutical formulation within the device.

144. The method of embodiment 143, wherein the formulation is a solution of the immune modulator in a liquid medium.

145. The method of embodiment 143, wherein the formulation is a suspension of the immune modulator in a liquid medium.

146. The method of any one of embodiments 130 to 145, wherein the tissue originating from the endoderm is selected from the group consisting of: the stomach, the colon, the liver, the pancreas, the urinary bladder, the epithelial parts of the trachea, the lungs, the pharynx, the thyroid, the parathyroid, the intestines, and the gallbladder.

147. The method of any one of embodiments 130 to 145, wherein the inflammatory disease or condition that arises in a tissue originating from the endoderm is selected from the group consisting of: gastritis, Celiac disease, hepatitis, alcoholic lever disease, fatty liver disease (hepatic steatosis), non-alcoholic fatty liver disease (NAFLD), cirrhosis, primary schlerosing cholangitis, pancreatitis, insterstitial cystitits, asthma, chronic obstructic pulmonary disease, pulmonary fibrosis, pharyngitis, thyroiditis, hyperthyroidism, parathyroiditis, nephritis, Hashimoto's disease, Addison's disease, Graves' disease, Sjögren syndrome, type 1 diabetes, pelvic inflammatory disease, auditory canal inflammation, tinnitus, vestibular neuritis, otitis media, auditory canal inflammation, tracheitis, cholestatic liver disease, primary biliary sclerosis, liver parenchyma, an inherited metabolic disorder of the liver, Byler syndrome, cerebrotendinous, xanthomatosis, Zellweger's syndrome, neonatal hepatitis, cystic fibrosis, ALGS (Alagilles syndrome), PFIC (progressive familial intrahepatic cholestasis), autoimmune hepatitis, primary biliary cirrhosis (PBC), liver fibrosis, NAFLD, portal hypertension, general cholestasis, such as in jaundice due to drugs or during pregnancy, intra- and extrahepatic cholestasis, such as hereditary forms of cholestasis, such as PFIC1, gall stones and choledocholithiasis, malignancy causing obstruction of the biliary tree, symptoms (scratching, pruritus) due to cholestasis/jaundice, chronic autoimmune liver disease leading to progressive cholestasis, and pruritus of cholestatic liver disease, duodenal ulcers, enteritis (radiation-, chemotherapy-, or infection-induced enteritis), diverticulitis, pouchitis, cholecystitis, and cholangitis.

148. The method of any one of embodiments 130 to 145, wherein the inflammatory disease or condition that arises in a tissue originating from the endoderm is inflammation of the liver.

149. The method of any one of embodiments 130 to 148, wherein the immune modulator is released at a location in the proximal portion of the ascending colon.

150. The method of any one of embodiments 130 to 148, wherein the immune modulator is released at a location in the proximal portion of the cecum.

151. The method of any one of embodiments 130 to 148, wherein the immune modulator is released at a location in the proximal portion of the sigmoid colon.

152. The method of any one of embodiments 130 to 148, wherein the immune modulator is released at a location in the proximal portion of the transverse colon.

153. The method of any one of embodiments 130 to 148, wherein the immune modulator is released at a location in the proximal portion of the descending colon.

154. The method of any one of embodiments 130 to 148, wherein the method comprises administering to the subject a reservoir comprising the therapeutically effective amount of the immune modulator, wherein the reservoir is connected to the endoscope.

155. The method of any one of the preceding embodiments, further comprising administering a second agent orally, intravenously or subcutaneously, wherein the second agent is the same immune modulator; a different immune modulator; or an agent having a different biological target from the immune modulator, wherein the second agent is an agent suitable for treating an inflammatory disease or condition that arises in a tissue originating from the endoderm.

156. The method of embodiment 155, wherein the immune modulator is administered prior to the second agent.

157. The method of embodiment 155, wherein the immune modulator is administered after the second agent.

158. The method of embodiment 155, wherein the immune modulator and the second agent are administered substantially at the same time.

159. The method of any one of embodiments 155, wherein the second agent is administered intravenously.

160. The method of any one of embodiments 155, wherein the second agent is administered subcutaneously.

161. The method of any one of embodiments 155 to 160, wherein the amount of the second agent is less than the amount of the second agent when the immune modulator and the second agent are both administered systemically.

162. The method of embodiment 161, wherein the second agent is another immune modulator.

163. The method of any one of embodiments 1 to 154, wherein the method does not comprise administering a second agent.

164. The method of any one of embodiments 119 to 163, wherein the method comprises identifying an intended site of release prior to endoscopic administration.

165. The method of any one of embodiments 119 to 164, wherein the method comprises identifying an intended site of release substantially at the same time as releasing the immune modulator.

166. The method of any one of the preceding embodiments, wherein the method comprising monitoring the progress of the disease.

167. The method of any one of embodiments 1 to 164, wherein the method does not comprise administering an immune modulator with a spray catheter.

168. The method of any one of embodiments 1 to 164, wherein the method comprises administering an immune modulator with a spray catheter.

169. A method of treating an inflammatory disease or condition arising in a tissue originating from the endoderm in a subject, comprising:
releasing an immune modulator at a location in the gastrointestinal tract of the subject that is proximate to an intended site of release, wherein the method comprises administering to the subject a pharmaceutical composition comprising a therapeutically effective amount of the immune modulator the method comprising one or more of the following steps:
a) identifying a subject having a disease or condition that arises in a tissue originating from the endoderm;
b) determination of the severity of the disease;
c) determination of the location of the disease;
d) evaluating the subject for suitability to treatment;
e) administration of an induction dose of the immune modulator;
f) monitoring the progress of the disease; and/or
g) optionally repeating steps e) and f) one or more times.

170. The method of embodiment 169, wherein the pharmaceutical composition is an ingestible device and the method comprises administering orally to the subject the pharmaceutical composition.

171. The method of embodiment 169 or 170, wherein the method comprises administering one or more maintenance doses following administration of the induction dose in step e).

172. The method of embodiment 171, wherein the induction dose is a dose of the immune modulator administered in an ingestible device.

173. The method of embodiment 171 or 172, wherein the maintenance dose is a dose of the immune modulator administered in an ingestible device as disclosed herein.

174. The method of embodiment 171 or 172, wherein the maintenance dose is a dose of the immune modulator delivered systemically.

175. The method of embodiment 171, wherein the induction dose is a dose of the immune modulator delivered systemically.

176. The method of embodiment 171 or 175, wherein the maintenance dose is a dose of the immune modulator administered in an ingestible device.

177. The method of embodiment 171, wherein the induction dose is a dose of a second agent as delivered systemically.

178. The method of embodiment 171 or 175, wherein the maintenance dose is a dose of the immune modulator administered in an ingestible device.

179. An immune modulator delivery apparatus comprising:
- an ingestible housing comprising a reservoir having a pharmaceutical composition comprising a therapeutically effective amount of the immune modulator stored therein;
- a detector coupled to the ingestible housing, the detector configured to detect when the ingestible housing is proximate to a respective intended site of release;
- a valve system in fluid communication with the reservoir system; and
- a controller communicably coupled to the valve system and the detector, the controller configured to cause the valve system to open in response to the detector detecting that the ingestible housing is proximate to the respective intended site of release so as to release the therapeutically effective amount of the immune modulator at the respective intended site of release.

180. The immune modulator delivery apparatus according to embodiment 179, further comprising a pump positioned in the ingestible housing, the pump configured to pump the therapeutically effective amount of the immune modulator from the reservoir in response to activation of the pump by the controller responsive to detection by the detector of the ingestible housing being proximate to the intended site of release.

181. The immune modulator delivery apparatus according to embodiment 180, wherein the controller is configured to cause the pump to pump the therapeutically effective amount of the immune modulator from the reservoir according to the following protocol.

182. The immune modulator delivery apparatus according to embodiment 179, wherein the valve system comprises a dissolvable coating.

183. The anti-inflammatory agent delivery apparatus according to embodiment 179, wherein the valve system comprises one or more doors configured for actuation by at least one of sliding, pivoting, and rotating.

184. The immune modulator delivery apparatus according to embodiment 179, wherein the valve system comprises an electrostatic shield.

185. The immune modulator delivery apparatus according to embodiment 179, wherein the reservoir comprises a pressurized cell.

186. The immune modulator delivery apparatus according to embodiment 179, further comprising at least one actuatable anchor configured to retain the ingestible housing at the respective intended site of release upon actuation.

187. The anti-inflammatory inhibitor delivery apparatus according to embodiment 179, herein the actuatable anchor is retractable.

188. A composition comprising a therapeutically effective amount of the immune modulator of any one of the preceding embodiments, wherein the composition is capable of releasing the immune modulator at a location in the gastrointestinal tract of the subject.

189. The composition of embodiment 188, wherein the composition comprises a tissue anchoring mechanism for anchoring the composition to the location.

190. The composition of embodiment 189, wherein the tissue anchoring mechanism is capable of anchoring for anchoring to the location.

191. The composition of embodiment 189 or 190, wherein the tissue anchoring mechanism comprises an osmotically-driven sucker.

192. The composition of embodiment 189, 190 or 191, wherein the tissue anchoring mechanism comprises a connector operable to anchor the composition to the location.

193. The composition of embodiment 192, wherein the connector is operable to anchor the composition to the location using an adhesive, negative pressure and/or fastener.

194. An immune modulator for use in a method of treating an inflammatory disease or condition that arises in a tissue originating from the endoderm in a subject, wherein the method comprises orally administering to the subject an ingestible device loaded with the immune modulator, wherein the immune modulator is released by the device at a location in the gastrointestinal tract of the subject that is proximate to an intended site of release of the immune modulator.

195. The immune modulator for use of embodiment 194, wherein the immune modulator is contained in a reservoir suitable for attachment to a device housing, and wherein the method comprises attaching the reservoir to the device housing to form the ingestible device, prior to orally administering the ingestible device to the subject.

196. An attachable reservoir containing an immune modulator for use in a method of treating an inflammatory disease or condition that arises in a tissue originating from the endoderm, wherein the method comprises attaching the reservoir to a device housing to form an ingestible device and orally administering the ingestible device to a subject, wherein the immune modulator is released by device at a location in the gastrointestinal tract of the subject that is proximate to the intended site of release.

197. A composition comprising or consisting of an ingestible device loaded with a therapeutically effective amount of an immune modulator, for use in a method of treatment, wherein the method comprises orally administering the composition to the subject, wherein the immune modulator is released by the device at a location in the gastrointestinal tract of the subject that is proximate to an intended site of release.

198. The immune modulator for use according to embodiment 194 or 195, the attachable reservoir compartment for use according to embodiment 196, or the composition for use according to embodiment 197, wherein the intended site of release has been pre-determined.

199. The immune modulator for use according to embodiment 194 or 195, the attachable reservoir compartment for use according to embodiment 196, or the composition for use according to embodiment 197, wherein the ingestible device further comprises an environmental sensor and the method further comprises using the environmental sensor to identify the location of the intended site of release.

200. The immune modulator for use, the attachable reservoir compartment for use the composition for use, according to embodiment 199, wherein the environmental sensor is an imaging sensor and the method further comprising imaging the gastrointestinal tract to identify the intended site of release.

201. The immune modulator for use, the attachable reservoir compartment for use, or the composition for use, according to embodiment 200, wherein the imaging detects an intended site of release.

202. The immune modulator for use, the attachable reservoir compartment for use or the composition for use, according to any one of embodiments 194 to 201, wherein the inflammatory disease or condition that arises in a tissue originating from the endoderm is selected from the group of: gastritis, Celiac disease, hepatitis, alcoholic lever disease, fatty liver disease (hepatic steatosis), non-alcoholic fatty liver disease (NAFLD), cirrhosis, primary schlerosing cholangitis, pancreatitis, insterstitial cystitits, asthma, chronic obstructic pulmonary disease, pulmonary fibrosis, pharyngitis, thyroiditis, hyperthyroidism, parathyroiditis, nephritis, Hashimoto's disease, Addison's disease, Graves' disease, Sjögren syndrome, type 1 diabetes, pelvic inflammatory disease, auditory canal inflammation, tinnitus, vestibular neuritis, otitis media, auditory canal inflammation, tracheitis, cholestatic liver disease, primary biliary sclerosis, liver parenchyma, an inherited metabolic disorder of the liver, Byler syndrome, cerebrotendinous, xanthomatosis, Zellweger's syndrome, neonatal hepatitis, cystic fibrosis, ALGS (Alagilles syndrome), PFIC (progressive familial intrahepatic cholestasis), autoimmune hepatitis, primary biliary cirrhosis (PBC), liver fibrosis, NAFLD, portal hypertension, general cholestasis, such as in jaundice due to drugs or during pregnancy, intra- and extrahepatic cholestasis, such as hereditary forms of cholestasis, such as PFIC1, gall stones and choledocholithiasis, malignancy causing obstruction of the biliary tree, symptoms (scratching, pruritus) due to cholestasis/jaundice, chronic autoimmune liver disease leading to progressive cholestasis, and pruritus of cholestatic liver disease, duodenal ulcers, enteritis (radiation-, chemotherapy-, or infection-induced enteritis), diverticulitis, pouchitis, cholecystitis, and cholangitis.

203. An ingestible device loaded with a therapeutically effective amount of an immune modulator, wherein the device is controllable to release the immune modulator at a location in the gastrointestinal tract of the subject that is proximate to an intended site of release.

204. The device of embodiment 203 for use in a method of treatment of the human or animal body.

205. The immune modulator for use, the attachable reservoir compartment for use or the composition for use according to any one of embodiments 194 to 202, or the device according to embodiment 203 or embodiment 204, wherein the ingestible device comprises:
a housing defined by a first end, a second end substantially opposite from the first end, and a wall extending longitudinally from the first end to the second end;
a reservoir located within the housing and containing the immune modulator wherein a first end of the reservoir is connected to the first end of the housing;
a mechanism for releasing the anti-inflammatory from the reservoir;
and
an exit value configured to allow the immune modulator to be released out of the housing from the reservoir.

206. The immune modulator for use, the attachable reservoir compartment for use or the composition for use according to any one of embodiments 194 to 202, or the device according to embodiment 203 or embodiment 204, wherein the ingestible device comprises:
an ingestible housing comprising a reservoir compartment having a therapeutically effective amount of the immune modulator stored therein;
a release mechanism having a closed state which retains the immune modulator in the reservoir and an open state which releases the immune modulator the reservoir to the exterior of the device; and
an actuator which changes the state of the release mechanism from the closed to the open state.

207. The immune modulator for use, the attachable reservoir compartment for use, the composition for use, or the device according to embodiments 205 or 206, wherein the ingestible device further comprises an environmental sensor for detecting the location of the device in the gut.

208. The immune modulator for use, the attachable reservoir compartment for use, the composition for use, or the device according to embodiment 207, wherein the ingestible device further comprises a communication system for transmitting data from the environmental sensor to an external receiver.

209. The immune modulator for use, the attachable reservoir compartment for use, the composition for use, or the device according to embodiment 207 or 208, wherein the ingestible device further comprises a processor or controller which is coupled to the environmental sensor and to the actuator and which triggers the actuator to cause the release mechanism to transition from its closed state to its open state when it is determined that the device is at or proximal to the intended site of release.

210. The immune modulator for use, the attachable reservoir compartment for use, the composition for use, or the device according to embodiment 208, wherein the communication system further comprises means for receiving a signal from an external transmitter, and wherein the actuator is adapted to be triggered in response to the signal.

211. The immune modulator for use, the attachable reservoir compartment for use, the composition for use, or the device according to any one of embodiments 205 to 210, wherein the ingestible device further comprises a communication system for transmitting localization data to an external receiver.

212. The immune modulator for use, the attachable reservoir compartment for use, the composition for use, or the device according to any one of embodiments 205 to 208, wherein the ingestible device further comprises a communication system for transmitting localization data to an external receiver and for receiving a signal from an external transmitter; wherein the actuator is adapted to be triggered in response to the signal.

213. The immune modulator for use, the attachable reservoir compartment for use, the composition for use, or the device according to any one of embodiments 114 to 212, wherein the ingestible device further comprises a deployable anchoring system and an actuator for deploying the anchoring system, wherein the anchoring system is capable of anchoring or attaching the ingestible device to the subject's tissue.

214. The method of any one of embodiments 1-178, wherein the subject has previously been identified as having an inflammatory disease or condition that arises in a tissue originating from the endoderm.

215. The method of any one of embodiments 1-107 or 113-178, wherein the immune modulator is selected from the group consisting of: IL-12/IL-23 inhibitors, TNFα inhibitors, IL-6 receptor inhibitors, JAK inhibitors, CD3 inhibitors, CD40/CD40L inhibitors, IL-1 inhibitors, IL-13 inhibitors, IL-10 receptor agonists, integrin inhibitors, and S1P antagonists.

216. A method of formulating a pharmaceutical composition comprising an immune modulator, the method comprising:
(a) topically administering a dose of an immune modulator to a small intestine and/or colon of a mammal;
(b) selecting an immune modulator whose topical administration in step (a) has been determined to result in (i) a decrease in one or both of the level of T cells in a mesenteric lymph node and the level of T cells in a Peyer's patch in the mammal, and/or (ii) an increase in the level of T cells in blood in the mammal, each as compared to the corresponding level in a control mammal systemically administered the same dose of the immune modulator; and
(c) formulating a pharmaceutical composition comprising the selected immune modulator.

217. A method of formulating a pharmaceutical composition comprising an immune modulator, the method comprising:
(a) selecting an immune modulator whose topical administration to a small intestine and/or colon of a mammal has been determined to result in (i) a decrease in one or both of the level of T cells in a mesenteric lymph node and the level of T cells in a Peyer's patch in the mammal, and/or (ii) an increase in the level of T cells in blood in the mammal, each as compared to the corresponding level in a control mammal systemically administered the same dose of the immune modulator; and
(b) formulating a pharmaceutical composition comprising the selected immune modulator.

218. A method of formulating a pharmaceutical composition comprising an immune modulator, the method comprising formulating a pharmaceutical composition comprising an immune modulator determined to result in a mammal topically administered a dose of an immune modulator to the small intestine and/or colon of the mammal: (i) a decrease in one or both of the level of T cells in a mesenteric lymph node and the level of T cells in a Peyer's patch in a mammal, and/or (ii) an increase in the level of T cells in blood in the mammal, each as compared to the corresponding level in a control mammal systemically administered the same dose of the immune modulator.

219. The method of any one of embodiment 216-218, wherein the level of T cells in the mesenteric lymph node is the level of Th memory cells in the mesenteric lymph node.

220. The method of any one of embodiments 216-218, wherein the level of T cells in the Peyer's patch is the level of Th memory cells in the Peyer's patch.

221. The method of any one of embodiments 216-218, wherein the level of T cells in the blood is the level of Th memory cells in the blood.

222. The method of any one of embodiments 216-218, wherein the topical administration of the immune modulator has been determined to result in a decrease in one or both of the level of T cells in a mesenteric lymph node and the level of T cells in a Peyer's patch in a mammal, each as compared to the corresponding level in a control mammal systemically administered the same dose of the immune modulator.

223. The method of any one of embodiments 216-218, wherein the topical administration of the immune modulator has been determined to result in an increase in the level of T cells in blood in the mammal, as compared to the corresponding level in a control mammal systemically administered the same dose of the immune modulator.

224. The method of any one of embodiments 216-218, wherein the topical administration of the immune modulator has been determined to result in (i) a decrease in one or both of the level of T cells in a mesenteric lymph node and the level of T cells in a Peyer's patch in a mammal, and (ii) an increase in the level of T cells in blood in the mammal, each as compared to the corresponding level in a control mammal systemically administered the same dose of the immune modulator.

225. The method of any one of embodiments 216-224, wherein the control mammal is a mammal of a similar age and having a similar disease state as compared to the mammal topically administered the dose of the immune modulator.

226. The method of any one of embodiments 216-225, wherein the immune modulator is selected from the group consisting of: IL-12/IL-23 inhibitors, TNFα inhibitors, IL-6 receptor inhibitors, JAK inhibitors, CD3 inhibitors, CD40/CD40L inhibitors, IL-1 inhibitors, IL-13 inhibitors, IL-10 receptor agonists, integrin inhibitors, and SIP modulators.

227. The method of any one of embodiments 216-226, wherein the pharmaceutical composition is an ingestible device that contains a therapeutically effective amount of the immune modulator disposed therein.

228. A pharmaceutical composition prepared by the method of any one of embodiments 216-227.

229. A kit comprising the pharmaceutical composition of embodiment 228.

Additional Exemplary Embodiments

1. A method of treating an inflammatory disease or condition that arises in a tissue originating from the endoderm in a subject in need thereof, comprising:
topically administering to the subject a pharmaceutical formulation comprising a therapeutically effective amount of an immune modulator, said topical administration comprising:
orally administering an ingestible device to the subject, said device containing the pharmaceutical formulation; and releasing the pharmaceutical formulation from the device to an intended site in
(a) the small intestine of the subject's GI tract; or (b) the large intestine of the subject's GI tract;
thereby treating the inflammatory disease or condition that arises in a tissue originating from the endoderm.

2. The method of embodiment 1, wherein the inflammatory disease or condition that arises in a tissue originating from the endoderm is in the GI tract, gallbladder, pancreas, or liver of the subject.

3. The method of embodiment 1 or 2, wherein the device comprises a self-localization mechanism configured to determine a device location within the subject's GI tract, and the method further comprises determining the device location within the subject's GI tract via the device self-localization mechanism.

4. The method of embodiment 3, wherein determining the device location within the subject's GI tract via the device self-localization mechanism comprises detecting one or more device transitions between portions of the subject's GI tract; optionally, the one or more device transitions occurs between portions of the GI tract selected from the group consisting of: mouth and stomach; esophagus and stomach; stomach and duodenum; duodenum and jejunum; jejunum and ileum; ileum and cecum; and cecum and ascending colon; and combinations of any two or more of the foregoing.

5. The method of embodiment 4, wherein the portions are adjacent portions; optionally, the adjacent portions are selected from the group consisting of: stomach and duodenum; duodenum and jejunum; jejunum and ileum; ileum and cecum; and cecum and ascending colon; and combinations of any two or more of the foregoing.

6. The method of any one of embodiments 3 to 5, wherein the determining of the device location within the subject's GI tract via the device self-localization mechanism further comprises confirming the one or more device transition between the portions of the GI tract of the subject.

7. The method of any one of embodiments 3 to 6, wherein the device self-localization mechanism is based on data comprising light reflectance occurring external to the device and within the GI tract of the subject.

8. The method of any one of embodiments 3 to 7, wherein the device self-localization mechanism is based on data comprising elapsed time after entry of the device into the GI tract of the subject, elapsed time after detecting at least one of the one or more device transitions between the portions of the subject's GI tract, or a combination thereof.

9. The method of any one of embodiments 3 to 8, wherein the device self-localizes to the stomach, duodenum, jejunum, ileum, cecum, ascending colon, or transverse colon with at least 80% accuracy; optionally, with at least 85% accuracy.

10. The method of any one of embodiments 3 to 9, wherein the release of the formulation from the device is autonomously triggered based on the self-localization of the device to a pre-selected location within the subject's GI tract; optionally, the pre-selected location is selected from the group consisting of the stomach, the duodenum, the jejunum, the ileum, the cecum, the ascending colon, the transverse colon, and the descending colon.

11. The method of embodiment 10, wherein the release of the formulation from the device occurs at substantially the same time as the device self-localizes to the pre-selected location.

12. The method of embodiment 10 or 11, wherein the release of the formulation from the device commences within a period of time of at most about 5 minutes after the device detects or confirms the transition to the pre-selected location; optionally, the period of time is at most about 1 minute, at most about 30 seconds, at most about 10 seconds, or at most about 1 second after the device detects or confirms the transition to the pre-selected location.

13. The method of any one of embodiments 10 to 12, wherein the release of the formulation is as a bolus.

14. The method of embodiment 10, wherein the release of the formulation from the device occurs over a pre-determined period of time; optionally, the pre-determined period of time over which the formulation is released from the device is about 8 hours, about 7 hours, about 6 hours, about 5 hours, about 4 hours, about 3 hours, about 2 hours, about 1 hour, about 30 minutes, about 15 minutes, about 10 minutes, or about 5 minutes.

15. The method of embodiment 14, wherein the pre-determined period of time commences within at most about 5 minutes, at most about 1 minute, at most about 30 seconds, at most about 10 seconds, or at most about 1 second after the device detects or confirms the transition to the pre-selected location.

16. The method of any one of embodiments 1 to 15, wherein release of the formulation from the device (a) to the small intestine or (b) to the large intestine provides one or more of the following pharmacodynamic effects:

a. decreased immune response in diseased tissue, lymph nodes or lymph tissues;
b. decreased T cells measured in diseased tissue, lymph nodes or lymph tissues;
c. increased T cells in peripheral circulation as measured in blood, plasma or serum;
d. changed anatomical features, including suppressed or reduced development, aggregation, or accumulation of one or more of intestinal lymphoid tissues, isolated lymphoid follicles (ILFs), intestinal lymphoid aggregates, or hepatic lymphoid aggregates;
e. decreased differentiation of immune cells in the diseased tissue;
f. decreased levels of inflammatory cytokine levels in the diseased tissue; or
g. improved efficacy of treatment using one or more clinical assessments of a treatment, such as endoscopic scoring for IBD, or evidence of hepatic steatosis by imaging or by histology for NAFLD.

17. The method of embodiment 16, wherein the one or more pharmacodynamic effects are determined relative to (a) non-treatment, or (b) administration of the immune modulator via a traditional route of administration. In some embodiments, the one or more pharmacodynamic effects are determined relative to administration of the same amount of the immune modulator via the traditional route of administration. In some embodiments, the traditional route of administration is intravenous administration or subcutaneous administration. In some embodiments, the formulation is not contained in an ingestible device.

17a. The method of embodiment 16 or 17, wherein the increased or decreased pharmacodynamic effect, or the improved efficacy of treatment, is about 1.5-fold to about 100 fold, about 1.5-fold to about 2-fold, or about 1.5-fold to about 10-fold. In some embodiments, the increased or decreased pharmacodynamic effect is about 1.5-fold, about 2-fold, about 10-fold or about 100-fold. In some embodiments, the increase or decrease in pharmacodynamics effect is relative to the same subject or relative to a population of subjects.

In some embodiments, the suppressed or reduced development, aggregation, or accumulation of one or more of intestinal lymphoid tissues, isolated lymphoid follicles (ILFs), intestinal lymphoid aggregates, or hepatic lymphoid aggregates is about 1.5-fold to about 100 fold, about 1.5-fold to about 2-fold, or about 1.5-fold to about 10-fold. In some embodiments, the suppressed or reduced development, aggregation, or accumulation of one or more of intestinal lymphoid tissues, isolated lymphoid follicles (ILFs), intestinal lymphoid aggregates, or hepatic lymphoid aggregates is about 1.5-fold, about 2-fold, about 10-fold or about 100-fold. In some embodiments, the suppressed or reduced development, aggregation, or accumulation of one or more of intestinal lymphoid tissues, isolated lymphoid follicles (ILFs), intestinal lymphoid aggregates, or hepatic lymphoid aggregates is relative to the same subject or relative to a population of subjects.

18. The method of any one of embodiments 3 to 17a, wherein determining the device location as the cecum autonomously triggers the release of the formulation to the cecum, thereby delivering the immune modulator to at least one of the one or more intended sites in the colon; optionally, the device determines the location as the cecum with at least 80% accuracy; preferably, with at least 85% accuracy.

19. The method of any one of embodiments 3 to 17a, wherein determining the device location as the cecum autonomously triggers the release of the formulation to the cecum, thereby treating an inflammatory disease or condition that arises in a tissue originating from the endoderm; optionally, the device determines the location as the cecum with at least 80% accuracy; preferably, with at least 85% accuracy.

20. The method any one of embodiments 3 to 17a, wherein determining the device location as the ileum autonomously triggers the release of the formulation to the ileum, thereby delivering the immune modulator to at least one of the one or more intended sites in the ileum; optionally, the device determines the location as the ileum with at least 80% accuracy; preferably, with at least 85% accuracy.

21. The method of any one of embodiments 3 to 17a, wherein determining the device location as the ileum autonomously triggers the release of the formulation to the ileum, thereby treating an inflammatory disease or condition that arises in a tissue originating from the endoderm; optionally, the device determines the location as the ileum with at least 80% accuracy; preferably, with at least 85% accuracy.

22. The method of any one of embodiments 3 to 17a, wherein determining the device location as the duodenum autonomously triggers the release of the formulation to the duodenum, thereby delivering the immune modulator to at least one of the one or more intended sites in the small intestine; optionally, the device determines the location as the duodenum with at least 80% accuracy; preferably, with at least 85% accuracy.

23. The method of any one of embodiments 3 to 17a, wherein determining the device location as the duodenum autonomously triggers the release of the formulation to the duodenum, thereby treating an inflammatory disease or condition that arises in a tissue originating from the endoderm; optionally, the device determines the location as the duodenum with at least 80% accuracy; preferably, with at least 85% accuracy.

24. The method of any one of embodiments 3 to 17a, wherein determining the device location as the jejunum autonomously triggers the release of the formulation to the jejunum, thereby delivering the immune modulator to at least one of the one or more intended sites in the small intestine; optionally, the device determines the location as the jejunum with at least 80% accuracy; preferably, with at least 85% accuracy.

25. The method of any one of embodiments 3 to 17a, wherein determining the device location as the jejunum autonomously triggers the release of the formulation to the jejunum, thereby treating an inflammatory disease or condition that arises in a tissue originating from the endoderm; optionally, the device determines the location as the jejunum with at least 80% accuracy; preferably, with at least 85% accuracy.

26. The method of any one of embodiments 3 to 17a, wherein determining the device location as the small intestine autonomously triggers release of the formulation to the small intestine, and wherein the disease is present in the liver.

27. The method of any one of embodiments 3 to 17a and 24 to 26, wherein determining the device location as the small intestine autonomously triggers release of the formulation to the small intestine, and wherein the disease is NAFLD or NASH.

28. The method of any one of embodiments 17 to 27, wherein the inflammatory disease or condition is the result of an autoimmune disease or condition.

29. The method of any one of embodiments 1 to 16, wherein the release of the formulation from the device is to the section or subsection of the subject's GI tract containing the inflammatory disease or condition.

30. The method of embodiment 29, wherein determining the device location as the colon autonomously triggers the release of the formulation to the colon, thereby delivering the immune modulator to at least one of the one or more intended sites in the colon; optionally, the device determines the location as the colon with at least 80% accuracy; preferably, with at least 85% accuracy.

31. The method of embodiment 29, wherein determining the device location as the colon autonomously triggers the release of the formulation to the colon, thereby treating an inflammatory disease or condition that arises in a tissue originating from the endoderm; optionally, the device determines the location as the colon with at least 80% accuracy; preferably, with at least 85% accuracy.

32. The method of embodiment 29, wherein determining the device location as the ileum autonomously triggers the release of the formulation to the ileum, thereby delivering the immune modulator to at least one of the one or more intended sites in the ileum; optionally, the device determines the location as the ileum with at least 80% accuracy; preferably, with at least 85% accuracy.

33. The method of embodiment 29, wherein determining the device location as the ileum autonomously triggers the release of the formulation to the ileum, thereby treating an inflammatory disease or condition that arises in a tissue originating from the endoderm; optionally, the device determines the location as the ileum with at least 80% accuracy; preferably, with at least 85% accuracy.

34. The method of embodiment 29, wherein determining the device location as the jejunum autonomously triggers the release of the formulation to the jejunum, thereby delivering the immune modulator to at least one of the one or more intended sites in the jejunum; optionally, the device determines the location as the jejunum with at least 80% accuracy; preferably, with at least 85% accuracy.

35. The method of embodiment 29, wherein determining the device location as the jejunum autonomously triggers the release of the formulation to the jejunum, thereby treating an inflammatory disease or condition that arises in a tissue originating from the endoderm; optionally, the device determines the location as the jejunum with at least 80% accuracy; preferably, with at least 85% accuracy.

36. The method of embodiment 29, wherein determining the device location as the duodenum autonomously triggers the release of the formulation to the duodenum, thereby delivering the immune modulator to at least one of the one or more intended sites in the duodenum; optionally, the device determines the location as the duodenum with at least 80% accuracy; preferably, with at least 85% accuracy.

37. The method of embodiment 29, wherein determining the device location as the duodenum autonomously triggers the release of the formulation to the duodenum, thereby treating an inflammatory disease or condition that arises in a tissue originating from the endoderm; optionally, the device determines the location as the duodenum with at least 80% accuracy; preferably, with at least 85% accuracy.

38. The method of any one of embodiments 1 to 37, wherein the inflammatory disease or condition that arises in a tissue originating from the endoderm is an inflammatory disease of the GI tract, and the section of the GI tract containing one or more inflammatory disease sites is selected from the group consisting of the stomach, duodenum, jejunum, ileum, cecum, ascending colon, transverse colon, descending colon and rectum; and a combination of any two or more of the foregoing.

39. The method of any one of embodiments 1 to 38, wherein the inflammatory disease or condition that arises in a tissue originating from the endoderm is an inflammatory disease of the liver, and the intended site of release in the GI tract is selected from the group consisting of the stomach, duodenum, jejunum, ileum, cecum, ascending colon, transverse colon, descending colon and rectum; and a combination of any two or more of the foregoing.

40. The method of any one of embodiments 3 to 39, wherein the device self-localization mechanism does not require monitoring the pH of the subject's GI tract.

41. The method of any one of embodiments 1 to 40, wherein the method excludes a pH-dependent drug release mechanism.

42. The method of any one of embodiments 3 to 41, wherein the device self-localization mechanism does not require monitoring the pressure of the subject's GI tract, the temperature of the subjects GI tract, or both.

43. The method of any one of embodiments 1 to 42, wherein the method treats the inflammatory disease or condition.

44. The method of any one of embodiments 1 to 43, wherein the method provides a ratio of immune modulator concentration in the subject's disease tissue to immune modulator concentration in the subject's blood, serum, or plasma greater than about 3:2, about 2:1, about 3:1, about 4:1, about 5:1, about 10:1, about 15:1, or about 100:1 or greater.

45. The method of any one of embodiments 1 to 44, wherein the method suppresses the subject's local GI tract immune response as compared to the subject's peripheral immune response.

46. The method of any one of embodiments 1 to 45, wherein the therapeutically effective amount of the immune modulator is an induction dose.

47. The method of any one of embodiments 1 to 45, wherein the therapeutically effective amount of the immune modulator is a maintenance dose.

48. The method of any one of embodiments 1 to 47, wherein the immune modulator is an antibody; optionally, the antibody is a monoclonal antibody.

49. The method of embodiment 48, wherein the pharmaceutical formulation further comprises one or more pharmaceutically acceptable excipients.

50. The method of embodiment 48 or 49, wherein the antibody or monoclonal antibody is present in the formulation at a concentration of greater than 100 mg/mL.

51. The method of embodiment 50, wherein the antibody or monoclonal antibody is present in the formulation at a concentration of at least about 125 mg/mL.

52. The method of embodiment 50, wherein the antibody or monoclonal antibody is present in the formulation at a concentration of at least about 150 mg/mL.

53. The method of embodiment 50, wherein the antibody or monoclonal antibody is present in the formulation at a concentration of at least about 175 mg/mL.

54. The method of any one of embodiments 49 to 53, wherein the formulation comprises a polyol, a non-ionic surfactant, or both.

55. The method of embodiment 54, wherein the polyol is selected from the group consisting of mannitol, sorbitol, sucrose, trehalose, raffinose and maltose, and a combination of any two or more of the foregoing.

56. The method of embodiment 54 or 55, wherein the non-ionic surfactant is a polysorbate or a poloxamer; optionally, the polysorbate is polysorbate 20, 40, 60 or 80, or more particularly, polysorbate 80.

57. The method of any one of embodiments 49 to 56, wherein the formulation comprises an amino acid; optionally, the amino acid is a free amino acid selected from the group consisting of histidine, alanine, arginine, glycine, glutamic acid and methionine, and a combination of any two or more of the foregoing; preferably, the free amino acid is histidine, arginine, or a combination thereof.

58. The method of embodiment 57, wherein the amino acid is a free amino acid or a salt thereof; preferably, the amino acid or salt thereof is histidine or a salt thereof, arginine or a salt thereof, or a combination thereof.

59. The method of any one of embodiments 49 to 58, wherein the formulation comprises a buffer, a salt, or both; optionally, the salt is sodium chloride; optionally, the buffer is an aqueous buffer; optionally, the aqueous buffer is a citrate buffer or a phosphate buffer.

60. The method of any one of embodiments 54 to 56, wherein the formulation consists of or consists essentially of the antibody or monoclonal antibody, the polyol, the surfactant, and water.

61. The method of any one of embodiments 49 to 58, wherein the formulation comprises an acetate salt; optionally, the formulation comprises negligible or non-detectable levels of a salt other than the acetate salt, negligible or non-detectable levels of citrate buffer, and negligible or non-detectable levels of phosphate buffer.

62. The method of any one of embodiments 49 to 56, wherein the formulation consists essentially of or consists of (i) the antibody or monoclonal antibody; (ii) a polyol, sugar or sugar alcohol; (iii) a non-ionic surfactant; (iv) a salt, such as sodium chloride; and (v) an aqueous buffer system; optionally, the polyol, sugar or sugar alcohol is mannitol or sucrose; the non-ionic surfactant is a polysorbate such as polysorbate 80; the salt is sodium chloride; and the aqueous buffer system consists essentially of or consists of water and a phosphate buffer, a citrate buffer, or both.

63. The method of any one of embodiments 49 to 56, wherein the formulation comprises negligible or non-detectable levels of salt and/or buffer.

64. The method of any one of embodiments 49 to 61, wherein the formulation further comprises a chelating agent; optionally, the chelating agent is succinic acid or EDTA.

65. The method of any one of embodiments 49 to 64, wherein the formulation is provided as a solution, wherein the antibody or monoclonal antibody is present in the solution formulation at a concentration of at least about 110 mg/mL, at least about 125 mg/mL, at least 150 mg/mL or at least 175 mg/mL.

66. The method of any one of embodiments 49 to 64, wherein the formulation is lyophilized to provide a powder; wherein the formulation comprises water prior to lyophilization.

67. The method of embodiment 48, wherein the pharmaceutical formulation is provided as a solid comprising the antibody or monoclonal antibody; optionally, the formulation further comprises one or more pharmaceutically acceptable excipients.

68. The method of embodiment 67, wherein the solid is a lyophilized powder.

69. The method of embodiment 67, wherein the antibody or monoclonal antibody is provided as a crystalline solid.

70. The method of any one of embodiments 67 to 69, wherein the antibody or monoclonal antibody is present in the pharmaceutical formulation at a concentration of at least about 75% (w/w), about 80% (w/w), about 85% (w/w), or at least about 90% (w/w); optionally, at least about 95%, about 96%, about 97%, about 98% or about 99% (w/w).

71. The method of any one of embodiments 67 to 69, wherein the formulation consists essentially of or consists of the antibody or monoclonal antibody.

72. The method of any one of embodiments 48 to 71, wherein the antibody or monoclonal antibody is selected from the group consisting of vedolizumab (Entyvio®, Millennium Pharmaceuticals), natalizumab (Tysabri®), etrolizumab, or a biosimilar thereof.

73. The method of any one of embodiments 1 to 47, wherein the immune modulator is a small molecule or peptide, and the formulation optionally further comprises one or more pharmaceutically acceptable excipients.

74. The method of any one of embodiments 1 to 47 or 73, wherein the immune modulator is AJM300 (Ajinomoto Pharmaceuticals) or carogetrast (Ajinomoto Pharmaceuticals); or a pharmaceutically acceptable salt of either of the aforementioned immune modulators.

75. The method of any one of embodiments 1 to 47 or 73, wherein the immune modulator is PF00547659; or a pharmaceutically acceptable salt thereof.

76. The method of embodiment 73, 74 or 75, wherein the pharmaceutical formulation is provided as a solid, and the immune modulator is present in the pharmaceutical formulation at a concentration of at least about 75% (w/w), about 80% (w/w), about 85% (w/w), at least about 90% (w/w), at least about 95%, at least about 96%, at least about 97%, at least about 98% or at least about 99% (w/w); optionally, the pharmaceutical formulation consists essentially of or consists of the immune modulator.

77. The method of embodiment 73, 74 or 75, wherein the pharmaceutical formulation is provided as a solution, a dispersion, an emulsion or a suspension; preferably, the pharmaceutical formulation comprises the immune modulator at a concentration of at least about 5 mg/mL or 5 mg/g, at least about 10 mg/mL or 10 mg/g, or at least about 15 mg/mL or 15 mg/g.

78. The method of any one of embodiments 1 to 77, wherein the method comprises administering an additional agent in addition to the immune modulator, wherein the additional agent is administered topically or by another form of administration; optionally, the topical administration is via an ingestible device.

79. The method of embodiment 78, wherein the additional agent is selected from the group consisting of an immunosuppressant (optionally, a corticosteroid), an aminosalicylate, a JAK inhibitor, an SIP modulator, a PDE4 inhibitor, an anti-IL-12/23 agent, a second immune modulator, a GM-CSF, and an anti-TNF agent.

80. The method of embodiment 79, wherein the additional agent is a JAK inhibitor.

81. The method of embodiment 80, wherein the JAK inhibitor is selected from the group consisting of baricitinib, filgotinib, upadacitinib, TD-1473, TD-3504 and tofacitinib; and pharmaceutically acceptable salts thereof.

82. The method of embodiment 81, wherein the JAK inhibitor is tofacitinib citrate.

83. The method of embodiment 79, wherein the additional agent is an SIP modulator.

84. The method of embodiment 83, wherein the SIP modulator is selected from the group consisting of fingolimod, KRP203, siponimod, ponesimod, cenerimod, ozanimod, ceralifimod, amiselimod, and etrasimod; and pharmaceutically acceptable salts thereof.

85. The method of embodiment 84, wherein the SIP modulator is ozanimod, etrasimod or amiselimod; or a pharmaceutically acceptable salt thereof.

86. The method of embodiment 79, wherein the additional agent is a GM-CSF.

87. The method of embodiment 86, wherein the GM-CSF is sargramostim (Leukine®) or molgramostim; or a biosimilar thereof; optionally, the GM-CSF is administered during maintenance therapy.

88. The method of embodiment 79, wherein the additional agent is a PDE4 inhibitor.

89. The method of embodiment 88, wherein the PDE4 inhibitor is selected from the group consisting of apremilast, cilomilast, crisaborole, ibudilast, lotamilast, roflumilast, and tetomilast; and pharmaceutically acceptable salts thereof.

90. The method of embodiment 89, wherein the PDE4 inhibitor is apremilast or a pharmaceutically acceptable salt thereof.

91. The method of embodiment 89, wherein the PDE4 inhibitor is tetomilast or a pharmaceutically acceptable salt thereof.

92. The method of embodiment 79, wherein the additional agent is CD3 inhibitor.

93. The method of embodiment 92, wherein the CD3 inhibitor is selected from the group consisting of visilizumab, muromonab-CD3, otelixizumab, foralumab, teplizumab; and biosimilars thereof.

94. The method of embodiment 93, wherein the CD3 inhibitor is foralumab or a biosimilar thereof.

95. The method of embodiment 72, wherein the vedolizumab or the biosimilar thereof is administered systemically.

96. The method of embodiment 72, wherein the additional agent is an integrin inhibitor selected from the group consisting of AJM-300, carotegrast (HCA2969), firategrast, valategrast, RO0270608, CDP-323, CT7758, GW-559090, ELND-004, PN-10943 (PN-943) and PTG-100; and pharmaceutically acceptable salts thereof.

97. The method of embodiment 96, wherein the integrin inhibitor is AJM-300 or a pharmaceutically acceptable salt thereof.

98. The method of embodiment 96, wherein the integrin inhibitor is carotegrast or a pharmaceutically acceptable salt thereof.

99. The method of embodiment 79, wherein the additional agent is an anti-IL-12/23 agent.

100. The method of embodiment 99, wherein the anti-IL-12/23 agent is selected from the group consisting of ustekinumab, guselkumab, risankizumab, brazikumab, and mirikizumab; and biosimilars thereof.

101. The method of embodiment 99, wherein the anti-IL-12/23 agent is selected from apilimod mesylate; PTG-200;

Compound A having the structure
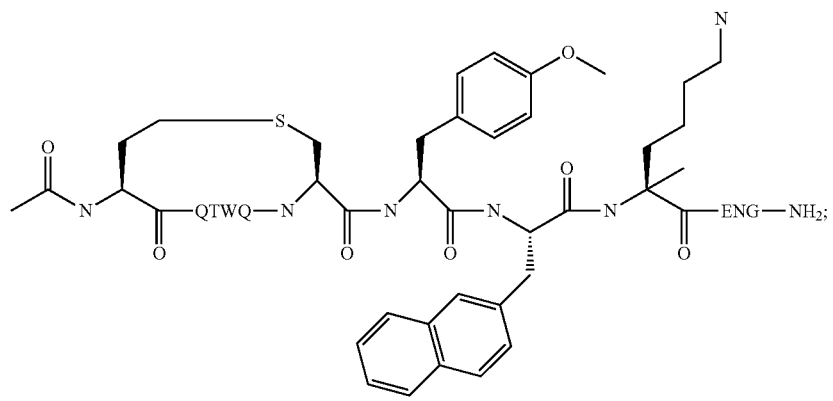
Compound B having the structure
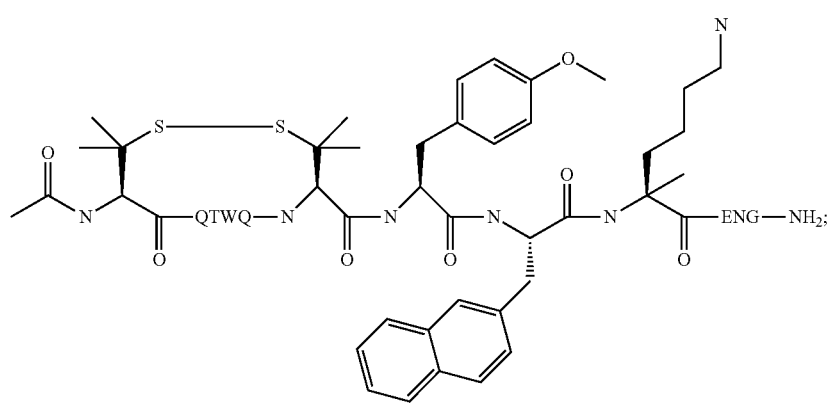
and Compound C having the structure
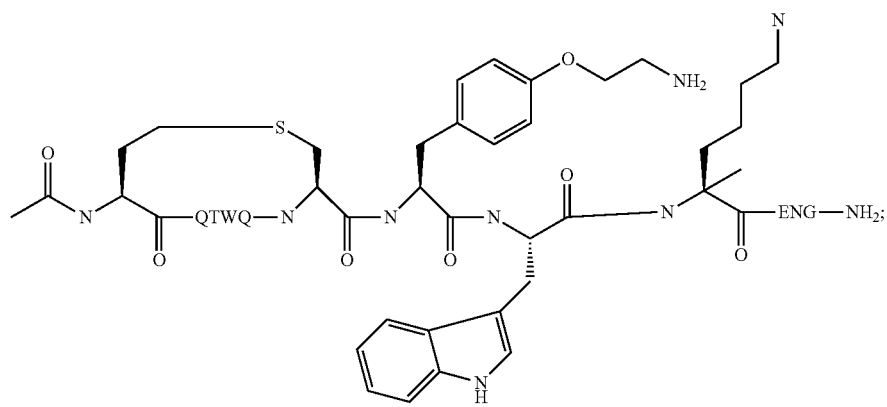

or a pharmaceutically acceptable salt thereof. Any N atom lacking an atom at one or more of the three N valencies is assumed to be H.

102. The method of embodiment 79, wherein the additional agent is an anti-TNF agent.

103. The method of embodiment 102, wherein the anti-TNF agent is selected from the group consisting of adalimumab, infliximab, golimumab, certolizumab, certolizumab pegol, and etanercept; and biosimilars thereof.

104. The method of embodiment 103, wherein the anti-TNF agent is adalimumab or a biosimilar thereof.

105. The method of embodiment 104, wherein the adalimumab is administered systemically.

106. The method of embodiment 79, wherein the additional agent is an immunosuppressant, such as optionally, a corticosteroid selected from the group consisting of prednisone, methylprednisolone, hydrocortisone and budesonide; and pharmaceutically acceptable salts thereof.

107. The method of embodiment 79, wherein the additional agent is an aminosalicylate; such as optionally, the aminosalicylate is mesalazine or a pharmaceutically acceptable salt thereof.

108. The method of embodiment 78, wherein the additional agent is selected from the group consisting of methotrexate, Traficet-EN, alicaforsen (ISIS 2302), SB012, tacrolimus, cyclosporin A, and neuregulin-4; and pharmaceutically acceptable salts thereof.

109. The method of any one of embodiments 78 to 108, wherein the immune modulator is ustekinumab or a biosimilar thereof.

110. The method of any one of embodiments 78 to 109, wherein the additional agent is administered topically via an ingestible device.

111. The method of embodiment 110, wherein the additional agent is administered together with the immune modulator in the same ingestible device as the immune modulator.

112. The method of embodiment 110, wherein the additional agent is administered separately from the immune modulator in a separate ingestible device from the immune modulator.

113. The method of any one of embodiments 78 to 109, wherein the additional agent is administered orally.

114. The method of any one of embodiments 78 to 109, wherein the additional agent is administered systemically.

115. The method of any one of embodiments 78 to 109, wherein the additional agent is administered intravenously.

116. The method of any one of embodiments 78 to 109, wherein the additional agent is administered subcutaneously.

117. The method of any one of embodiments 78 to 109, wherein the additional agent is administered rectally.

118. A method of treating an inflammatory condition of the liver in a subject in need thereof, the method comprising:
topically administering a pharmaceutical formulation comprising a therapeutically effective amount of an immune modulator, or a biosimilar thereof, to an intended site in (a) the small intestine of the subject's GI tract; or (b) the large intestine of the subject's GI tract; wherein said intended site allows for improved pharmacodynamic effects in a target tissue originating from the endoderm as compared to the pharmacodynamic effects in the same target tissue when the pharmaceutical formulation is administered via traditional administration;
thereby treating at least one of the one or more inflammatory disease sites.

119. The method of embodiment 118, wherein the intended release site is selected from the group consisting of duodenum, jejunum, ileum, and cecum.

120. The method of any one of embodiments 118 or 119, wherein the inflammatory condition of the liver is NAFLD.

121. The method of any one of embodiments 118 or 119, wherein the inflammatory condition of the liver is NASH.

122. The method of embodiment 121, wherein the section or subsection of the GI tract is selected from the group consisting of ileum, cecum, colon, and rectum.

123. The method of any one of embodiments 118 to 122, wherein the pharmaceutical formulation is a solid formulation or a solution formulation.

124. The method of embodiment 123, wherein the pharmaceutical formulation is a solution formulation.

125. The method of any one of embodiments 118 to 124, wherein the pharmaceutical formulation is contained in a device selected from an endoscope, an ingestible device, or a reservoir.

126. The method of embodiment 125, wherein the endoscope comprises a catheter.

127. The method of embodiment 126, wherein the catheter is a spray catheter.

128. The method of any one of embodiments 125 to 127, wherein the endoscope is connected to the reservoir.

129. The method of embodiment 128, wherein the reservoir is an anchorable reservoir.

130. The method of any one of embodiments 118 to 122, wherein the pharmaceutical formulation is a suppository for rectal administration.

131. The method of any one of embodiments 118 to 122, wherein the pharmaceutical formulation is an enema for rectal administration.

132. The method of embodiment 131, wherein the enema for rectal administration is for sustained release or for delayed release.

133. The method of any one of embodiments 118 to 125, wherein the pharmaceutical formulation is contained in an ingestible device, said device comprising a self-localization mechanism configured to determine a device location within the subject's GI tract, and the method further comprises determining the device location within the subject's GI tract via the device self-localization mechanism.

134. The method of embodiment 133, wherein the topical administration comprises:
orally administering the ingestible device to the subject; and
releasing the pharmaceutical formulation from the device (a) to a section or subsection of the subject's small intestine; or (b) to a section or subsection of the subject's large intestine.

135. The method of embodiment 133 or 134, wherein determining the device location within the subject's GI tract via the device self-localization mechanism comprises detecting one or more device transitions between portions of the subject's GI tract; optionally, the one or more device transitions occurs between portions of the GI tract selected from the group consisting of: mouth and stomach; esophagus and stomach; stomach and duodenum; duodenum and jejunum; jejunum and ileum; ileum and cecum; and cecum and colon; and combinations of any two or more of the foregoing.

136. The method of embodiment 135, wherein the portions are adjacent portions; optionally, the adjacent portions are selected from the group consisting of: stomach and duodenum; duodenum and jejunum; jejunum and ileum;

ileum and cecum; and cecum and colon; and combinations of any two or more of the foregoing.

137. The method of any one of embodiments 133 to 136, wherein the device self-localization mechanism is based on data comprising light reflectance occurring external to the device and within the GI tract of the subject.

138. The method of any one of embodiments 133 to 137, wherein the device self-localization mechanism is based on data comprising elapsed time after entry of the device into the GI tract of the subject, elapsed time after detecting at least one of the one or more device transitions between the portions of the subject's GI tract, or a combination thereof.

139. The method of any one of embodiments 133 to 138, wherein the determining of the device location within the subject's GI tract via the device self-localization mechanism further comprises confirming the one or more device transition between the portions of the GI tract of the subject.

140. The method of any one of embodiments 133 to 139, wherein the device self-localizes to the stomach, duodenum, jejunum, ileum, cecum or colon with at least 80% accuracy; optionally, with at least 85% accuracy.

141. The method of any one of embodiments 133 to 140, wherein the self-localization of the device to a pre-selected location within the subject's GI tract autonomously triggers a release of the formulation from the device; optionally, the pre-selected location is selected from the group consisting of the stomach, the duodenum, the jejunum, the ileum, the cecum and the colon.

142. The method of embodiment 141, wherein the release of the formulation from the device occurs at substantially the same time as the device self-localizes to the pre-selected location.

143. The method of embodiment 141 or 142, wherein the release of the formulation from the device commences within a period of time of at most about 5 minutes after the device detects or confirms the transition to the pre-selected location; optionally, the period of time is at most about 1 minute, at most about 30 seconds, at most about 10 seconds, or at most about 1 second after the device detects or confirms the transition to the pre-selected location.

144. The method of any one of embodiments 141 to 143, wherein the release of the formulation is as a bolus.

145. The method of embodiment 141, wherein the release of the formulation from the device occurs over a pre-determined period of time; optionally, the pre-determined period of time is about 8 hours, about 7 hours, about 6 hours, about 5 hours, about 4 hours, about 3 hours, about 2 hours, about 1 hour, about 30 minutes, about 15 minutes, about 10 minutes, or about 5 minutes.

146. The method of embodiment 145, wherein the pre-determined period of time commences within at most about 5 minutes, at most about 1 minute, at most about 30 seconds, at most about 10 seconds, or at most about 1 second after the device detects or confirms the transition to the pre-selected location.

147. The method of any one of embodiments 141 to 146, wherein the release of the formulation from the device is to the small intestine.

148. The method of embodiment 147, wherein determining the device location as the duodenum autonomously triggers the release of the formulation to the duodenum, thereby treating an inflammatory disease or condition that arises in a tissue originating from the endoderm.

149. The method of embodiment 147, wherein determining the device location as the ileum autonomously triggers the release of the formulation to the ileum, thereby treating an inflammatory disease or condition that arises in a tissue originating from the endoderm; optionally, the device determines the location as the ileum with at least 80% accuracy; preferably, with at least 85% accuracy.

150. A device comprising:
    a pharmaceutical formulation comprising an immune modulator;
    one or more processing devices; and
    one more machine-readable hardware storage devices storing instructions that are executable by the one or more processing devices to (a) determine a location of the ingestible device in the GI tract of the subject; and (b) release the formulation from the device at a pre-selected location of the GI tract;
    wherein the device is a self-localizing ingestible device configured for use in treating an inflammatory disease or condition that arises in a tissue originating from the endoderm.

151. The device of embodiment 150, wherein the device self-localizes in the pre-selected location of the GI tract of the subject with an accuracy of at least 80%; optionally, the pre-selected location is selected from the group consisting of duodenum, jejunum, ileum, cecum, ascending colon, transverse colon, descending colon, and rectum.

152. The device of embodiment 150 or 151, further comprising a first light source and a second light source, wherein the first light source is configured to emit light at a first wavelength, and the second light source is configured to emit light at a second wavelength different from the first wavelength.

153. The device of embodiment 152, further comprising a first detector and a second detector, wherein the first detector is configured to detect light at the first wavelength, and the second detector is configured to detect light at the second wavelength.

154. The device of embodiment 153, wherein the each of the first and second wavelengths is selected from the group consisting of red light, green light and blue light.

155. The device of embodiment 153, wherein the each of the first and second wavelengths is selected from the group consisting of 600 nm to 750 nm; 495 nm to 600 nm; and 400 nm to 495 nm; optionally, the first and second wavelengths are separated by at least 50 nm.

156. The device of any one of embodiments 150 to 155, further comprising a mechanism configured to monitor elapsed time after entry of the device into the GI tract of the subject.

157. The device of any one of embodiments 150 to 156, wherein the device is configured to detect a transition between a first section or subsection and a second section or subsection of the GI tract.

158. The device of embodiment 157, wherein the first and second section of the GI tract is selected from the group consisting of the mouth and stomach; the esophagus and stomach; the stomach and duodenum; the duodenum and jejunum; the jejunum and ileum; the ileum and cecum; and the cecum and colon; and a combination of any two or more of the foregoing.

159. The device of any one of embodiments 156 to 158, wherein the mechanism is further configured to monitor elapsed time after detecting a device transition between a first section or subsection and a second section or subsection of the subject's GI tract.

160. The device of any one of embodiments 150 to 159, wherein at least one of the one or more storage device stores instructions to release the formulation from the device into the pre-selected location at substantially the same time as the device self-localizes to the pre-selected location.

161. The device of embodiment 160, wherein the device is configured so that the pre-selected location is the stomach, and the formulation is released at substantially the same time as the device self-localizes to the stomach.

162. The device of embodiment 160, wherein the device is configured so that the pre-selected location is the duodenum, and the formulation is released at substantially the same time as the device self-localizes to the duodenum.

163. The device of embodiment 160, wherein the device is configured so that the pre-selected location is the jejunum, and the formulation is released at substantially the same time as the device self-localizes to the jejunum.

164. The device of embodiment 160, wherein the device is configured so that the pre-selected location is the ileum, and the formulation is released at substantially the same time as the device self-localizes to the ileum.

165. The device of embodiment 160, wherein the device is configured so that pre-selected location is the cecum, and the formulation is released at substantially the same time as the device self-localizes to the cecum.

166. The device of embodiment 160, wherein the device is configured so that the pre-selected location is the colon, and the formulation is released at substantially the same time as the device self-localizes to the colon.

167. The device of any one of embodiments 160 to 166, further comprising:
   a housing;
   a force generator located within the housing; and
   a storage reservoir located within the housing, wherein the storage reservoir stores the pharmaceutical formulation;
   wherein the ingestible device is configured such that the force generator generates a force, thereby initiating the release of the formulation from the ingestible device into the pre-selected location of the GI tract.

168. The device of embodiment 167, wherein the force generator is a gas generating cell that generates a gas.

169. The device of any one of 160 to 168, wherein the device is not configured to measure the pH of the subject's GI tract.

170. The device of any one of embodiments 160 to 169, wherein determining the location of the ingestible device in the GI tract of the subject is not based on pressure in the GI tract of the subject.

171. The device of any one of embodiments 160 to 170, wherein releasing the formulation from the device is not based on pH of the GI tract of the subject.

172. The device of any one of embodiments 160 to 171, wherein the pharmaceutical formulation consists of, or consists essentially of, the immune modulator.

173. The device of any one of embodiments 160 to 171, wherein the pharmaceutical formulation comprises a therapeutically effective amount of the immune modulator.

174. The device of any one of embodiments 160 to 173, wherein the immune modulator is an antibody or a monoclonal antibody; optionally, the inhibitor is selected from the group consisting of ustekinumab or a biosimilar thereof; adalimumab or a biosimilar thereof; vedolizumab or a biosimilar thereof; foralumab or a biosimilar thereof; and teplizumab or a biosimilar thereof.

175. The device of embodiment 174, wherein the pharmaceutical formulation further comprises one or more pharmaceutically acceptable excipients.

176. The device of embodiment 174 or 175, wherein the antibody or monoclonal antibody is present in the formulation at a concentration of greater than 100 mg/mL.

177. The device of embodiment 176, wherein the antibody or monoclonal antibody is present in the formulation at a concentration of at least about 125 mg/mL.

178. The device of embodiment 176, wherein the antibody or monoclonal antibody is present in the formulation at a concentration of at least about 150 mg/mL.

179. The device of embodiment 176, wherein the antibody or monoclonal antibody is present in the formulation at a concentration of at least about 175 mg/mL.

180. The device of any one of embodiments 176 to 179, wherein the formulation comprises a polyol, a non-ionic surfactant, or both.

181. The device of embodiment 180, wherein the polyol is selected from the group consisting of mannitol, sorbitol, sucrose, trehalose, raffinose and maltose, and a combination of any two or more of the foregoing.

182. The device of embodiment 180 or 181, wherein the non-ionic surfactant is a polysorbate or a poloxamer; optionally, the polysorbate is polysorbate 20, 40, 60 or 80, or more particularly, polysorbate 80.

183. The device of any one of embodiments 176 to 182, wherein the formulation comprises an amino acid; optionally, the amino is a free amino acid selected from the group consisting of histidine, alanine, arginine, glycine, glutamic acid and methionine, and a combination of any two or more of the foregoing; preferably, the free amino acid is histidine, arginine, or a combination thereof.

184. The device of embodiment 183, wherein the amino acid is a free amino acid or a salt thereof; preferably, the amino acid or salt thereof is histidine or a salt thereof, arginine or a salt thereof, or a combination thereof.

185. The device of any one of embodiments 176 to 184, wherein the formulation comprises a buffer, a salt, or both; optionally, the salt is sodium chloride; optionally, the buffer is an aqueous buffer; optionally, the aqueous buffer is a citrate buffer or a phosphate buffer.

186. The device of any one of embodiments 180 to 182, wherein the formulation consists of or consists essentially of the antibody or monoclonal antibody, the polyol, the surfactant, and water.

187. The device of any one of embodiments 176 to 184, wherein the formulation comprises an acetate salt; optionally, the formulation comprises negligible or non-detectable levels of salt and/or buffer.

188. The device of any one of embodiments 176 to 182, wherein the formulation consists essentially of or consists of (i) the antibody or monoclonal antibody; (ii) a polyol, sugar or sugar alcohol; (iii) a non-ionic surfactant; (iv) a salt, such as sodium chloride; and (v) an aqueous buffer system; optionally, the polyol, sugar or sugar alcohol is mannitol or sucrose; the non-ionic surfactant is a polysorbate such as polysorbate 80; the salt is sodium chloride; and the aqueous buffer system consists essentially of or consists of water and a phosphate buffer, a citrate buffer, or both.

189. The device of any one of embodiments 176 to 182, wherein the formulation comprises negligible or non-detectable levels of salt and/or buffer.

190. The device of any one of embodiments 176 to 187, wherein the formulation further comprises a chelating agent; optionally, the chelating agent is succinic acid or EDTA.

191. The device of any one of embodiments 176 to 190, wherein the formulation is provided as a solution, wherein the antibody or monoclonal antibody is present in the solution formulation at a concentration of at least about 125 mg/mL, at least about 150 mg/mL or at least about 175 mg/mL.

192. The device of any one of embodiments 176 to 190, wherein the formulation is lyophilized to provide a powder; wherein the formulation comprises water prior to lyophilization.

193. The device of embodiment 174, wherein the pharmaceutical formulation is provided as a solid comprising the antibody or monoclonal antibody; optionally, the formulation further comprises one or more pharmaceutically acceptable excipients.

194. The device of embodiment 193, wherein the solid is a lyophilized powder.

195. The device of embodiment 193, wherein the antibody or monoclonal antibody is provided as a crystalline solid.

196. The device of any one of embodiments 193 to 195, wherein the antibody or monoclonal antibody is present in the pharmaceutical formulation at a concentration of at least about 75% (w/w), about 80% (w/w), about 85% (w/w), or at least about 90% (w/w); optionally, at least about 95%, about 96%, about 97%, about 98% or about 99% (w/w).

197. The device of any one of embodiments 193 to 195, wherein the formulation consists essentially of or consists of the antibody or monoclonal antibody.

198. The device of any one of embodiments 150 to 197, wherein the immune modulator is a small molecule or peptide, and the formulation optionally further comprises one or more pharmaceutically acceptable excipients.

199. The device of any one of embodiments 150 to 173, 198 or 199, wherein the pharmaceutical formulation is provided as a solid, and the immune modulator is present in the pharmaceutical formulation at a concentration of at least about 75% (w/w), about 80% (w/w), about 85% (w/w), at least about 90% (w/w), at least about 95%, at least about 96%, at least about 97%, at least about 98% or at least about 99% (w/w); optionally, the pharmaceutical formulation consists essentially of or consists of the immune modulator.

200. The device of embodiments 199, wherein the pharmaceutical formulation is provided as a solution, a dispersion or a suspension; preferably, the pharmaceutical formulation comprises the immune modulator at a concentration of at least about 5 mg/mL or 5 mg/g, at least about 10 mg/mL or 10 mg/g, or at least about 15 mg/mL or 15 mg/g.

201. The device of any one of embodiments 150 to 200, wherein the device does not contain an environmental pH sensor, an environmental temperature sensor, or an environmental pressure sensor.

202. The device of any one of embodiments 150 to 201 for use in a method of any one of embodiments 1 to 149.

SEQUENCE LISTING (215 sequences)

SEQ ID NO: 1 - DNA, 1450 bp, Homo sapiens
tttcgctttcattttgggccgagctggaggcggcggggccgtcccggaacggctgcggccgggcaccccgggagttaatccgaaagcgccgcaagccccgcgggccggccgcaccgcacgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggagggggaaagaaggatgggactattacatccacatgatacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttattaaattatttatcaagtgtatttgaaaaatatttttaagtgttctaaaaataaaagtattgaattaaagtgaaaaaaaa

SEQ ID NO: 2 - DNA, 2347 bp, Homo sapiens
ctgtttcagggccattggactctccgtcctgcccagagcaagatgtgtcaccagcagttggtcatctcttggttttccctggtttttctggcatctcccctcgtggccatatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagttaggttctgatccaggatgaaaatttggaggaaaagtggaagatattaagcaaaatgtttaaagacacaacggaatagacccaaaaagataatttctatctgatttgctttaaaacgtttttttaggatcacaatgatatctttgctgtatttgtatagttagatgctaaatgctcattgaaacaatcagctaatttatgtatagattttccagctctcaagttgccatgggccttcatgctatttaaatatttaagtaatttatgtatttattagtatattactgttatttaacgtttgtctgccaggatgtatggaatgtttcatactcttatgacctgatccatcaggatcagtccctattatgcaaaatgtgaatttaattttatttgtactgacaacttttcaagcaaggctgcaagtacatcagttttatgacaatcaggaagaatgcagtgttctgataccagtgccatcatacacttgtgatggatgggaacgcaagagatacttacatggaaacctgacaatgcaaacctgttgagaagatccaggagaacaagatgctagttcccatgtctgtgaagacttcctggagatggtgttgataaagcaatttagggccacttacacttctaagcaagtttaatctttggatgcctgaattttaaaagggctagaaaaaaatgattgaccagcctgggaaacataacaagaccccgtctctacaaaaaaaatttaaaattagccaggcgtggtggctcatgcttgtggtcccagctgttcaggaggatgaggcaggaggatctcttgagcccaggaggtcaaggctatggtgagccgtgattgtgccactgcataccagcctaggtgacagaatgagaccctgtctcaaaaaaaaaaatgattgaaattaaaattcagctttagcttccatggcagtcctcacccccacctctctaaaagacacaggaggatgacacagaaacaccgtaagtgtctggaaggcaaaaagatcttaagattcaagagagaggacaagtagttatggctaaggacatgaaattgtcagaatggcaggtggcttcttaacagccctgtgagaagcagacagatgcaaagaaaatctggaatccctttctcattagcatgaatgaacctgatacacaattatgaccagaaaatatggctccatgaaggtgctacttttaagtaatgtatgtgcgctctgtaaagtgattacatttgtttcctgtttgtttatttatttatttatttttgcattctgaggctgaactaataaaaactcttctttgtaatc

SEQ ID NO: 3 - DNA, 1049 bp, Homo sapiens
aaaacaacaggaagcagcttacaaactcggtgaacaactgagggaaccaaaccagagacgcgctgaacagagagaatcaggctcaaagcaagtggaagtgggcagagattccaccaggactggtgcaaggcgcagagccagccagatttgagaagaaggcaaaaagatgctggggagcagagctgtaatgctgctgttgctgctgccctggacagctcagggcagagctgtgcctgggggcagcagccctgcctggactcagtgccagcagctttcacagaagctctgcacactggcctggagtgcacatccactagtgggacacatggatctaagagaagagggagatgaagagactacaaatgatgttccccatatccagtgtggagatggctgtgacccccaaggactcagggacaacagtcagttctgcttgcaaaggatccaccagggtctgattttttatgagaagctgctaggatcggatattttcacaggggagccttctctgctccctgatagccctgtgggccagcttcatgcctccctactgggcctcagccaactcctgcagcctgagggtcaccactgggagactcagcagattccaagcctcagtcccagccagccatggcagcgtctccttctccgcttcaaaatccttcgcagcctccaggcctttgtggctgtagccgcccgggtctttgcccatggagcagcaaccctgagtccctaaaggcagcagctcaaggatggcactcagatctccatggcccagcaaggccaagataaatctaccaccccaggcacctgtgagccaacaggttaattagtccattaattttagtgggacctgcatatgttgaaaattaccaatactgactgacatgtgatgctgacctatgataaggttgagtatttattagatgggaagggaaatttggggattatttatcctcctggggacagtttggggaggattatttattgtatttatattgaattatgtacttttttcaataaagtcttatttttgtggctaaaaaaaa

SEQ ID NO: 4 - DNA, 2800 bp, Homo sapiens
ctctttcactttgacttgccttagggatgggctgtgacactttactttttttcttttttcttttttttcagtcttttctccttgctcagcttcaatgtgttccggagtggggacggggtggctgaacctcgcaggtggcagagaggctcccctggggctgtggggctctacgtggatccgatggagccgctggtgacctgggtggtccccctcctcttcctcttcctgctgtccaggcagggcgctgcctgcagaaccagtgagtgctgttttcaggacccgccatatccggatgcagactcaggctcggcctcgggccctagggacctgagatgctatcggatatccagtgatcgttacgagtgctcctggcagtatgagggtcccacagctggggtcagccacttcctgcggtgttgccttagctccgggcgctgctgctacttcgccgccggctcagccaccaggctgcagttctccgaccaggctggggtgtctgtgctgtacactgtcacactctgggtggaatcctgggccaggaaccagacagagaagtctcctgaggtgaccctgcagctctacaactcagttaaatatgagcctcctctgggagacatcaaggtgtccaagttggccgggcagctgcgtatggagtgggagaccccggataaccaggttggtgctgaggtgcagttccggcaccggacacccagcagcccatggaagttgggcgactgcggacctcaggatgatgatactgagtcctgcctctgccccctggagatgaatgtggcccaggaattccagctccgacgacggcagctggggagccaaggaagttcctggagcaagtggagcagccccgtgtgcgttccccctgaaaaccccccacagcctcaggtgagattctcggtggagcagctgggccaggatgggaggaggcggctgaccctgaaagagcagccaacccagctggagcttccagaaggctgtcaagggctggcgcctggcacggaggtcacttaccgactacagctccacatgctgtcctgcccgtgtaaggccaaggccaccaggaccctgcacctggggaagatgccctatctctcgggtgctgcctacaacgtggctgtcatctcctcgaaccaatttggtcctggcctgaaccagacgtggcacattcctgccgacacccacacagaaccagtggctctgaatatcagcgtcggaaccaacgggaccaccatgtattggccagcccgggctcagagcatgacgtattgcattgaatggcagcctgtgggccaggacgggggccttgccacctgcagcctgactgcgccgcaagacccggatccggctggaatggcaacctacagctggagtcgagagtctggggcaatggggcaggaaaagtgttactacattaccatctttgcctctgcgcaccccgagaagctcaccttgtggtctacggtcctgtccacctaccactttgggggcaatgcctcagcagctgggacaccgcaccacgtctcggtgaagaatcatagcttggactctgtgtctgtggactgggcaccatccctgctgagcacctgtcccggcgtcctaaaggagtatgttgtccgctgccgagatgaagacagcaaacaggtgtcagagcatcccgtgcagcccacagagacccaagttaccctcagtggcctgcgggctggtgtagcctacacggtgcaggtgcgagcagacacagcgtggctgaggggtgtctggagccagccccagcgcttcagcatcgaagtgcaggtttctgattggctcatcttcttcgcctccctggggagcttcctgagcatccttctcgtgggcgtccttggctaccttggcctgaacagggccgcacggcacctgtgcccgccgctgcccacaccctgtgccagctccgccattgagttccctggagggaaggagacttggcagtggatcaacccagtggacttccaggaagaggcatccctgcaggaggccctggtggtagagatgtcctgggacaaaggcgagaggactgagcctctcgagaagacagagctacctgagggtgcccctgagctggccctggatacagagttgtccttggaggatggagacaggtgcaaggccaagatgtgatcgttgaggctcagagagggtgagtgactcgcccgaggctacgtagcacacacaggagtcacatttggacccaaataacccagagctcctccaggctccagtgcacctgcctcctctctgccccgtgcctgttgccacccatcctgcgggggaaccctagatgctgccatgaaatggaagctgctgcaccctgctgggcctggcatccgtggggcaggagcagaccctgccatttacctgttctggcgtagaatggactgggaatgggggcaaggggggctcagatggatccctggaccctgggctgggcatccacccccaggagcactggatggggagtctggactcaagggctccctgcagcattgcggggtcttgtagcttggaggatccaggcatatagggaagggggctgtaaactttgtgggaaaaatgacggtcctcccatcccaccccccaccccaccctcacccccctataaaatgggggtggtgataatgaccttacacagctgttcaaaatcatcgtaaatgagcctcctcttgggtatttttttcctgtttgaagcttgaatgtcctgctcaaaatctcaaaacacgagccttggaattcaaaaaaaaaaaaaaaaaaa

SEQ ID NO: 5 - DNA, 1997 bp, Homo sapiens
ctctttcactttgacttgccttagggatgggctgtgacactttactttttttcttttttcttttttttcagtcttttctccttgctcagcttcaatgtgttccggagtggggacggggtggctgaacctcgcaggtggcagagaggctcccctggggctgtggggctctacgtggatccgatggagccgctggtgacctgggtggtccccctcctcttcctcttcctgctgtccaggcagggcgctgcctgcagaaccagtgagtgctgttttcaggacccgccatatccggatgcagactcaggctcggcctcgggccctagggacctgagatgctatcggatatccagtgatcgttacgagtgctcctggcagtatgagggtcccacagctggggtcagccacttcctgcggtgttgccttagctccgggcgctgctgctacttcgccgccggctcagccaccaggctgcagttctccgaccaggctggggtgtctgtgctgtacactgtcacactctgggtggaatcctgggccaggaaccagacagagaagtctcctgaggtgaccctgcagctctacaactcagttaaatatgagcctcctctgggagacatcaaggtgtccaagttggccgggcagctgcgtatggagtgggagaccccggataaccaggttggtgctgaggtgcagttccggcaccggacacccagcagcccatggaagttgggcgactgcggacctcaggatgatgatactgagtcctgcctctgccccctggagatgaatgtggcccaggaattccagctccgacgacggcagctggggagccaaggaagttcctggagcaagtggagcagccccgtgtgcgttccccctgaaaaccccccacagcctcaggtgagattctcggtggagcagctgggccaggatgggaggaggcggctgaccctgaaagagcagccaacccagctggagcttccagaaggctgtcaagggctggcgcctggcacggaggtcacttaccgactacagctccacatgctgtcctgcccgtgtaaggccaaggccaccaggaccctgcacctggggaagatgccctatctctcgggtgctgcctacaacgtggctgtcatctcctcgaaccaatttggtcctggcctgaaccagacgtggcacattcctgccgacacccacacagatggcatgatctcagctcactgcaacctccgccttccagattcaagagattctcctgcttcagcctcccgagtagctgggattacaggcatctgccaccatacccggctaattttgtatttttagtagagacggggtttcaccacgttggccaggctggtctcgaactcctgacctcaagtgatccacctgccttggcctcccaaagtgttgggattataggcgtgagccaccatgcccagcctaatttttgtatttttagtagagatggagtttcaccatgttgcccaggctggtctcaaactcctgccctcaggtgatccacccacctcagcctctcaaagtgctgggattacaggtgtgagccactgtggccgacctactatttttattatttttgagctaggttctcagtctgttggcagactggagtgcaatcatggctcactgcagccttgaactcccagactcaagtgatccttccacctcagcctctggagtagctgggactacagacatgcaccaccacacctggttaattttttatttttattttttgtagagacaggtgtctctctacgttgcccaggctggtctcgaactcctgggctcaagtgatccacccatctccacctcccaaagtgctaggattacaggcgtgagccaccgtacccagcctggtcccatatcatagtgaaatggtgcctgtaaagctctcagcattggcttggcacatgcagttggtactcaataaacggctgttgctatccccaaaaaaaaaaaaaaaaaaaaaaaaa

SEQ ID NO: 6 - DNA, 2787 bp, Homo sapiens
ctctttcactttgacttgccttagggatgggctgtgacactttactttttttcttttttcttttttttcagtcttttctccttgctcagcttcaatgtgttccggagtggggacggggtggctgaacctcgcaggtggcagagaggctcccctggggctgtggggctctacgtggatccgatggagccgctggtgacctgggtggtccccctcctcttcctcttcctgctgtccaggcagggcgctgcctgcagaaccagtgagtgctgttttcaggacccgccatatccggatgcagactcaggctcggcctcgggccctagggacctgagatgctatcggatatccagtgatcgttacgagtgctcctggcagtatgagggtcccacagctggggtcagccacttcctgcggtgttgccttagctccgggcgctgctgctacttcgccgccggctcagccaccaggctgcagttctccgaccaggctggggtgtctgtgctgtacactgtcacactctgggtggaatcctgggccaggaaccagacagagaagtctcctgaggtgaccctgcagctctacaactcagttaaatatgagcctcctctgggagacatcaaggtgtccaagttggccgggcagctgcgtatggagtgggagaccccggataaccaggttggtgctgaggtgcagttccggcaccggacacccagcagcccatggaagttgggcgactgcggacctcaggatgatgatactgagtcctgcctctgccccctggagatgaatgtggcccaggaattccagctccgacgacggcagctggggagccaaggaagttcctggagcaagtggagcagccccgtgtgcgttccccctgaaaaccccccacagcctcaggtgagattctcggtggagcagctgggccaggatgggaggaggcggctgaccctgaaagagcagccaacccagctggagcttccagaaggctgtcaagggctggcgcctggcacggaggtcacttaccgactacagctccacatgctgtcctgcccgtgtaaggccaaggccaccaggaccctgcacctggggaagatgccctatctctcgggtgctgcctacaacgtggctgtcatctcctcgaaccaatttggtcctggcctgaaccagacgtggcacattcctgccgacacccacacagaaccagtggctctgaatatcagcgtcggaaccaacgggaccaccatgtattggccagcccgggctcagagcatgacgtattgcattgaatggcagcctgtgggccaggacgggggccttgccacctgcagcctgactgcgccgcaagacccggatccggctggaatggcaacctacagctggagtcgagagtctggggcaatggggcaggaaaagtgttactacattaccatctttgcctctgcgcaccccgagaagctcaccttgtggtctacggtcctgtccacctaccactttgggggcaatgcctcagcagctgggacaccgcaccacgtctcggtgaagaatcatagcttggactctgtgtctgtggactgggcaccatccctgctgagcacctgtcccggcgtcctaaaggagtatgttgtccgctgccgagatgaagacagcaaacaggtgtcagagcatcccgtgcagcccacagagacccaagttaccctcagtggcctgcgggctggtgtagcctacacggtgcaggtgcgagcagacacagcgtggctgaggggtgtctggagccagccccagcgcttcagcatcgaagtgcaggtttctgattggctcatcttcttcgcctccctggggagcttcctgagcatccttctcgtgggcgtccttggctaccttggcctgaacagggccgcacggcacctgtgcccgccgctgcccacaccctgtgccagctccgccattgagttccctggagggaaggagacttggcagtggatcaacccagtggacttccaggaagaggcatccctgcaggaggccctggtggtagagatgtcctgggacaaaggcgagaggactgagcctctcgagaagacagagctacctgagggtgcccctgagctggccctggatacagagttgtccttggaggatggagacagatgtgatcgttgaggctcagagagggtgagtgactcgcccgaggctacgtagcacacacaggagtcacatttggacccaaataacccagagctcctccaggctccagtgcacctgcctcctctctgccccgtgcctgttgccacccatcctgcgggggaaccctagatgctgccatgaaatggaagctgctgcaccctgctgggcctggcatccgtggggcaggagcagaccctgccatttacctgttctggcgtagaatggactgggaatgggggcaaggggggctcagatggatccctggaccctgggctgggcatccacccccaggagcactggatggggagtctggactcaagggctccctgcagcattgcggggtcttgtagcttggaggatccaggcatatagggaagggggctgtaaactttgtgggaaaaatgacggtcctcccatcccaccccccaccccaccctcacccccctataaaatgggggtggtgataatgaccttacacagctgttcaaaatcatcgtaaatgagcctcctcttgggtatttttttcctgtttgaagcttgaatgtcctgctcaaaatctcaaaacacgagccttggaattcaaaaaaaaaaaaaaaaaaa

SEQ ID NO: 7 - DNA, 2791 bp, Homo sapiens
agaacactccgctgcctctccagagccaggcacacagcaggcgctccataaatgttcgttggtcttttctccttgctcagcttcaatgtgttccggagtggggacggggtggctgaacctcgcaggtggcagagaggctcccctggggctgtggggctctacgtggatccgatggagccgctggtgacctgggtggtccccctcctcttcctcttcctgctgtccaggcagggcgctgcctgcagaaccagtgagtgctgttttcaggacccgccatatccggatgcagactcaggctcggcctcgggccctagggacctgagatgctatcggatatccagtgatcgttacgagtgctcctggcagtatgagggtcccacagctggggtcagccacttcctgcggtgttgccttagctccgggcgctgctgctacttcgccgccggctcagccaccaggctgcagttctccgaccaggctggggtgtctgtgctgtacactgtcacactctgggtggaatcctgggccaggaaccagacagagaagtctcctgaggtgaccctgcagctctacaactcagttaaatatgagcctcctctgggagacatcaaggtgtccaagttggccgggcagctgcgtatggagtgggagaccccggataaccaggttggtgctgaggtgcagttccggcaccggacacccagcagcccatggaagttgggcgactgcggacctcaggatgatgatactgagtcctgcctctgccccctggagatgaatgtggcccaggaattccagctccgacgacggcagctggggagccaaggaagttcctggagcaagtggagcagccccgtgtgcgttccccctgaaaaccccccacagcctcaggtgagattctcggtggagcagctgggccaggatgggaggaggcggctgaccctgaaagagcagccaacccagctggagcttccagaaggctgtcaagggctggcgcctggcacggaggtcacttaccgactacagctccacatgctgtcctgcccgtgtaaggccaaggccaccaggaccctgcacctggggaagatgccctatctctcgggtgctgcctacaacgtggctgtcatctcctcgaaccaatttggtcctggcctgaaccagacgtggcacattcctgccgacacccacacagaaccagtggctctgaatatcagcgtcggaaccaacgggaccaccatgtattggccagcccgggctcagagcatgacgtattgcattgaatggcagcctgtgggccaggacgggggccttgccacctgcagcctgactgcgccgcaagacccggatccggctggaatggcaacctacagctggagtcgagagtctggggcaatggggcaggaaaagtgttactacattaccatctttgcctctgcgcaccccgagaagctcaccttgtggtctacggtcctgtccacctaccactttgggggcaatgcctcagcagctgggacaccgcaccacgtctcggtgaagaatcatagcttggactctgtgtctgtggactgggcaccatccctgctgagcacctgtcccggcgtcctaaaggagtatgttgtccgctgccgagatgaagacagcaaacaggtgtcagagcatcccgtgcagcccacagagacccaagttaccctcagtggcctgcgggctggtgtagcctacacggtgcaggtgcgagcagacacagcgtggctgaggggtgtctggagccagccccagcgcttcagcatcgaagtgcaggtttctgattggctcatcttcttcgcctccctggggagcttcctgagcatccttctcgtgggcgtccttggctaccttggcctgaacagggccgcacggcacctgtgcccgccgctgcccacaccctgtgccagctccgccattgagttccctggagggaaggagacttggcagtggatcaacccagtggacttccaggaagaggcatccctgcaggaggccctggtggtagagatgtcctgggacaaaggcgagaggactgagcctctcgagaagacagagctacctgagggtgcccctgagctggccctggatacagagttgtccttggaggatggagacaggtgcaaggccaagatgtgatcgttgaggctcagagagggtgagtgactcgcccgaggctacgtagcacacacaggagtcacatttggacccaaataacccagagctcctccaggctccagtgcacctgcctcctctctgccccgtgcctgttgccacccatcctgcgggggaaccctagatgctgccatgaaatggaagctgctgcaccctgctgggcctggcatccgtggggcaggagcagaccctgccatttacctgttctggcgtagaatggactgggaatgggggcaaggggggctcagatggatccctggaccctgggctgggcatccacccccaggagcactggatggggagtctggactcaagggctccctgcagcattgcggggtcttgtagcttggaggatccaggcatatagggaagggggctgtaaactttgtgggaaaaatgacggtcctcccatcccaccccccaccccaccctcacccccctataaaatgggggtggtgataatgaccttacacagctgttcaaaatcatcgtaaatgagcctcctcttgggtatttttttcctgtttgaagcttgaatgtcctgctcaaaatctcaaaacacgagccttggaattcaaaaaaaaaaaaaaaaaaa

SEQ ID NO: 8 - DNA, 4040 bp, Homo sapiens
tgcagagcacagagaaaggacatctgcgaggaaagttccctgatggctgtcaacaaagtgccacgtctctatggctgtgaacgctgagcacacgattttatcgcgcctatcatatcttggtgcataaacgcacctcacctcggtcaacccttgctccgtcttatgagacaggctttattatccgcattttatatgaggggaaactgacggtggagagagaattatcttgctcaaggcgacacagcagagcccacaggtggcagaatcccacccgagcccgcttcgacccgcggggtggaaaccacgggcgcccgcccggctgcgcttccagagctgaactgagaagcgagtcctctccgccctgcggccaccgcccagccccgacccccgccccggcccgatcctcactcgccgccagctccccgcgcccaccccggagttggtggcgcagaggcgggaggcggaggcgggagggcgggcgctggcaccgggaacgcccgagcgccggcagagagcgcggagagcgcgacacgtgcggcccagagcaccggggccacccggtccccgcaggcccgggaccgcgcccgctggcaggcgacacgtggaagaatacggagttctataccagagttgattgttgatggcacatacttttagaggatgctcattggcatttatgtttataatcacgtggctgttgattaaagcaaaaatagatgcgtgcaagagaggcgatgtgactgtgaagccttcccatgtaattttacttggatccactgtcaatattacatgctctttgaagcccagacaaggctgctttcactattccagacgtaacaagttaatcctgtacaagtttgacagaagaatcaattttcaccatggccactccctcaattctcaagtcacaggtcttccccttggtacaaccttgtttgtctgcaaactggcctgtatcaatagtgatgaaattcaaatatgtggagcagagatcttcgttggtgttgctccagaacagcctcaaaatttatcctgcatacagaagggagaacaggggactgtggcctgcacctgggaaagaggacgagacacccacttatacactgagtatactctacagctaagtggaccaaaaaatttaacctggcagaagcaatgtaaagacatttattgtgactatttggactttggaatcaacctcacccctgaatcacctgaatccaatttcacagccaaggttactgctgtcaatagtcttggaagctcctcttcacttccatccacattcacattcttggacatagtgaggcctcttcctccgtgggacattagaatcaaatttcaaaaggcttctgtgagcagatgtaccctttattggagagatgagggactggtactgcttaatcgactcagatatcggcccagtaacagcaggctctggaatatggttaatgttacaaaggccaaaggaagacatgatttgctggatctgaaaccatttacagaatatgaatttcagatttcctctaagctacatctttataagggaagttggagtgattggagtgaatcattgagagcacaaacaccagaagaagagcctactgggatgttagatgtctggtacatgaaacggcacattgactacagtagacaacagatttctcttttctggaagaatctgagtgtctcagaggcaagaggaaaaattctccactatcaggtgaccttgcaggagctgacaggagggaaagccatgacacagaacatcacaggacacacctcctggaccacagtcattcctagaaccggaaattgggctgtggctgtgtctgcagcaaattcaaaaggcagttctctgcccactcgtattaacataatgaacctgtgtgaggcagggttgctggctcctcgccaggtctctgcaaactcagagggcatggacaacattctggtgacttggcagcctcccaggaaagatccctctgctgttcaggagtacgtggtggaatggagagagctccatccagggggtgacacacaggtccctctaaactggctacggagtcgaccctacaatgtgtctgctctgatttcagagaacataaaatcctacatctgttatgaaatccgtgtgtatgcactctcaggggatcaaggaggatgcagctccatcctgggtaactctaagcacaaagcaccactgagtggcccccacattaatgccatcacagaggaaaaggggagcattttaatttcatggaacagcattccagtccaggagcaaatgggctgcctcctccattataggatatactggaaggaacgggactccaactcccagcctcagctctgtgaaattccctacagagtctcccaaaattcacatccaataaacagcctgcagccccgagtgacatatgtcctgtggatgacagctctgacagctgctggtgaaagttcccacggaaatgagagggaattttgtctgcaaggtaaagccaattggatggcgtttgtggcaccaagcatttgcattgctatcatcatggtgggcattttctcaacgcattacttccagcaaaaggtgtttgttctcctagcagccctcagacctcagtggtgtagcagagaaattccagatccagcaaatagcacttgcgctaagaaatatcccattgcagaggagaagacacagctgcccttggacaggctcctgatagactggcccacgcctgaagatcctgaaccgctggtcatcagtgaagtccttcatcaagtgaccccagttttcagacatcccccctgctccaactggccacaaagggaaaaaggaatccaaggtcatcaggcctctgagaaagacatgatgcacagtgcctcaagcccaccacctccaagagctctccaagctgagagcagacaactggtggatctgtacaaggtgctggagagcaggggctccgacccaaagcccgaaaacccagcctgtccctggacggtgctcccagcaggtgaccttcccacccatgatggctacttaccctccaacatagatgacctcccctcacatgaggcacctctcgctgactctctggaagaactggagcctcagcacatctccctttctgttttcccctcaagttctcttcacccactcaccttctcctgtggtgataagctgactctggatcagttaaagatgaggtgtgactccctcatgctctgagtggtgaggcttcaagccttaaagtcagtgtgccctcaaccagcacagcctgccccaattcccccagcccctgctccagcagctgtcatctctgggtgccaccatcggtctggctgcagctagaggacaggcaagccagctctgggggagtcttaggaactgggagttggtcttcactcagatgcctcatcttgcctttcccagggccttaaaattacatccttcactgtgtggacctagagactccaacttgaattcctagtaactttcttggtatgctggccagaaagggaaatgaggaggagagtagaaaccacagctcttagtagtaatggcatacagtctagaggaccattcatgcaatgactatttctaaagcacctgctacacagcaggctgtacacagcagatcagtactgttcaacagaacttcctgagatgatggaaatgttctacctctgcactcactgtccagtacattagacactaggcacattggctgttaatcacttggaatgtgtttagcttgactgaggaattaaattttgattgtaaatttaaatcgccacacatggctagtggctactgtattggagtgcacagctctagatggctcctagattattgagagccttcaaaacaaatcaacctagttctatagatgaagacataaaagacactggtaaacaccaaggtaaaagggcccccaaggtggtcatgactggtctcatttgcagaagtctaagaatgtacctttttctggccgggcgtggtagctcatgcctgtaatcccagcactttgggaggctga

SEQ ID NO: 9 - DNA, 4028 bp, Homo sapiens
tgcagagcacagagaaaggacatctgcgaggaaagttccctgatggctgtcaacaaagtgccacgtctctatggctgtgaacgctgagcacacgattttatcgcgcctatcatatcttggtgcataaacgcacctcacctcggtcaacccttgctccgtcttatgagacaggctttattatccgcattttatatgaggggaaactgacggtggagagagaattatcttgctcaaggcgacacagcagagcccacaggtggcagaatcccacccgagcccgcttcgacccgcggggtggaaaccacgggcgcccgcccggctgcgcttccagagctgaactgagaagcgagtcctctccgccctgcggccaccgcccagccccgacccccgccccggcccgatcctcactcgccgccagctccccgcgcccaccccggagttggtggcgcagaggcgggaggcggaggcgggagggcgggcgctggcaccgggaacgcccgagcgccggcagagagcgcggagagcgcgacacgtgcggcccagagcaccggggccacccggtccccgcaggcccgggaccgcgcccgctggcaggcgacacgtggtcacggtgatccatttgtaaagtcgggaataaatgacctctgaagtgttgtctgtatattgatctgctaccagtaaaacatatctctgaagaatacggagttctataccagagttgattgttgatggcacatacttttagaggatgctcattggcatttatgtttataatcacgtggctgttgattaaagcaaaaatagatgcgtgcaagagaggcgatgtgactgtgaagccttcccatgtaattttacttggatccactgtcaatattacatgctctttgaagcccagacaaggctgctttcactattccagacgtaacaagttaatcctgtacaagtttgacagaagaatcaattttcaccatggccactccctcaattctcaagtcacaggtcttccccttggtacaaccttgtttgtctgcaaactggcctgtatcaatagtgatgaaattcaaatatgtggagcagagatcttcgttggtgttgctccagaacagcctcaaaatttatcctgcatacagaagggagaacaggggactgtggcctgcacctgggaaagaggacgagacacccacttatacactgagtatactctacagctaagtggaccaaaaaatttaacctggcagaagcaatgtaaagacatttattgtgactatttggactttggaatcaacctcacccctgaatcacctgaatccaatttcacagccaaggttactgctgtcaatagtcttggaagctcctcttcacttccatccacattcacattcttggacatagtgaggcctcttcctccgtgggacattagaatcaaatttcaaaaggcttctgtgagcagatgtaccctttattggagagatgagggactggtactgcttaatcgactcagatatcggcccagtaacagcaggctctggaatatggttaatgttacaaaggccaaaggaagacatgatttgctggatctgaaaccatttacagaatatgaatttcagatttcctctaagctacatctttataagggaagttggagtgattggagtgaatcattgagagcacaaacaccagaagaagagcctactgggatgttagatgtctggtacatgaaacggcacattgactacagtagacaacagatttctcttttctggaagaatctgagtgtctcagaggcaagaggaaaaattctccactatcaggtgaccttgcaggagctgacaggagggaaagccatgacacagaacatcacaggacacacctcctggaccacagtcattcctagaaccggaaattgggctgtggctgtgtctgcagcaaattcaaaaggcagttctctgcccactcgtattaacataatgaacctgtgtgaggcagggttgctggctcctcgccaggtctctgcaaactcagagggcatggacaacattctggtgacttggcagcctcccaggaaagatccctctgctgttcaggagtacgtggtggaatggagagagctccatccagggggtgacacacaggtccctctaaactggctacggagtcgaccctacaatgtgtctgctctgatttcagagaacataaaatcctacatctgttatgaaatccgtgtgtatgcactctcaggggatcaaggaggatgcagctccatcctgggtaactctaagcacaaagcaccactgagtggcccccacattaatgccatcacagaggaaaaggggagcattttaatttcatggaacagcattccagtccaggagcaaatgggctgcctcctccattataggatatactggaaggaacgggactccaactcccagcctcagctctgtgaaattccctacagagtctcccaaaattcacatccaataaacagcctgcagccccgagtgacatatgtcctgtggatgacagctctgacagctgctggtgaaagttcccacggaaatgagagggaattttgtctgcaaggtaaagccaattggatggcgtttgtggcaccaagcatttgcattgctatcatcatggtgggcattttctcaacgcattacttccagcaaaagagaagacacagctgcccttggacaggctcctgatagactggcccacgcctgaagatcctgaaccgctggtcatcagtgaagtccttcatcaagtgaccccagttttcagacatcccccctgctccaactggccacaaagggaaaaaggaatccaaggtcatcaggcctctgagaaagacatgatgcacagtgcctcaagcccaccacctccaagagctctccaagctgagagcagacaactggtggatctgtacaaggtgctggagagcaggggctccgacccaaagcccgaaaacccagcctgtccctggacggtgctcccagcaggtgaccttcccacccatgatggctacttaccctccaacatagatgacctcccctcacatgaggcacctctcgctgactctctggaagaactggagcctcagcacatctccctttctgttttcccctcaagttctcttcacccactcaccttctcctgtggtgataagctgactctggatcagttaaagatgaggtgtgactccctcatgctctgagtggtgaggcttcaagccttaaagtcagtgtgccctcaaccagcacagcctgccccaattcccccagcccctgctccagcagctgtcatctctgggtgccaccatcggtctggctgcagctagaggacaggcaagccagctctgggggagtcttaggaactgggagttggtcttcactcagatgcctcatcttgcctttcccagggccttaaaattacatccttcactgtgtggacctagagactccaacttgaattcctagtaactttcttggtatgctggccagaaagggaaatgaggaggagagtagaaaccacagctcttagtagtaatggcatacagtctagaggaccattcatgcaatgactatttctaaagcacctgctacacagcaggctgtacacagcagatcagtactgttcaacagaacttcctgagatgatggaaatgttctacctctgcactcactgtccagtacattagacactaggcacattggctgttaatcacttggaatgtgtttagcttgactgaggaattaaattttgattgtaaatttaaatcgccacacatggctagtggctactgtattggagtgcacagctctagatggctcctagattattgagagccttcaaaacaaatcaacctagttctatagatgaagacataaaagacactggtaaacaccaaggtaaaagggcccccaaggtggtcatgactggtctcatttgcagaagtctaagaatgtacctttttctggccgggcgtggtagctcatgcctgtaatcccagcactttgggaggctga

SEQ ID NO: 10 - DNA, 3782 bp, Homo sapiens
tgcagagcacagagaaaggacatctgcgaggaaagttccctgatggctgtcaacaaagtgccacgtctctatggctgtgaacgctgagcacacgattttatcgcgcctatcatatcttggtgcataaacgcacctcacctcggtcaacccttgctccgtcttatgagacaggctttattatccgcattttatatgaggggaaactgacggtggagagagaattatcttgctcaaggcgacacagcagagcccacaggtggcagaatcccacccgagcccgcttcgacccgcggggtggaaaccacgggcgcccgcccggctgcgcttccagagctgaactgagaagcgagtcctctccgccctgcggccaccgcccagccccgacccccgccccggcccgatcctcactcgccgccagctccccgcgcccaccccggagttggtggcgcagaggcgggaggcggaggcgggagggcgggcgctggcaccgggaacgcccgagcgccggcagagagcgcggagagcgcgacacgtgcggcccagagcaccggggccacccggtccccgcaggcccgggaccgcgcccgctggcaggcgacacgtggaagaatacggagttctataccagagttgattgttgatggcacatacttttagaggatgctcattggcatttatgtttataatcacgtggctgttgattaaagcaaaaatagatgcgtgcaagagaggcgatgtgactgtgaagccttcccatgtaattttacttggatccactgtcaatattacatgctctttgaagcccagacaaggctgctttcactattccagacgtaacaagttaatcctgtacaagtttgacagaagaatcaattttcaccatggccactccctcaattctcaagtcacaggtcttccccttggtacaaccttgtttgtctgcaaactggcctgtatcaatagtgatgaaattcaaatatgtggagcagagatcttcgttggtgttgctccagaacagcctcaaaatttatcctgcatacagaagggagaacaggggactgtggcctgcacctgggaaagaggacgagacacccacttatacactgagtatactctacagctaagtggaccaaaaaatttaacctggcagaagcaatgtaaagacatttattgtgactatttggactttggaatcaacctcacccctgaatcacctgaatccaatttcacagccaaggttactgctgtcaatagtcttggaagctcctcttcacttccatccacattcacattcttggacatagtgaggcctcttcctccgtgggacattagaatcaaatttcaaaaggcttctgtgagcagatgtaccctttattggagagatgagggactggtactgcttaatcgactcagatatcggcccagtaacagcaggctctggaatatggttaatgttacaaaggccaaaggaagacatgatttgctggatctgaaaccatttacagaatatgaatttcagatttcctctaagctacatctttataagggaagttggagtgattggagtgaatcattgagagcacaaacaccagaagaagagcctactgggatgttagatgtctggtacatgaaacggcacattgactacagtagacaacagatttctcttttctggaagaatctgagtgtctcagaggcaagaggaaaaattctccactatcaggtgaccttgcaggagctgacaggagggaaagccatgacacagaacatcacaggacacacctcctggaccacagtcattcctagaaccggaaattgggctgtggctgtgtctgcagcaaattcaaaaggcagttctctgcccactcgtattaacataatgaacctgtgtgaggcagggttgctggctcctcgccaggtctctgcaaactcagagggcatggacaacattctggtgacttggcagcctcccaggaaagatccctctgctgttcaggagtacgtggtggaatggagagagctccatccagggggtgacacacaggtccctctaaactggctacggagtcgaccctacaatgtgtctgctctgatttcagaaattccctacagagtctcccaaaattcacatccaataaacagcctgcagccccgagtgacatatgtcctgtggatgacagctctgacagctgctggtgaaagttcccacggaaatgagagggaattttgtctgcaaggtaaagccaattggatggcgtttgtggcaccaagcatttgcattgctatcatcatggtgggcattttctcaacgcattacttccagcaaaaggtgtttgttctcctagcagccctcagacctcagtggtgtagcagagaaattccagatccagcaaatagcacttgcgctaagaaatatcccattgcagaggagaagacacagctgcccttggacaggctcctgatagactggcccacgcctgaagatcctgaaccgctggtcatcagtgaagtccttcatcaagtgaccccagttttcagacatcccccctgctccaactggccacaaagggaaaaaggaatccaaggtcatcaggcctctgagaaagacatgatgcacagtgcctcaagcccaccacctccaagagctctccaagctgagagcagacaactggtggatctgtacaaggtgctggagagcaggggctccgacccaaagcccgaaaacccagcctgtccctggacggtgctcccagcaggtgaccttcccacccatgatggctacttaccctccaacatagatgacctcccctcacatgaggcacctctcgctgactctctggaagaactggagcctcagcacatctccctttctgttttcccctcaagttctcttcacccactcaccttctcctgtggtgataagctgactctggatcagttaaagatgaggtgtgactccctcatgctctgagtggtgaggcttcaagccttaaagtcagtgtgccctcaaccagcacagcctgccccaattcccccagcccctgctccagcagctgtcatctctgggtgccaccatcggtctggctgcagctagaggacaggcaagccagctctgggggagtcttaggaactgggagttggtcttcactcagatgcctcatcttgcctttcccagggccttaaaattacatccttcactgtgtggacctagagactccaacttgaattcctagtaactttcttggtatgctggccagaaagggaaatgaggaggagagtagaaaccacagctcttagtagtaatggcatacagtctagaggaccattcatgcaatgactatttctaaagcacctgctacacagcaggctgtacacagcagatcagtactgttcaacagaacttcctgagatgatggaaatgttctacctctgcactcactgtccagtacattagacactaggcacattggctgttaatcacttggaatgtgtttagcttgactgaggaattaaattttgattgtaaatttaaatcgccacacatggctagtggctactgtattggagtgcacagctctagatggctcctagattattgagagccttcaaaacaaatcaacctagttctatagatgaagacataaaagacactggtaaacaccaaggtaaaagggcccccaaggtggtcatgactggtctcatttgcagaagtctaagaatgtacctttttctggccgggcgtggtagctcatgcctgtaatcccagcactttgggaggctga

SEQ ID NO: 11 - DNA, 3849 bp, Homo sapiens
tgcagagcacagagaaaggacatctgcgaggaaagttccctgatggctgtcaacaaagtgccacgtctctatggctgtgaacgctgagcacacgattttatcgcgcctatcatatcttggtgcataaacgcacctcacctcggtcaacccttgctccgtcttatgagacaggctttattatccgcattttatatgaggggaaactgacggtggagagagaattatcttgctcaaggcgacacagcagagcccacaggtggcagaatcccacccgagcccgcttcgacccgcggggtggaaaccacgggcgcccgcccggctgcgcttccagagctgaactgagaagcgagtcctctccgccctgcggccaccgcccagccccgacccccgccccggcccgatcctcactcgccgccagctccccgcgcccaccccggagttggtggcgcagaggcgggaggcggaggcgggagggcgggcgctggcaccgggaacgcccgagcgccggcagagagcgcggagagcgcgacacgtgcggcccagagcaccggggccacccggtccccgcaggcccgggaccgcgcccgctggcaggcgacacgtggaagaatacggagttctataccagagttgattgttgatggcacatacttttagaggatgctcattggcatttatgtttataatcacgtggctgttgattaaagcaaaaatagatgcgtgcaagagaggcgatgtgactgtgaagccttcccatgtaattttacttggatccactgtcaatattacatgctctttgaagcccagacaaggctgctttcactattccagacgtaacaagttaatcctgtacaagtttgacagaagaatcaattttcaccatggccactccctcaattctcaagtcacaggtcttccccttggtacaaccttgtttgtctgcaaactggcctgtatcaatagtgatgaaattcaaatatgtggagcagagatcttcgttggtgttgctccagaacagcctcaaaatttatcctgcatacagaagggagaacaggggactgtggcctgcacctgggaaagaggacgagacacccacttatacactgagtatactctacagctaagtggaccaaaaaatttaacctggcagaagcaatgtaaagacatttattgtgactatttggactttggaatcaacctcacccctgaatcacctgaatccaatttcacagccaaggttactgctgtcaatagtcttggaagctcctcttcacttccatccacattcacattcttggacatagtgaggcctcttcctccgtgggacattagaatcaaatttcaaaaggcttctgtgagcagatgtaccctttattggagagatgagggactggtactgcttaatcgactcagatatcggcccagtaacagcaggctctggaatatggttaatgttacaaaggccaaaggaagacatgatttgctggatctgaaaccatttacagaatatgaatttcagatttcctctaagctacatctttataagggaagttggagtgattggagtgaatcattgagagcacaaacaccagaagaagagcctactgggatgttagatgtctggtacatgaaacggcacattgactacagtagacaacagatttctcttttctggaagaatctgagtgtctcagaggcaagaggaaaaattctccactatcaggtgaccttgcaggagctgacaggagggaaagccatgacacagaacatcacaggacacacctcctggaccacagtcattcctagaaccggaaattgggctgtggctgtgtctgcagcaaattcaaaaggcagttctctgcccactcgtattaacataatgaacctgtgtgaggcagggttgctggctcctcgccaggtctctgcaaactcagagggcatggacaacattctggtgacttggcagcctcccaggaaagatccctctgctgttcaggagtacgtggtggaatggagagagctccatccagggggtgacacacaggtccctctaaactggctacggagtcgaccctacaatgtgtctgctctgatttcagagaacataaaatcctacatctgttatgaaatccgtgtgtatgcactctcaggggatcaaggaggatgcagctccatcctgggtaactctaagcacaaagcaccactgagtggcccccacattaatgccatcacagaggaaaaggggagcattttaatttcatggaacagcattccagtccaggagcaaatgggctgcctcctccattataggatatactggaaggaacgggactccaactcccagcctcagctctgtgaaattccctacagagtctcccaaaattcacatccaataaacagcctgcagccccgagtgacatatgtcctgtggatgacagctctgacagctgctggtgaaagttcccacggaaatgagagggaattttgtctgcaaggagaagacacagctgcccttggacaggctcctgatagactggcccacgcctgaagatcctgaaccgctggtcatcagtgaagtccttcatcaagtgaccccagttttcagacatcccccctgctccaactggccacaaagggaaaaaggaatccaaggtcatcaggcctctgagaaagacatgatgcacagtgcctcaagcccaccacctccaagagctctccaagctgagagcagacaactggtggatctgtacaaggtgctggagagcaggggctccgacccaaagcccgaaaacccagcctgtccctggacggtgctcccagcaggtgaccttcccacccatgatggctacttaccctccaacatagatgacctcccctcacatgaggcacctctcgctgactctctggaagaactggagcctcagcacatctccctttctgttttcccctcaagttctcttcacccactcaccttctcctgtggtgataagctgactctggatcagttaaagatgaggtgtgactccctcatgctctgagtggtgaggcttcaagccttaaagtcagtgtgccctcaaccagcacagcctgccccaattcccccagcccctgctccagcagctgtcatctctgggtgccaccatcggtctggctgcagctagaggacaggcaagccagctctgggggagtcttaggaactgggagttggtcttcactcagatgcctcatcttgcctttcccagggccttaaaattacatccttcactgtgtggacctagagactccaacttgaattcctagtaactttcttggtatgctggccagaaagggaaatgaggaggagagtagaaaccacagctcttagtagtaatggcatacagtctagaggaccattcatgcaatgactatttctaaagcacctgctacacagcaggctgtacacagcagatcagtactgttcaacagaacttcctgagatgatggaaatgttctacctctgcactcactgtccagtacattagacactaggcacattggctgttaatcacttggaatgtgtttagcttgactgaggaattaaattttgattgtaaatttaaatcgccacacatggctagtggctactgtattggagtgcacagctctagatggctcctagattattgagagccttcaaaacaaatcaacctagttctatagatgaagacataaaagacactggtaaacaccaaggtaaaagggcccccaaggtggtcatgactggtctcatttgcagaagtctaagaatgtacctttttctggccgggcgtggtagctcatgcctgtaatcccagcactttgggaggctga

SEQ ID NO: 12 - DNA, 2826 bp, Homo sapiens
acaagggtggcagcctggctctgaagtggaattatgtgcttcaaacaggttgaaagagggaaacagtcttttcctgcttccagacatgaatcaggtcactattcaatgggatgcagtaatagccctttacatactcttcagctggtgtcatggaggaattacaaatataaactgctctggccacatctgggtagaaccagccacaatttttaagatgggtatgaatatctctatatattgccaagcagcaattaagaactgccaaccaaggaaacttcatttttataaaaatggcatcaaagaaagatttcaaatcacaaggattaataaaacaacagctcggctttggtataaaaactttctggaaccacatgcttctatgtactgcactgctgaatgtcccaaacattttcaagagacactgatatgtggaaaagacatttcttctggatatccgccagatattcctgatgaagtaacctgtgtcatttatgaatattcaggcaacatgacttgcacctggaatgctgggaagctcacctacatagacacaaaatacgtggtacatgtgaagagtttagagacagaagaagagcaacagtatctcacctcaagctatattaacatctccactgattcattacaaggtggcaagaagtacttggtttgggtccaagcagcaaacgcactaggcatggaagagtcaaaacaactgcaaattcacctggatgatatagtgataccttctgcagccgtcatttccagggctgagactataaatgctacagtgcccaagaccataatttattgggatagtcaaacaacaattgaaaaggtttcctgtgaaatgagatacaaggctacaacaaaccaaacttggaatgttaaagaatttgacaccaattttacatatgtgcaacagtcagaattctacttggagccaaacattaagtacgtatttcaagtgagatgtcaagaaacaggcaaaaggtactggcagccttggagttcaccgttttttcataaaacacctgaaacagttccccaggtcacatcaaaagcattccaacatgacacatggaattctgggctaacagttgcttccatctctacagggcaccttacttctgacaacagaggagacattggacttttattgggaatgatcgtctttgctgttatgttgtcaattctttctttgattgggatatttaacagatcattccgaactgggattaaaagaaggatcttattgttaataccaaagtggctttatgaagatattcctaatatgaaaaacagcaatgttgtgaaaatgctacaggaaaatagtgaacttatgaataataattccagtgagcaggtcctatatgttgatcccatgattacagagataaaagaaatcttcatcccagaacacaagcctacagactacaagaaggagaatacaggacccctggagacaagagactacccgcaaaactcgctattcgacaatactacagttgtatatattcctgatctcaacactggatataaaccccaaatttcaaattttctgcctgagggaagccatctcagcaataataatgaaattacttccttaacacttaaaccaccagttgattccttagactcaggaaataatcccaggttacaaaagcatcctaattttgctttttctgtttcaagtgtgaattcactaagcaacacaatatttcttggagaattaagcctcatattaaatcaaggagaatgcagttctcctgacatacaaaactcagtagaggaggaaaccaccatgcttttggaaaatgattcacccagtgaaactattccagaacagaccctgcttcctgatgaatttgtctcctgtttggggatcgtgaatgaggagttgccatctattaatacttattttccacaaaatattttggaaagccacttcaataggatttcactcttggaaaagtagagctgtgtggtcaaaatcaatatgagaaagctgccttgcaatctgaacttgggttttccctgcaatagaaattgaattctgcctctttttgaaaaaaatgtattcacatacaaatcttcacatggacacatgttttcatttcccttggataaatacctaggtaggggattgctgggccatatgataagcatatgtttcagttctaccaatcttgtttccagagtagtgacatttctgtgctcctaccatcaccatgtaagaattcccgggagctccatgcctttttaattttagccattcttctgcctcatttcttaaaattagagaattaaggtcccgaaggtggaacatgcttcatggtcacacatacaggcacaaaaacagcattatgtggacgcctcatgtattttttatagagtcaactatttcctctttattttccctcattgaaagatgcaaaacagctctctattgtgtacagaaagggtaaataatgcaaaatacctggtagtaaaataaatgctgaaaattttcctttaaaatagaatcattaggccaggcgtggtggctcatgcttgtaatcccagcactttggtaggctgaggtgggtggatcacctgaggtcaggagttcgagtccagcctggccaatatgctgaaaccctgtctctactaaaattacaaaaattagccggccatggtggcaggtgcttgtaatcccagctacttgggaggctgaggcaggagaatcacttgaaccaggaaggcagaggttgcactgagctgagattgtgccactgcactccagcctgggcaacaagagcaaaactctgtctggaaaaaaaaaaaaaa

SEQ ID NO: 13 - DNA, 702 bp, Homo sapiens
atgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagttccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtga

SEQ ID NO: 14 - DNA, 1368 bp, Homo sapiens
atgggcctctccaccgtgcctgacctgctgctgccgctggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggaacctacttgtacaatgactgtccaggcccggggcaggatacggactgcagggagtgtgagagcggctccttcaccgcttcagaaaaccacctcagacactgcctcagctgctccaaatgccgaaaggaaatgggtcaggtggagatctcttcttgcacagtggaccgggacaccgtgtgtggctgcaggaagaaccagtaccggcattattggagtgaaaaccttttccagtgcttcaattgcagcctctgcctcaatgggaccgtgcacctctcctgccaggagaaacagaacaccgtgtgcacctgccatgcaggtttctttctaagagaaaacgagtgtgtctcctgtagtaactgtaagaaaagcctggagtgcacgaagttgtgcctaccccagattgagaatgttaagggcactgaggactcaggcaccacagtgctgttgcccctggtcattttctttggtctttgccttttatccctcctcttcattggtttaatgtatcgctaccaacggtggaagtccaagctctactccattgtttgtgggaaatcgacacctgaaaaagagggggagcttgaaggaactactactaagcccctggccccaaacccaagcttcagtcccactccaggcttcacccccaccctgggcttcagtcccgtgcccagttccaccttcacctccagctccacctatacccccggtgactgtcccaactttgcggctccccgcagagaggtggcaccaccctatcagggggctgaccccatccttgcgacagccctcgcctccgaccccatccccaacccccttcagaagtgggaggacagcgcccacaagccacagagcctagacactgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatga

SEQ ID NO: 15 - DNA, 1386 bp, Homo sapiens
atggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggactgattgtgggtgtgacagccttgggtctactaataataggagtggtgaactgtgtcatcatgacccaggtgaaaaagaagcccttgtgcctgcagagagaagccaaggtgcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaa

SEQ ID NO: 16 - DNA, 939 bp, Homo sapiens
atggcagctgggcaaaatgggcacgaagagtgggtgggcagcgcatacctgtttgtggagtcctcgctggacaaggtggtcctgtcggatgcctacgcgcacccccagcagaaggtggcagtgtacagggctctgcaggctgccttggcagagagcggcgggagcccggacgtgctgcagatgctgaagatccaccgcagcgacccgcagctgatcgtgcagctgcgattctgcgggcggcagccctgtggccgcttcctccgcgcctaccgcgagggggcgctgcgcgccgcgctgcagaggagcctggcggccgcgctcgcccagcactcggtgccgctgcaactggagctgcgcgccggcgccgagcggctggacgctttgctggcggacgaggagcgctgtttgagttgcatcctagcccagcagcccgaccggctccgggatgaagaactggctgagctggaggatgcgctgcgaaatctgaagtgcggctcgggggcccggggtggcgacggggaggtcgcttcggcccccttgcagcccccggtgccctctctgtcggaggtgaagccgccgccgccgccgccacctgcccagacttttctgttccagggtcagcctgtagtgaatcggccgctgagcctgaaggaccaacagacgttcgcgcgctctgtgggtctcaaatggcgcaaggtggggcgctcactgcagcgaggctgccgggcgctgcgggacccggcgctggactcgctggcctacgagtacgagcgcgagggactgtacgagcaggccttccagctgctgcggcgcttcgtgcaggccgagggccgccgcgccacgctgcagcgcctggtggaggcactcgaggagaacgagctcaccagcctggcagaggacttgctgggcctgaccgatcccaatggcggcctggcctag

SEQ ID NO: 17 - DNA, 1506 bp, Homo sapiens
atggctgcagctagcgtgaccccccctggctccctggagttgctacagcccggcttctccaagaccctcctggggaccaagctggaagccaagtacctgtgctccgcctgcagaaacgtcctccgcaggcccttccaggcgcagtgtggccaccggtactgctccttctgcctggccagcatcctcagctctgggcctcagaactgtgctgcctgtgttcacgagggcatatatgaagaaggcatttctattttagaaagcagttcggccttcccagataatgctgcccgcagggaggtggagagcctgccggccgtctgtcccagtgatggatgcacctggaaggggaccctgaaagaatacgagagctgccacgaaggccgctgcccgctcatgctgaccgaatgtcccgcgtgcaaaggcctggtccgccttggtgaaaaggagcgccacctggagcacgagtgcccggagagaagcctgagctgccggcattgccgggcaccctgctgcggagcagacgtgaaggcgcaccacgaggtctgccccaagttccccttaacttgtgacggctgcggcaagaagaagatcccccgggagaagtttcaggaccacgtcaagacttgtggcaagtgtcgagtcccttgcagattccacgccatcggctgcctcgagacggtagagggtgagaaacagcaggagcacgaggtgcagtggctgcgggagcacctggccatgctactgagctcggtgctggaggcaaagcccctcttgggagaccagagccacgcggggtcagagctcctgcagaggtgcgagagcctggagaagaagacggccacttttgagaacattgtctgcgtcctgaaccgggaggtggagagggtggccatgactgccgaggcctgcagccggcagcaccggctggaccaagacaagattgaagccctgagtagcaaggtgcagcagctggagaggagcattggcctcaaggacctggcgatggctgacttggagcagaaggtcttggagatggaggcatccacctacgatggggtcttcatctggaagatctcagacttcgccaggaagcgccaggaagctgtggctggccgcatacccgccatcttctccccagccttctacaccagcaggtacggctacaagatgtgtctgcgtatctacctgaacggcgacggcaccgggcgaggaacacacctgtccctcttctttgtggtgatgaagggcccgaatgacgccctgctgcggtggcccttcaaccagaaggtgaccttaatgctgctcgaccagaataaccgggagcacgtgattgacgccttcaggcccgacgtgacttcatcctcttttcagaggccagtcaacgacatgaacatcgcaagcggctgccccctcttctgccccgtctccaagatggaggcaaagaattcctacgtgcgggacgatgccatcttcatcaaggccattgtggacctgacagggctctaa

SEQ ID NO: 18 - DNA, 4539 bp, Homo sapiens
atggcggcggcggcggggaatcgcgcctcgtcgtcgggattcccgggcgccagggctacgagccctgaggcaggcggcggcggaggagccctcaaggcgagcagcgcgcccgcggctgccgcgggactgctgcgggaggcgggcagcgggggccgcgagcgggcggactggcggcggcggcagctgcgcaaagtgcggagtgtggagctggaccagctgcctgagcagccgctcttccttgccgcctcaccgccggcctcctcgacttccccgtcgccggagcccgcggacgcagcggggagtgggaccggcttccagcctgtggcggtgccgccgccccacggagccgcgagccgcggcggcgcccaccttaccgagtcggtggcggcgccggacagcggcgcctcgagtcccgcagcggccgagcccggggagaagcgggcgcccgccgccgagccgtctcctgcagcggcccccgccggtcgtgagatggagaataaagaaactctcaaagggttgcacaagatggatgatcgtccagaggaacgaatgatcagggagaaactgaaggcaacctgtatgccagcctggaagcacgaatggttggaaaggagaaataggcgagggcctgtggtggtaaaaccaatcccagttaaaggagatggatctgaaatgaatcacttagcagctgagtctccaggagaggtccaggcaagtgcggcttcaccagcttccaaaggccgacgcagtccttctcctggcaactccccatcaggtcgcacagtgaaatcagaatctccaggagtaaggagaaaaagagtttccccagtgccttttcagagtggcagaatcacaccaccccgaagagccccttcaccagatggcttctcaccatatagccctgaggaaacaaaccgccgtgttaacaaagtgatgcgggccagactgtacttactgcagcagatagggcctaactctttcctgattggaggagacagcccagacaataaataccgggtgtttattgggcctcagaactgcagctgtgcacgtggaacattctgtattcatctgctatttgtgatgctccgggtgtttcaactagaaccttcagacccaatgttatggagaaaaactttaaagaattttgaggttgagagtttgttccagaaatatcacagtaggcgtagctcaaggatcaaagctccatctcgtaacaccatccagaagtttgtttcacgcatgtcaaattctcatacattgtcatcatctagtacttctacgtctagttcagaaaacagcataaaggatgaagaggaacagatgtgtcctatttgcttgttgggcatgcttgatgaagaaagtcttacagtgtgtgaagacggctgcaggaacaagctgcaccaccactgcatgtcaatttgggcagaagagtgtagaagaaatagagaacctttaatatgtcccctttgtagatctaagtggagatctcatgatttctacagccacgagttgtcaagtcctgtggattccccttcttccctcagagctgcacagcagcaaaccgtacagcagcagcctttggctggatcacgaaggaatcaagagagcaattttaaccttactcattatggaactcagcaaatccctcctgcttacaaagatttagctgagccatggattcaggtgtttggaatggaactcgttggctgcttattttctagaaactggaatgtgagagagatggccctcaggcgtctttcccatgatgtcagtggggccctgctgttggcaaatggggagagcactggaaattctgggggcagcagtggaagcagcccgagtgggggagccaccagtgggtcttcccagaccagtatctcaggagatgtggtggaggcatgctgcagcgttctgtcaatggtctgtgctgaccctgtctacaaagtgtacgttgctgctttaaaaacattgagagccatgctggtatatactccttgccacagtttagcggaaagaatcaaacttcagagacttctccagccagttgtagacaccatcctagtcaaatgtgcagatgccaatagccgcacaagtcagctgtccatatcaacactgttggaactgtgcaaaggccaagcaggagagttggcagttggcagagaaatactaaaagctggatccattggtattggtggtgttgattatgtcttaaattgtattcttggaaaccaaactgaatcaaacaattggcaagaacttcttggccgcctttgtcttatagatagactgttgttggaatttcctgctgaattttatcctcatattgtcagtactgatgtttcacaagctgagcctgttgaaatcaggtataagaagctgctgtccctcttaacctttgctttgcagtccattgataattcccactcaatggttggcaaactttccagaaggatctacttgagttctgcaagaatggttactacagtaccccatgtgttttcaaaactgttagaaatgctgagtgtttccagttccactcacttcaccaggatgcgtcgccgtttgatggctattgcagatgaggtggaaattgccgaagccatccagttgggcgtagaagacactttggatggtcaacaggacagcttcttgcaggcatctgttcccaacaactatctggaaaccacagagaacagttcccctgagtgcacagtccatttagagaaaactggaaaaggattatgtgctacaaaattgagtgccagttcagaggacatttctgagagactggccagcatttcagtaggaccttctagttcaacaacaacaacaacaacaacaacagagcaaccaaagccaatggttcaaacaaaaggcagaccccacagtcagtgtttgaactcctctcctttatctcatcattcccaattaatgtttccagccttgtcaaccccttcttcttctaccccatctgtaccagctggcactgcaacagatgtctctaagcatagacttcagggattcattccctgcagaataccttctgcatctcctcaaacacagcgcaagttttctctacaattccacagaaactgtcctgaaaacaaagactcagataaactttccccagtctttactcagtcaagacccttgccctccagtaacatacacaggccaaagccatctagacctaccccaggtaatacaagtaaacagggagatccctcaaaaaatagcatgacacttgatctgaacagtagttccaaatgtgatgacagctttggctgtagcagcaatagtagtaatgctgttatacccagtgacgagacagtgttcaccccagtagaggagaaatgcagattagatgtcaatacagagctcaactccagtattgaggaccttcttgaagcatctatgccttcaagtgatacaacagtaacttttaagtcagaagttgctgtcctgtctcctgaaaaggctgaaaatgatgatacctacaaagatgatgtgaatcataatcaaaagtgcaaagagaagatggaagctgaagaagaagaagctttagcaattgccatggcaatgtcagcgtctcaggatgccctccccatagttcctcagctgcaggttgaaaatggagaagatatcatcattattcaacaggatacaccagagactctaccaggacataccaaagcaaaacaaccgtatagagaagacactgaatggctgaaaggtcaacagataggccttggagcattttcttcttgttatcaggctcaagatgtgggaactggaactttaatggctgttaaacaggtgacttatgtcagaaacacatcttctgagcaagaagaagtagtagaagcactaagagaagagataagaatgatgagccatctgaatcatccaaacatcattaggatgttgggagccacgtgtgagaagagcaattacaatctcttcattgaatggatggcagggggatcggtggctcatttgctgagtaaatatggagccttcaaagaatcagtagttattaactacactgaacagttactccgtggcctttcgtatctccatgaaaaccaaatcattcacagagatgtcaaaggtgccaatttgctaattgacagcactggtcagagactaagaattgcagattttggagctgcagccaggttggcatcaaaaggaactggtgcaggagagtttcagggacaattactggggacaattgcatttatggcacctgaggtactaagaggtcaacagtatggaaggagctgtgatgtatggagtgttggctgtgctattatagaaatggcttgtgcaaaaccaccatggaatgcagaaaaacactccaatcatcttgctttgatatttaagattgctagtgcaactactgctccatcgatcccttcacatttgtctcctggtttacgagatgtggctcttcgttgtttagaacttcaacctcaggacagacctccatcaagagagctactgaagcatccagtctttcgtactacatggtag

SEQ ID NO: 19 - DNA, 4827 bp, Homo sapiens
atgagagaagccgctgccgcgctggtccctcctcccgcctttgccgtcacgcctgccgccgccatggaggagccgccgccaccgccgccgccgccaccaccgccaccggaacccgagaccgagtcagaacccgagtgctgcttggcggcgaggcaagagggcacattgggagattcagcttgcaagagtcctgaatctgatctagaagacttctccgatgaaacaaatacagagaatctttatggtacctctccccccagcacacctcgacagatgaaacgcatgtcaaccaaacatcagaggaataatgtggggaggccagccagtcggtctaatttgaaagaaaaaatgaatgcaccaaatcagcctccacataaagacactggaaaaacagtggagaatgtggaagaatacagctataagcaggagaaaaagatccgagcagctcttagaacaacagagcgtgatcataaaaaaaatgtacagtgctcattcatgttagactcagtgggtggatctttgccaaaaaaatcaattccagatgtggatctcaataagccttacctcagccttggctgtagcaatgctaagcttccagtatctgtgcccatgcctatagccagacctgcacgccagacttctaggactgactgtccagcagatcgtttaaagttttttgaaactttacgacttttgctaaagcttacctcagtctcaaagaaaaaagacagggagcaaagaggacaagaaaatacgtctggtttctggcttaaccgatctaacgaactgatctggttagagctacaagcctggcatgcaggacggacaattaacgaccaggacttctttttatatacagcccgtcaagccatcccagatattattaatgaaatccttactttcaaagtcgactatgggagcttcgcctttgttagagatagagctggttttaatggtacttcagtagaagggcagtgcaaagccactcctggaacaaagattgtaggttactcaacacatcatgagcatctccaacgccagagggtctcatttgagcaggtaaaacggataatggagctgctagagtacatagaagcactttatccatcattgcaggctcttcagaaggactatgaaaaatatgctgcaaaagacttccaggacagggtgcaggcactctgtttgtggttaaacatcacaaaagacttaaatcagaaattaaggattatgggcactgttttgggcatcaagaatttatcagacattggctggccagtgtttgaaatcccttcccctcgaccatccaaaggtaatgagccggagtatgagggtgatgacacagaaggagaattaaaggagttggaaagtagtacggatgagagtgaagaagaacaaatctctgatcctagggtaccggaaatcagacagcccatagataacagcttcgacatccagtcgcgggactgcatatccaagaagcttgagaggctcgaatctgaggatgattctcttggctggggagcaccagactggagcacagaagcaggctttagtagacattgtctgacttctatttatagaccatttgtagacaaagcactgaagcagatggggttaagaaagttaattttaagacttcacaagctaatggatggttccttgcaaagggcacgtatagcattggtaaagaacgatcgtccagtggagttttctgaatttccagatcccatgtggggttcagattatgtgcagttgtcaaggacaccaccttcatctgaggagaaatgcagtgctgtgtcgtgggaggagctgaaggccatggatttaccttcattcgaacctgccttcctagttctctgccgagtccttctgaatgtcatacatgagtgtctgaagttaagattggagcagagacctgctggagaaccatctctcttgagtattaagcagctggtgagagagtgtaaggaggtcctgaagggcggcctgctgatgaagcagtactaccagttcatgctgcaggaggttctggaggacttggagaagcccgactgcaacattgacgcttttgaagaggatctacataaaatgcttatggtgtattttgattacatgagaagctggatccaaatgctacagcaattacctcaagcatcgcatagtttaaaaaatctgttagaagaagaatggaatttcaccaaagaaataactcattacatacggggaggagaagcacaggccgggaagcttttctgtgacattgcaggaatgctgctgaaatctacaggaagttttttagaatttggcttacaggagagctgtgctgaattttggactagtgcggatgacagcagtgcttccgacgaaatcaggaggtctgttatagagatcagtcgagccctgaaggagctcttccatgaagccagagaaagggcttccaaagcacttggatttgctaaaatgttgagaaaggacctggaaatagcagcagaattcaggctttcagccccagttagagacctcctggatgttctgaaatcaaaacagtatgtcaaggtgcaaattcctgggttagaaaacttgcaaatgtttgttccagacactcttgctgaggagaagagtattattttgcagttactcaatgcagctgcaggaaaggactgttcaaaagattcagatgacgtactcatcgatgcctatctgcttctgaccaagcacggtgatcgagcccgtgattcagaggacagctggggcacctgggaggcacagcctgtcaaagtcgtgcctcaggtggagactgttgacaccctgagaagcatgcaggtggataatcttttactagttgtcatgcagtctgcgcatctcacaattcagagaaaagctttccagcagtccattgagggacttatgactctgtgccaggagcagacatccagtcagccggtcatcgccaaagctttgcagcagctgaagaatgatgcattggagctatgcaacaggataagcaatgccattgaccgcgtggaccacatgttcacatcagaatttgatgctgaggttgatgaatctgaatctgtcaccttgcaacagtactaccgagaagcaatgattcaggggtacaattttggatttgagtatcataaagaagttgttcgtttgatgtctggggagtttagacagaagataggagacaaatatataagctttgcccggaagtggatgaattatgtcctgactaaatgtgagagtggtagaggtacaagacccaggtgggcgactcaaggatttgattttctacaagcaattgaacctgcctttatttcagctttaccagaagatgacttcttgagtttacaagccttgatgaatgaatgcattggccatgtcataggaaaaccacacagtcctgttacaggtttgtaccttgccattcatcggaacagcccccgtcctatgaaggtacctcgatgccatagtgaccctcctaacccacacctcattatccccactccagagggattcagcactcggagcatgccttccgacgcgcggagccatggcagccctgctgctgctgctgctgctgctgctgctgctgttgctgccagtcggcccagcccctctggtggtgactctgtgctgcccaaatccatcagcagtgcccatgataccaggggttccagcgttcctgaaaatgatcgattggcttccatagctgctgaattgcagtttaggtccctgagtcgtcactcaagccccacggaggagcgagatgaaccagcatatccaagaggagattcaagtgggtccacaagaagaagttgggaacttcggacactaatcagccagagtaaagatactgcttctaaactaggacccatagaagctatccagaagtcagtccgattgtttgaagaaaagaggtaccgagaaatgaggagaaagaatatcattggtcaagtttgtgatacgcctaagtcctatgataatgttatgcacgttggcttgaggaaggtgaccttcaaatggcaaagaggaaacaaaattggagaaggccagtatgggaaggtgtacacctgcatcagcgtcgacaccggggagctgatggccatgaaagagattcgatttcaacctaatgaccataagactatcaaggaaactgcagacgaattgaaaatattcgaaggcatcaaacaccccaatctggttcggtattttggtgtggagctccatagagaagaaatgtacatcttcatggagtactgcgatgaggggactttagaagaggtgtcaaggctgggacttcaggaacatgtgattaggctgtattcaaagcagatcaccattgcgatcaacgtcctccatgagcatggcatagtccaccgtgacattaaaggtgccaatatcttccttacctcatctggattaatcaaactgggagattttggatgttcagtaaagctcaaaaacaatgcccagaccatgcctggtgaagtgaacagcaccctggggacagcagcatacatggcacctgaagtcatcactcgtgccaaaggagagggccatgggcgtgcggccgacatctggagtctggggtgtgttgtcatagagatggtgactggcaagaggccttggcatgagtatgagcacaactttcaaattatgtataaagtggggatgggacataagccaccaatccctgaaagattaagccctgaaggaaaggacttcctttctcactgccttgagagtgacccaaagatgagatggaccgccagccagctcctcgaccattcgtttgtcaaggtttgcacagatgaagaatga

SEQ ID NO: 20 - DNA, 1740 bp, Homo sapiens
atgtctacagcctctgccgcctcctcctcctcctcgtcttcggccggtgagatgatcgaagccccttcccaggtcctcaactttgaagagatcgactacaaggagatcgaggtggaagaggttgttggaagaggagcctttggagttgtttgcaaagctaagtggagagcaaaagatgttgctattaaacaaatagaaagtgaatctgagaggaaagcgtttattgtagagcttcggcagttatcccgtgtgaaccatcctaatattgtaaagctttatggagcctgcttgaatccagtgtgtcttgtgatggaatatgctgaagggggctctttatataatgtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaacttactgctggttgcaggggggacagttctaaaaatttgtgattttggtacagcctgtgacattcagacacacatgaccaataacaaggggagtgctgcttggatggcacctgaagtttttgaaggtagtaattacagtgaaaaatgtgacgtcttcagctggggtattattctttgggaagtgataacgcgtcggaaaccctttgatgagattggtggcccagctttccgaatcatgtgggctgttcataatggtactcgaccaccactgataaaaaatttacctaagcccattgagagcctgatgactcgttgttggtctaaagatccttcccagcgcccttcaatggaggaaattgtgaaaataatgactcacttgatgcggtactttccaggagcagatgagccattacagtatccttgtcagtattcagatgaaggacagagcaactctgccaccagtacaggctcattcatggacattgcttctacaaatacgagtaacaaaagtgacactaatatggagcaagttcctgccacaaatgatactattaagcgcttagaatcaaaattgttgaaaaatcaggcaaagcaacagagtgaatctggacgtttaagcttgggagcctcccgtgggagcagtgtggagagcttgcccccaacctctgagggcaagaggatgagtgctgacatgtctgaaatagaagctaggatcgccgcaaccacaggcaacggacagccaagacgtagatccatccaagacttgactgtaactggaacagaacctggtcaggtgagcagtaggtcatccagtcccagtgtcagaatgattactacctcaggaccaacctcagaaaagccaactcgaagtcatccatggacccctgatgattccacagataccaatggatcagataactccatcccaatggcttatcttacactggatcaccaactacagcctctagcaccgtgcccaaactccaaagaatctatggcagtgtttgaacagcattgtaaaatggcacaagaatatatgaaagttcaaacagaaattgcattgttattacagagaaagcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatga

SEQ ID NO: 21 - DNA, 1284 bp, Homo sapiens
atgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgttgacatttggtcagttgggtgcatcatgggagaaatgatcaaaggtggtgttttgttcccaggtacagatcatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatga

SEQ ID NO: 22 - DNA, 996 bp, Homo sapiens
atgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttga

SEQ ID NO: 23 - DNA, 4125 bp, Homo sapiens
atgagcacggaggcggacgagggcatcactttctctgtgccacccttcgccccctcgggcttctgcaccatccccgagggcggcatctgcaggaggggaggagcggcggcggtgggcgagggcgaggagcaccagctgccaccgccgccgccgggcagcttctggaacgtggagagcgccgctgcccctggcatcggttgtccggcggccacctcctcgagcagtgccacccgaggccggggcagctctgttggcgggggcagccgacggaccacggtggcatatgtgatcaacgaagcgagccaagggcaactggtggtggccgagagcgaggccctgcagagcttgcgggaggcgtgcgagacagtgggcgccaccctggaaaccctgcattttgggaaactcgactttggagaaaccaccgtgctggaccgcttttacaatgcagatattgcggtggtggagatgagcgatgccttccggcagccgtccttgttttaccaccttggggtgagagaaagtttcagcatggccaacaacatcatcctctactgtgatactaactcggactctctgcagtcactgaaggaaataatttgccagaagaatactatgtgcactgggaactacacctttgttccttacatgataactccacataacaaagtctactgctgtgacagcagcttcatgaaggggttgacagagctcatgcaaccgaacttcgagctgcttcttggacccatctgcttacctcttgtggatcgttttattcaacttttgaaggtggcacaagcaagttctagccagtacttccgggaatctatactcaatgacatcaggaaagctcgtaatttatacactggtaaagaattggcagctgagttggcaagaattcggcagcgagtagataatatcgaagtcttgacagcagatattgtcataaatctgttactttcctacagagatatccaggactatgattctattgtgaagctggtagagactttagaaaaactgccaacctttgatttggcctcccatcaccatgtgaagtttcattatgcatttgcactgaataggagaaatctccctggtgacagagcaaaagctcttgatattatgattcccatggtgcaaagcgaaggacaagttgcttcagatatgtattgcctagttggtcgaatctacaaagatatgtttttggactctaatttcacggacactgaaagcagagaccatggagcttcttggttcaaaaaggcatttgaatctgagccaacactacagtcaggaattaattatgcggtcctcctcctggcagctggacaccagtttgaatcttcctttgagctccggaaagttggggtgaagctaagtagtcttcttggtaaaaagggaaacttggaaaaactccagagctactgggaagttggattttttctgggggccagcgtcctagccaatgaccacatgagagtcattcaagcatctgaaaagctttttaaactgaagacaccagcatggtacctcaagtctattgtagagacaattttaatatataagcattttgtgaaactgaccacagaacagcctgtggccaagcaagaacttgtggacttttggatggatttcctggtcgaggccacaaagacagatgttactgtggttaggtttccagtattaatattagaaccaaccaaaatctatcaaccttcttatttgtctatcaacaatgaagttgaggaaaagacaatctctatttggcacgtgcttcctgatgacaagaaaggtatacatgagtggaattttagtgcctcttctgtcaggggagtgagtatttctaaatttgaagaaagatgctgctttctttatgtgcttcacaattctgatgatttccaaatctatttctgtacagaacttcattgtaaaaagttttttgagatggtgaacaccattaccgaagagaaggggagaagcacagaggaaggagactgtgaaagtgacttgctggagtatgactatgaatatgatgaaaatggtgacagagtcgttttaggaaaaggcacttatgggatagtctacgcaggtcgggacttgagcaaccaagtcagaattgctattaaggaaatcccagagagagacagcagatactctcagcccctgcatgaagaaatagcattgcataaacacctgaagcacaaaaatattgtccagtatctgggctctttcagtgagaatggtttcattaaaatcttcatggagcaggtccctggaggaagtctttctgctctccttcgttccaaatggggtccattaaaagacaatgagcaaacaattggcttttatacaaagcaaatactggaaggattaaaatatctccatgacaatcagatagttcaccgggacataaagggtgacaatgtgttgattaatacctacagtggtgttctcaagatctctgacttcggaacatcaaagaggcttgctggcataaacccctgtactgaaacttttactggtaccctccagtatatggcaccagaaataatagataaaggaccaagaggctacggaaaagcagcagacatctggtctctgggctgtacaatcattgaaatggccacaggaaaacccccattttatgaactgggagaaccacaagcagctatgttcaaggtgggaatgtttaaagtccaccctgagatcccagagtccatgtctgcagaggccaaggcattcatactgaaatgttttgaaccagatcctgacaagagagcctgtgctaacgacttgcttgttgatgagtttttaaaagtttcaagcaaaaagaaaaagacacaacctaagctttcagctctttcagctggatcaaatgaatatctcaggagtatatccttgccggtacctgtgctggtggaggacaccagcagcagcagtgagtacggctcagtttcacccgacacggagttgaaagtggaccccttctctttcaaaacaagagccaagtcctgcggagaaagagatgtcaagggaattcggacactctttttgggcattccagatgagaattttgaagatcacagtgctcctccttcccctgaagaaaaagattctggattcttcatgctgaggaaggacagtgagaggcgagctacccttcacaggatcctgacggaagaccaagacaaaattgtgagaaacctaatggaatctttagctcagggggctgaagaaccgaaactaaaatgggaacacatcacaaccctcattgcaagcctcagagaatttgtgagatccactgaccgaaaaatcatagccaccacactgtcaaagctgaaactggagctggacttcgacagccatggcattagccaagtccaggtggtactctttggttttcaagatgctgtcaataaagttcttcggaatcataacatcaagccgcactggatgtttgccttagacagtatcattcggaaggcggtacagacagccattaccatcctggttccagaactaaggccacatttcagccttgcatctgagagtgatactgctgatcaagaagacttggatgtagaagatgaccatgaggaacagccttcaaatcaaactgtccgaagacctcaggctgtcattgaagatgctgtggctacctcaggcgtgagcacgctcagttctactgtgtctcatgattcccagagtgctcaccggtcactgaatgtacagcttggaaggatgaaaatagaaaccaatagattactggaagaattggttcggaaagagaaagaattacaagcactccttcatcgagctattgaagaaaaagaccaagaaattaaacacctgaagcttaagtcccaacccatagaaattcctgaattgcctgtatttcatctaaattcttctggcacaaatactgaagattctgaacttaccgactggctgagagtgaatggagctgatgaagacactataagccggtttttggctgaagattatacactattggatgttctctactatgttacacgtgatgacttaaaatgcttgagactaaggggagggatgctgtgcacactgtggaaggctatcattgactttcgaaacaaacagacttga

SEQ ID NO: 24 - DNA, 1527 bp, Homo sapiens
atgtggagcaaactgaataatgaagagcacaatgagctgagggaagtggacggcaccgctaagaagaatggcggcaccctctactacatggcgcccgagcacctgaatgacgtcaacgcaaagcccacagagaagtcggatgtgtacagctttgctgtagtactctgggcgatatttgcaaataaggagccatatgaaaatgctatctgtgagcagcagttgataatgtgcataaaatctgggaacaggccagatgtggatgacatcactgagtactgcccaagagaaattatcagtctcatgaagctctgctgggaagcgaatccggaagctcggccgacatttcctggcattgaagaaaaatttaggcctttttatttaagtcaattagaagaaagtgtagaagaggacgtgaagagtttaaagaaagagtattcaaacgaaaatgcagttgtgaagagaatgcagtctcttcaacttgattgtgtggcagtaccttcaagccggtcaaattcagccacagaacagcctggttcactgcacagttcccagggacttgggatgggtcctgtggaggagtcctggtttgctccttccctggagcacccacaagaagagaatgagcccagcctgcagagtaaactccaagacgaagccaactaccatctttatggcagccgcatggacaggcagacgaaacagcagcccagacagaatgtggcttacaacagagaggaggaaaggagacgcagggtctcccatgacccttttgcacagcaaagaccttacgagaattttcagaatacagagggaaaaggcactgcttattccagtgcagccagtcatggtaatgcagtgcaccagccctcagggctcaccagccaacctcaagtactgtatcagaacaatggattatatagctcacatggctttggaacaagaccactggatccaggaacagcaggtcccagagtttggtacaggccaattccaagtcatatgcctagtctgcataatatcccagtgcctgagaccaactatctaggaaatacacccaccatgccattcagctccttgccaccaacagatgaatctataaaatataccatatacaatagtactggcattcagattggagcctacaattatatggagattggtgggacgagttcatcactactagacagcacaaatacgaacttcaaagaagagccagctgctaagtaccaagctatctttgataataccactagtctgacggataaacacctggacccaatcagggaaaatctgggaaagcactggaaaaactgtgcccgtaaactgggcttcacacagtctcagattgatgaaattgaccatgactatgagcgagatggactgaaagaaaaggtttaccagatgctccaaaagtgggtgatgagggaaggcataaagggagccacggtggggaagctggcccaggcgctccaccagtgttccaggatcgaccttctgagcagcttgatttacgtcagccagaactaa

SEQ ID NO: 25 - DNA, 1974 bp, Homo sapiens
atggacgaacaggaggcattgaactcaatcatgaacgatctggtggccctccagatgaaccgacgtcaccggatgcctggatatgagaccatgaagaacaaagacacaggtcactcaaataggcagaaaaaacacaacagcagcagctcagcccttctgaacagccccacagtaacaacaagctcatgtgcaggggccagtgagaaaaagaaatttttgagtgacgtcagaatcaagttcgagcacaacggggagaggcgaattatagcgttcagccggcctgtgaaatatgaagatgtggagcacaaggtgacaacagtatttggacaacctcttgatctacattacatgaacaatgagctctccatcctgctgaaaaaccaagatgatcttgataaagcaattgacattttagatagaagctcaagcatgaaaagccttaggatattgctgttgtcccaggacagaaaccataacagttcctctccccactctggggtgtccagacaggtgcggatcaaggcttcccagtccgcaggggatataaatactatctaccagccccccgagcccagaagcaggcacctctctgtcagctcccagaaccctggccgaagctcacctccccctggctatgttcctgagcggcagcagcacattgcccggcaggggtcctacaccagcatcaacagtgagggggagttcatcccagagaccagcgagcagtgcatgctggatcccctgagcagtgcagaaaattccttgtctggaagctgccaatccttggacaggtcagcagacagcccatccttccggaaatcacgaatgtcccgtgcccagagcttccctgacaacagacaggaatactcagatcgggaaactcagctttatgacaaaggggtcaaaggtggaacctacccccggcgctaccacgtgtctgtgcaccacaaggactacagtgatggcagaagaacatttccccgaatacggcgtcatcaaggcaacttgttcaccctggtgccctccagccgctccctgagcacaaatggcgagaacatgggtctggctgtgcaatacctggacccccgtgggcgcctgcggagtgcggacagcgagaatgccctctctgtgcaggagaggaatgtgccaaccaagtctcccagtgcccccatcaactggcgccggggaaagctcctgggccagggtgccttcggcagggtctatttgtgctatgacgtggacacgggacgtgaacttgcttccaagcaggtccaatttgatccagacagtcctgagacaagcaaggaggtgagtgctctggagtgcgagatccagttgctaaagaacttgcagcatgagcgcatcgtgcagtactatggctgtctgcgggaccgcgctgagaagaccctgaccatcttcatggagtacatgccagggggctcggtgaaagaccagttgaaggcttacggtgctctgacagagagcgtgacccgaaagtacacgcggcagatcctggagggcatgtcctacctgcacagcaacatgattgttcaccgggacattaagggagccaacatcctccgagactctgctgggaatgtaaagctgggggactttggggccagcaaacgcctgcagacgatctgtatgtcggggacgggcatgcgctccgtcactggcacaccctactggatgagccctgaggtgatcagcggcgagggctatggaaggaaagcagacgtgtggagcctgggctgcactgtggtggagatgctgacagagaaaccaccgtgggcagagtatgaagctatggccgccatcttcaagattgccacccagcccaccaatcctcagctgccctcccacatctctgaacatggccgggacttcctgaggcgcatttttgtggaggctcgccagagaccttcagctgaggagctgctcacacaccactttgcacagctcatgtactga

SEQ ID NO: 26 - DNA, 3867 bp, Homo sapiens
atggcggggccgtgtccccggtccggggcggagcgcgccggcagctgctggcaggacccgctggccgtggcgctgagccggggccggcagctcgcggcgcccccgggccggggctgcgcgcggagccggccgctcagcgtggtctacgtgctgacccgggagccgcagcccgggctcgagcctcgggagggaaccgaggcggagccgctgcccctgcgctgcctgcgcgaggcttgcgcgcaggtcccccggccgcggccgcccccgcagctgcgcagcctgcccttcgggacgctggagctaggcgacaccgcggctctggatgccttctacaacgcggatgtggtggtgctggaggtgagcagctcgctggtacagccctccctgttctaccaccttggtgtgcgtgagagcttcagcatgaccaacaatgtgctcctctgctcccaggccgacctccctgacctgcaggccctgcgggaggatgttttccagaagaactcggattgcgttggcagctacacactgatcccctatgtggtgacggccactggtcgggtgctgtgtggtgatgcaggccttctgcggggcctggctgatgggctggtacaggctggagtggggaccgaggccctgctcactcccctggtgggccggcttgcccgcctgctggaggccacacccacagactcttgtggctatttccgggagaccattcggcgggacatccggcaggcgcgggagcggttcagtgggccacagctgcggcaggagctggctcgcctgcagcggagactggacagcgtggagctgctgagccccgacatcatcatgaacttgctgctctcctaccgcgatgtgcaggactactcggccatcattgagctggtggagacgctgcaggccttgcccacctgtgatgtggccgagcagcataatgtctgcttccactacacttttgccctcaaccggaggaacaggcctggggaccgggcgaaggccctgtctgtgctgctgccgctggtacagcttgagggctctgtggcgcccgatctgtactgcatgtgtggccgtatctacaaggacatgttcttcagctcgggtttccaggatgctgggcaccgggagcaggcctatcactggtatcgcaaggcttttgacgtagagcccagccttcactcaggcatcaatgcagctgtgctcctcattgctgccgggcagcactttgaggattccaaagagctccggctaataggcatgaagctgggctgcctgctggcccgcaaaggctgcgtggagaagatgcagtattactgggatgtgggtttctacctgggagcccagatcctcgccaatgaccccacccaggtggtgctggctgcagagcagctgtataagctcaatgcccccatatggtacctggtgtccgtgatggagaccttcctgctctaccagcacttcaggcccacgccagagccccctggagggccaccacgccgtgcccacttctggctccacttcttgctacagtcctgccaaccattcaagacagcctgtgcccagggcgaccagtgcttggtgctggtcctggagatgaacaaggtgctgctgcctgcaaagctcgaggttcggggtactgacccagtaagcacagtgaccctgagcctgctggagcctgagacccaggacattccctccagctggaccttcccagtcgcctccatatgcggagtcagcgcctcaaagcgcgacgagcgctgctgcttcctctatgcactccccccggctcaggacgtccagctgtgcttccccagcgtagggcactgccagtggttctgcggcctgatccaggcctgggtgacgaacccggattccacggcgcccgcggaggaggcggagggcgcgggggagatgttggagtttgattatgagtacacggagacgggcgagcggctggtgctgggcaagggcacgtatggggtggtgtacgcgggccgcgatcgccacacgagggtgcgcatcgccatcaaggagatcccggagcgggacagcaggttctctcagcccctgcatgaagagatcgctcttcacagacgcctgcgccacaagaacatagtgcgctatctgggctcagctagccagggcggctaccttaagatcttcatggaggaagtgcctggaggcagcctgtcctccttgctgcggtcggtgtggggacccctgaaggacaacgagagcaccatcagtttctacacccgccagatcctgcagggacttggctacttgcacgacaaccacatcgtgcacagggacataaaaggggacaatgtgctgatcaacaccttcagtgggctgctcaagatttctgacttcggcacctccaagcggctggcaggcatcacaccttgcactgagaccttcacaggaactctgcagtatatggccccagaaatcattgaccagggcccacgcgggtatgggaaagcagctgacatctggtcactgggctgcactgtcattgagatggccacaggtcgcccccccttccacgagctcgggagcccacaggctgccatgtttcaggtgggtatgtacaaggtccatccgccaatgcccagctctctgtcggccgaggcccaagcctttctcctccgaacttttgagccagacccccgcctccgagccagcgcccagacactgctgggggaccccttcctgcagcctgggaaaaggagccgcagccccagctccccacgacatgctccacggccctcagatgccccttctgccagtcccactccttcagccaactcaaccacccagtctcagacattcccgtgccctcaggcaccctctcagcacccacccagccccccgaagcgctgcctcagttatgggggcaccagccagctccgggtgcccgaggagcctgcggccgaggagcctgcgtctccggaggagagttcggggctgagcctgctgcaccaggagagcaagcgtcgggccatgctggccgcagtattggagcaggagctgccagcgctggcggagaatctgcaccaggagcagaagcaagagcagggggcccgtctgggcagaaaccatgtggaagagctgctgcgctgcctcggggcacacatccacactcccaaccgccggcagctcgcccaggagctgcgggcgctgcaaggacggctgagggcccagggccttgggcctgcgcttctgcacagaccgctgtttgccttcccggatgcggtgaagcagatcctccgcaagcgccagatccgtccacactggatgttcgttctggactcactgctcagccgtgctgtgcgggcagccctgggtgtgctaggaccggaggtggagaaggaggcggtctcaccgaggtcagaggagctgagtaatgaaggggactcccagcagagcccaggccagcagagcccgcttccggtggagcccgagcagggccccgctcctctgatggtgcagctgagcctcttgagggcagagactgatcggctgcgcgaaatcctggcggggaaggaacgggagtaccaggccctggtgcagcgggctctacagcggctgaatgaggaagcccggacctatgtcctggccccagagcctccaactgctctttcaacggaccagggcctggtgcagtggctacaggaactgaatgtggattcaggcaccatccaaatgctgttgaaccatagcttcaccctccacactctgctcacctatgccactcgagatgacctcatctacacccgcatcaggggagggatggtatgccgcatctggagggccatcttggcacagcgagcaggatccacaccagtcacctctggaccctga

SEQ ID NO: 27 - DNA, 2844 bp, Homo sapiens
atggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggaggatgagtctccactcggcgccccatatgttagaaacaccccgcagttcaccaagcctctgaaggaaccaggccttgggcaactctgttttaagcagcttggcgagggcctacggccggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaggccaggcccacagcctgaccagcctggccaagacctgggcagcaaggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaagtgggaggtctgaagagcccttggaggggagaatataaagaaccaagacatccaccgccaaatcaagccaattaccaccagaccctccatgcccagccgagagagctttcgccaagggccccagggccccggccagctgaggagacaacaggcagagcccctaagctccagcctcctctcccaccagagcccccagagccaaacaagtctcctcccttgactttgagcaaggaggagtctgggatgtgggaacccttacctctgtcctccctggagccagcccctgccagaaaccccagctcaccagagcggaaagcaaccgtcccggagcaggaactgcagcagctggaaatagaattattcctcaacagcctgtcccagccattttctctggaggagcaggagcaaattctctcgtgcctcagcatcgacagcctctccctgtcggatgacagtgagaagaacccatcaaaggcctctcaaagctcgcgggacaccctgagctcaggcgtacactcctggagcagccaggccgaggctcgaagctccagctggaacatggtgctggcccgggggcggcccaccgacaccccaagctatttcaatggtgtgaaagtccaaatacagtctcttaatggtgaacacctgcacatccgggagttccaccgggtcaaagtgggagacatcgccactggcatcagcagccagatcccagctgcagccttcagcttggtcaccaaagacgggcagcctgttcgctacgacatggaggtgccagactcgggcatcgacctgcagtgcacactggcccctgatggcagcttcgcctggagctggagggtcaagcatggccagctggagaacaggccctaa

SEQ ID NO: 28 - DNA, 2265 bp, Homo sapiens
atgttttcaggggggtgtcatagccccgggtttggccgccccagccccgccttccccgccccggggagcccgccccctgccccgcgtccctgccgacaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatga

SEQ ID NO: 29 - DNA, 2907 bp, Homo sapiens
atggcagaagatgatccatatttgggaaggcctgaacaaatgtttcatttggatccttctttgactcatacaatatttaatccagaagtatttcaaccacagatggcactgccaacagatggcccataccttcaaatattagagcaacctaaacagagaggatttcgtttccgttatgtatgtgaaggcccatcccatggtggactacctggtgcctctagtgaaaagaacaagaagtcttaccctcaggtcaaaatctgcaactatgtgggaccagcaaaggttattgttcagttggtcacaaatggaaaaaatatccacctgcatgcccacagcctggtgggaaaacactgtgaggatgggatctgcactgtaactgctggacccaaggacatggtggtcggcttcgcaaacctgggtatacttcatgtgacaaagaaaaaagtatttgaaacactggaagcacgaatgacagaggcgtgtataaggggctataatcctggactcttggtgcaccctgaccttgcctatttgcaagcagaaggtggaggggaccggcagctgggagatcgggaaaaagagctaatccgccaagcagctctgcagcagaccaaggagatggacctcagcgtggtgcggctcatgtttacagcttttcttccggatagcactggcagcttcacaaggcgcctggaacccgtggtatcagacgccatctatgacagtaaagcccccaatgcatccaacttgaaaattgtaagaatggacaggacagctggatgtgtgactggaggggaggaaatttatcttctttgtgacaaagttcagaaagatgacatccagattcgattttatgaagaggaagaaaatggtggagtctgggaaggatttggagatttttcccccacagatgttcatagacaatttgccattgtcttcaaaactccaaagtataaagatattaatattacaaaaccagcctctgtgtttgtccagcttcggaggaaatctgacttggaaactagtgaaccaaaacctttcctctactatcctgaaatcaaagataaagaagaagtgcagaggaaacgtcagaagctcatgcccaatttttcggatagtttcggcggtggtagtggtgctggagctggaggcggaggcatgtttggtagtggcggtggaggagggggcactggaagtacaggtccagggtatagcttcccacactatggatttcctacttatggtgggattactttccatcctggaactactaaatctaatgctgggatgaagcatggaaccatggacactgaatctaaaaaggaccctgaaggttgtgacaaaagtgatgacaaaaacactgtaaacctctttgggaaagttattgaaaccacagagcaagatcaggagcccagcgaggccaccgttgggaatggtgaggtcactctaacgtatgcaacaggaacaaaagaagagagtgctggagttcaggataacctctttctagagaaggctatgcagcttgcaaagaggcatgccaatgcccttttcgactacgcggtgacaggagacgtgaagatgctgctggccgtccagcgccatctcactgctgtgcaggatgagaatggggacagtgtcttacacttagcaatcatccaccttcattctcaacttgtgagggatctactagaagtcacatctggtttgatttctgatgacattatcaacatgagaaatgatctgtaccagacgcccttgcacttggcagtgatcactaagcaggaagatgtggtggaggatttgctgagggctggggccgacctgagccttctggaccgcttgggtaactctgttttgcacctagctgccaaagaaggacatgataaagttctcagtatcttactcaagcacaaaaaggcagcactacttcttgaccaccccaacggggacggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggagggtgatgcccatgtggacagtactacctacgatggaaccacacccctgcatatagcagctgggagagggtccaccaggctggcagctcttctcaaagcagcaggagcagatcccctggtggagaactttgagcctctctatgacctggatgactcttgggaaaatgcaggagaggatgaaggagttgtgcctggaaccacgcctctagatatggccaccagctggcaggtatttgacatattaaatgggaaaccatatgagccagagtttacatctgatgatttactagcacaaggagacatgaaacagctggctgaagatgtgaagctgcagctgtataagttactagaaattcctgatccagacaaaaactgggctactctggcgcagaaattaggtctggggatacttaataatgccttccggctgagtcctgctccttccaaaacacttatggacaactatgaggtctctgggggtacagtcagagagctggtggaggccctgagacaaatgggctacaccgaagcaattgaagtgatccaggcagcctccagcccagtgaagaccacctctcaggcccactcgctgcctctctcgcctgcctccacaaggcagcaaatagacgagctccgagacagtgacagtgtctgcgacagcggcgtggagacatccttccgcaaactcagctttaccgagtctctgaccagtggtgcctcactgctaactctcaacaaaatgccccatgattatgggcaggaaggacctctagaaggcaaaatttag

SEQ ID NO: 30 - DNA, 1128 bp, Homo sapiens
atggagcgcgcgtcctgcttgttgctgctgctgctgccgctggtgcacgtctctgcgaccacgccagaaccttgtgagctggacgatgaagatttccgctgcgtctgcaacttctccgaacctcagcccgactggtccgaagccttccagtgtgtgtctgcagtagaggtggagatccatgccggcggtctcaacctagagccgtttctaaagcgcgtcgatgcggacgccgacccgcggcagtatgctgacacggtcaaggctctccgcgtgcggcggctcacagtgggagccgcacaggttcctgctcagctactggtaggcgccctgcgtgtgctagcgtactcccgcctcaaggaactgacgctcgaggacctaaagataaccggcaccatgcctccgctgcctctggaagccacaggacttgcactttccagcttgcgcctacgcaacgtgtcgtgggcgacagggcgttcttggctcgccgagctgcagcagtggctcaagccaggcctcaaggtactgagcattgcccaagcacactcgcctgccttttcctgcgaacaggttcgcgccttcccggcccttaccagcctagacctgtctgacaatcctggactgggcgaacgcggactgatggcggctctctgtccccacaagttcccggccatccagaatctagcgctgcgcaacacaggaatggagacgcccacaggcgtgtgcgccgcactggcggcggcaggtgtgcagccccacagcctagacctcagccacaactcgctgcgcgccaccgtaaaccctagcgctccgagatgcatgtggtccagcgccctgaactccctcaatctgtcgttcgctgggctggaacaggtgcctaaaggactgccagccaagctcagagtgctcgatctcagctgcaacagactgaacagggcgccgcagcctgacgagctgcccgaggtggataacctgacactggacgggaatcccttcctggtccctggaactgccctcccccacgagggctcaatgaactccggcgtggtcccagcctgtgcacgttcgaccctgtcggtgggggtgtcgggaaccctggtgctgctccaaggggcccggggctttgcctaa

SEQ ID NO: 31 - DNA, 480 bp, Homo sapiens
atgcgacccgaccgcgctgaggctccaggaccgcccgccatggctgcaggaggtcccggcgcggggtctgcggccccggtctcctccacatcctcccttcccctggctgctctcaacatgcgagtgcggcgccgcctgtctctgttcttgaacgtgcggacacaggtggcggccgactggaccgcgctggcggaggagatggactttgagtacttggagatccggcaactggagacacaagcggaccccactggcaggctgctggacgcctggcagggacgccctggcgcctctgtaggccgactgctcgagctgcttaccaagctgggccgcgacgacgtgctgctggagctgggacccagcattggtgccgccggatggtggtggttgtctctgatgattacctgcagagcaaggaatgtgacttccagaccaaatttgcactcagcctctctccaggtgcccatcagaagcgactga

SEQ ID NO: 32 - DNA, 2049 bp, Homo sapiens
atggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggtcccaagccctgcttccctgtggcctccaccgccatctccagccccttcttctaccaagccaggcccagagagctcagtgtccctcctgcagggagcccgcccctttccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctga

SEQ ID NO: 33 - DNA, 1446 bp, Homo sapiens
atgggggccttggccagagccctgccgtccatactgctggcattgctgcttacgtccaccccagaggctctgggtgccaaccccggcttggtcgccaggatcaccgacaagggactgcagtatgcggcccaggaggggctattagctctgcagagtgagctgctcaggatcacgctgcctgacttcaccggggacttgaggatcccccacgtcggccgtgggcgctatgagttccacagcctgaacatccacagctgtgagctgcttcactctgcgctgaggcctgtccctggccagggcctgagtctcagcatctccgactcctccatccgggtccagggcaggtggaaggtgcgcaagtcattcttcaaactacagggctcctttgatgtcagtgtcaagggcatcagcatttcggtcaacctcctgttgggcagcgagtcctccgggaggcccacagttactgcctccagctgcagcagtgacatcgctgacgtggaggtggacatgtcgggagacttggggtggctgttgaacctcttccacaaccagattgagtccaagttccagaaagtactggagagcaggatttgcgaaatgatccagaaatcagtgtcctccgatctacagccttatctccaaactctgccagttacaacagagattgacagtttcgccgacattgattatagcttagtggaagcccctcgggcaacagcccagatgctggaggtgatgtttaagggtgaaatctttcatcgtaaccaccgttctccagttaccctccttgctgcagtcatgagccttcctgaggaacacaacaaaatggtctactttgccatctcggattatgtcttcaacacggccagcctggtttatcatgaggaaggatatctgaacttctccatcacagatgacatgataccgcctgactctaatatccgactgaccaccaagtccttccgacccttcgtcccacggttagccaggctctaccccaacatgaacctggaactccagggatcagtgccctctgctccgctcctgaacttcagccctgggaatctgtctgtggacccctatatggagatagatgcctttgtgctcctgcccagctccagcaaggagcctgtcttccggctcagtgtggccactaatgtgtccgccaccttgaccttcaataccagcaagatcactgggttcctgaagccaggaaaggtaaaagtggaactgaaagaatccaaagttggactattcaatgcagagctgttggaagcgctcctcaactattacatccttaacaccttctaccccaagttcaatgataagttggccgaaggcttcccccttcctctgctgaagcgtgttcagctctacgaccttgggctgcagatccataaggacttcctgttcttgggtgccaatgtccaatacatgagagtttga

SEQ ID NO: 34 - DNA, 1569 bp, Homo sapiens
atgagtctgctaaactgtgaaaacagctgtggatccagccagtctgaaagtgactgctgtgtggccatggccagctcctgtagcgctgtaacaaaagatgatagtgtgggtggaactgccagcacggggaacctctccagctcatttatggaggagatccagggatatgatgtagagtttgacccacccctggaaagcaagtatgaatgccccatctgcttgatggcattacgagaagcagtgcaaacgccatgcggccataggttctgcaaagcctgcatcataaaatcaataagggatgcaggtcacaaatgtccagttgacaatgaaatactgctggaaaatcaactatttccagacaattttgcaaaacgtgagattctttctctgatggtgaaatgtccaaatgaaggttgtttgcacaagatggaactgagacatcttgaggatcatcaagcacattgtgagtttgctcttatggattgtccccaatgccagcgtcccttccaaaaattccatattaatattcacattctgaaggattgtccaaggagacaggtttcttgtgacaactgtgctgcatcaatggcatttgaagataaagagatccatgaccagaactgtcctttggcaaatgtcatctgtgaatactgcaatactatactcatcagagaacagatgcctaatcattatgatctagactgccctacagccccaattccatgcacattcagtacttttggttgccatgaaaagatgcagaggaatcacttggcacgccacctacaagagaacacccagtcacacatgagaatgttggcccaggctgttcatagtttgagcgttatacccgactctgggtatatctcagaggtccggaatttccaggaaactattcaccagttagagggtcgccttgtaagacaagaccatcaaatccgggagctgactgctaaaatggaaactcagagtatgtatgtaagtgagctcaaacgaaccattcgaacccttgaggacaaagttgctgaaatcgaagcacagcagtgcaatggaatttatatttggaagattggcaactttggaatgcatttgaaatgtcaagaagaggagaaacctgttgtgattcatagccctggattctacactggcaaacccgggtacaaactgtgcatgcgcttgcaccttcagttaccgactgctcagcgctgtgcaaactatatatccctttttgtccacacaatgcaaggagaatatgacagccacctcccttggcccttccagggtacaatacgccttacaattcttgatcagtctgaagcacctgtaaggcaaaaccacgaagagataatggatgccaaaccagagctgcttgctttccagcgacccacaatcccacggaacccaaaaggttttggctatgtaacttttatgcatctggaagccctaagacaaagaactttcattaaggatgacacattattagtgcgctgtgaggtctccacccgctttgacatgggtagccttcggagggagggttttcagccacgaagtactgatgcaggggtatag

SEQ ID NO: 35 - DNA, 567 bp, Homo sapiens
atgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaa

SEQ ID NO: 36 - DNA, 570 bp, Homo sapiens
atgactgagtacaaactggtggtggttggagcaggtggtgttgggaaaagcgcactgacaatccagctaatccagaaccactttgtagatgaatatgatcccaccatagaggattcttacagaaaacaagtggttatagatggtgaaacctgtttgttggacatactggatacagctggacaagaagagtacagtgccatgagagaccaatacatgaggacaggcgaaggcttcctctgtgtatttgccatcaataatagcaagtcatttgcggatattaacctctacagggagcagattaagcgagtaaaagactcggatgatgtacctatggtgctagtgggaaacaagtgtgatttgccaacaaggacagttgatacaaaacaagcccacgaactggccaagagttacgggattccattcattgaaacctcagccaagaccagacagggtgttgaagatgctttttacacactggtaagagaaatacgccagtaccgaatgaaaaaactcaacagcagtgatgatgggactcagggttgtatgggattgccatgtgtggtgatgtaa

SEQ ID NO: 37 - DNA, 2514 bp, Homo sapiens
atggctagcaaacgaaaatctacaactccatgcatggttcggacatcacaagtagtagaacaagatgtgcccgaggaagtagacagggccaaagagaaaggaatcggcacaccacagcctgacgtggccaaggacagttgggcagcagaacttgaaaactcttccaaagaaaacgaagtgatagaggtgaaatctatgggggaaagccagtccaaaaaactccaaggtggttatgagtgcaaatactgcccctactccacgcaaaacctgaacgagttcacggagcatgtcgacatgcagcatcccaacgtgattctcaaccccctctacgtgtgtgcagaatgtaacttcacaaccaaaaagtacgactccctatccgaccacaactccaagttccatcccggggaggccaacttcaagctgaagttaattaaacgcaataatcaaactgtcttggaacagtccatcgaaaccaccaaccatgtcgtgtccatcaccaccagtggccctggaactggtgacagtgattctgggatctcggtgagtaaaacccccatcatgaagcctggaaaaccaaaagcggatgccaagaaggtgcccaagaagcccgaggagatcacccccgagaaccacgtggaagggaccgcccgcctggtgacagacacagctgagatcctctcgagactcggcggggtggagctcctccaagacacattaggacacgtcatgccttctgtacagctgccaccaaatatcaaccttgtgcccaaggtccctgtcccactaaatactaccaaatacaactctgccctggatacaaatgccacgatgatcaactctttcaacaagtttccttacccgacccaggctgagttgtcctggctgacagctgcctccaaacacccagaggagcacatcagaatctggtttgccacccagcgcttaaagcatggcatcagctggtccccagaagaggtggaggaggcccggaagaagatgttcaacggcaccatccagtcagtacccccgaccatcactgtgctgcccgcccagttggcccccacaaaggtgacgcagcccatcctccagacggctctaccgtgccagatcctcggccagactagcctggtgctgactcaggtgaccagcgggtcaacaaccgtctcttgctcccccatcacacttgccgtggcaggagtcaccaaccatggccagaagagacccttggtgactccccaagctgcccccgaacccaagcgtccacacatcgctcaggtgccagagcccccacccaaggtggccaaccccccgctcacaccagccagtgaccgcaagaagacaaaggagcagatagcacatctcaaggccagctttctccagagccagttccctgacgatgccgaggtttaccggctcatcgaggtgactggccttgccaggagcgagatcaagaagtggttcagtgaccaccgatatcggtgtcaaaggggcatcgtccacatcaccagcgaatcccttgccaaagaccagttggccatcgcggcctcccgacacggtcgcacgtatcatgcgtacccagactttgccccccagaagttcaaagagaaaacacagggtcaggttaaaatcttggaagacagctttttgaaaagttcttttcctacccaagcagaactggatcggctaagggtggagaccaagctgagcaggagagagatcgactcctggttctcggagaggcggaagcttcgagacagcatggaacaagctgtcttggattccatggggtctggcaaaaaaggccaagatgtgggagcccccaatggtgctctgtctcgactcgaccagctctccggtgcccagttaacaagttctctgcccagcccttcgccagcaattgcaaaaagtcaagaacaggttcatctcctgaggagcacgtttgcaagaacccagtggcctactccccaggagtacgaccagttagcggccaagactggcctggtccgaactgagattgtgcgttggttcaaggagaacagatgcttgctgaaaacgggaaccgtgaagtggatggagcagtaccagcaccagcccatggcagatgatcacggctacgatgccgtagcaaggaaagcaacaaaacccatggccgagagcccaaagaacgggggtgatgtggttccacaatattacaaggaccccaaaaagctctgcgaagaggacttggagaagttggtgaccagggtaaaagtaggcagcgagccagcaaaagactgtttgccagcaaagccctcagaggccacctcagaccggtcagagggcagcagccgggacggccagggtagcgacgagaacgaggagtcgagcgttgtggattacgtggaggtgacggtcggggaggaggatgcgatctcagatagatcagatagctggagtcaggctgcggcagaaggtgtgtcggaactggctgaatcagactccgactgcgtccctgcagaggctggccaggcctag

SEQ ID NO: 38 - DNA, 1182 bp, Homo sapiens
atgcccaagaagaagccgacgcccatccagctgaacccggcccccgacggctctgcagttaacgggaccagctctgcggagaccaacttggaggccttgcagaagaagctggaggagctagagcttgatgagcagcagcgaaagcgccttgaggcctttcttacccagaagcagaaggtgggagaactgaaggatgacgactttgagaagatcagtgagctgggggctggcaatggcggtgtggtgttcaaggtctcccacaagccttctggcctggtcatggccagaaagctaattcatctggagatcaaacccgcaatccggaaccagatcataagggagctgcaggttctgcatgagtgcaactctccgtacatcgtgggcttctatggtgcgttctacagcgatggcgagatcagtatctgcatggagcacatggatggaggttctctggatcaagtcctgaagaaagctggaagaattcctgaacaaattttaggaaaagttagcattgctgtaataaaaggcctgacatatctgagggagaagcacaagatcatgcacagagatgtcaagccctccaacatcctagtcaactcccgtggggagatcaagctctgtgactttggggtcagcgggcagctcatcgactccatggccaactccttcgtgggcacaaggtcctacatgtcgccagaaagactccaggggactcattactctgtgcagtcagacatctggagcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctcatacggaatggacagccgacctcccatggcaatttttgagttgttggattacatagtcaacgagcctcctccaaaactgcccagtggagtgttcagtctggaatttcaagattttgtgaataaatgcttaataaaaaaccccgcagagagagcagatttgaagcaactcatggttcatgcttttatcaagagatctgatgctgaggaagtggattttgcaggttggctctgctccaccatcggccttaaccagcccagcacaccaacccatgctgctggcgtctaa

SEQ ID NO: 39 - DNA, 1203 bp, Homo sapiens
atgctggcccggaggaagccggtgctgccggcgctcaccatcaaccctaccatcgccgagggcccatcccctaccagcgagggcgcctccgaggcaaacctggtggacctgcagaagaagctggaggagctggaacttgacgagcagcagaagaagcggctggaagcctttctcacccagaaagccaaggtcggcgaactcaaagacgatgacttcgaaaggatctcagagctgggcgcgggcaacggcggggtggtcaccaaagtccagcacagaccctcgggcctcatcatggccaggaagctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatggacggcggctccctggaccaggtgctgaaagaggccaagaggattcccgaggagatcctggggaaagtcagcatcgcggttctccggggcttggcgtacctccgagagaagcaccagatcatgcaccgagatgtgaagccctccaacatcctcgtgaactctagaggggagatcaagctgtgtgacttcggggtgagcggccagctcatcgactccatggccaactccttcgtgggcacgcgctcctacatggctccggagcggttgcagggcacacattactcggtgcagtcggacatctggagcatgggcctgtccctggtggagctggccgtcggaaggtaccccatccccccgcccgacgccaaagagctggaggccatctttggccggcccgtggtcgacggggaagaaggagagcctcacagcatctcgcctcggccgaggccccccgggcgccccgtcagcggtcacgggatggatagccggcctgccatggccatctttgaactcctggactatattgtgaacgagccacctcctaagctgcccaacggtgtgttcacccccgacttccaggagtttgtcaataaatgcctcatcaagaacccagcggagcgggcggacctgaagatgctcacaaaccacaccttcatcaagcggtccgaggtggaagaagtggattttgccggctggttgtgtaaaaccctgcggctgaaccagcccggcacacccacgcgcaccgccgtgtga

SEQ ID NO: 40 - DNA, 1074 bp, Homo sapiens
atggcggcggcggcggctcaggggggcgggggcggggagccccgtagaaccgagggggtcggcccgggggtcccgggggaggtggagatggtgaaggggcagccgttcgacgtgggcccgcgctacacgcagttgcagtacatcggcgagggcgcgtacggcatggtcagctcggcctatgaccacgtgcgcaagactcgcgtggccatcaagaagatcagccccttcgaacatcagacctactgccagcgcacgctccgggagatccagatcctgctgcgcttccgccatgagaatgtcatcggcatccgagacattctgcgggcgtccaccctggaagccatgagagatgtctacattgtgcaggacctgatggagactgacctgtacaagttgctgaaaagccagcagctgagcaatgaccatatctgctacttcctctaccagatcctgcggggcctcaagtacatccactccgccaacgtgctccaccgagatctaaagccctccaacctgctcatcaacaccacctgcgaccttaagatttgtgatttcggcctggcccggattgccgatcctgagcatgaccacaccggcttcctgacggagtatgtggctacgcgctggtaccgggccccagagatcatgctgaactccaagggctataccaagtccatcgacatctggtctgtgggctgcattctggctgagatgctctctaaccggcccatcttccctggcaagcactacctggatcagctcaaccacattctgggcatcctgggctccccatcccaggaggacctgaattgtatcatcaacatgaaggcccgaaactacctacagtctctgccctccaagaccaaggtggcttgggccaagcttttccccaagtcagactccaaagcccttgacctgctggaccggatgttaacctttaaccccaataaacggatcacagtggaggaagcgctggctcacccctacctggagcagtactatgacccgacggatgaggtgggccagtccccagcagcagtggggctgggggcaggggagcaggggggcacgtag

SEQ ID NO: 41 - DNA, 1083 bp, Homo sapiens
atggcggcggcggcggcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaa

SEQ ID NO: 42 - DNA, 954 bp, Homo sapiens
atgttccaggcggccgagcgcccccaggagtgggccatggagggcccccgcgacgggctgaagaaggagcggctactggacgaccgccacgacagcggcctggactccatgaaagacgaggagtacgagcagatggtcaaggagctgcaggagatccgcctcgagccgcaggaggtgccgcgcggctcggagccctggaagcagcagctcaccgaggacggggactcgttcctgcacttggccatcatccatgaagaaaaggcactgaccatggaagtgatccgccaggtgaagggagacctggccttcctcaacttccagaacaacctgcagcagactccactccacttggctgtgatcaccaaccagccagaaattgctgaggcacttctgggagctggctgtgatcctgagctccgagactttcgaggaaatacccccctacaccttgcctgtgagcagggctgcctggccagcgtgggagtcctgactcagtcctgcaccaccccgcacctccactccatcctgaaggctaccaactacaatggccacacgtgtctacacttagcctctatccatggctacctgggcatcgtggagcttttggtgtccttgggtgctgatgtcaatgctcaggagccctgtaatggccggactgcccttcacctcgcagtggacctgcaaaatcctgacctggtgtcactcctgttgaagtgtggggctgatgtcaacagagttacctaccagggctattctccctaccagctcacctggggccgcccaagcacccggatacagcagcagctgggccagctgacactagaaaaccttcagatgctgccagagagtgaggatgaggagagctatgacacagagtcagagttcacggagttcacagaggacgagctgccctatgatgactgtgtgtttggaggccagcgtctgacgttatga

SEQ ID NO: 43 - DNA, 1443 bp, Homo sapiens
atgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctga

SEQ ID NO: 44 - DNA, 957 bp, Homo sapiens
atgtccaagccacccgcacccaaccccacacccccccggaacctggactcccggaccttcatcaccattggagacagaaactttgaggtggaggctgatgacttggtgaccatctcagaactgggccgtggagcctatggggtggtagagaaggtgcggcacgcccagagcggcaccatcatggccgtgaagcggatccgggccaccgtgaactcacaggagcagaagcggctgctcatggacctggacatcaacatgcgcacggtcgactgtttctacactgtcaccttctacggggcactattcagagagggagacgtgtggatctgcatggagctcatggacacatccttggacaagttctaccggaaggtgctggataaaaacatgacaattccagaggacatccttggggagattgctgtgtctatcgtgcgggccctggagcatctgcacagcaagctgtcggtgatccacagagatgtgaagccctccaatgtccttatcaacaaggagggccatgtgaagatgtgtgactttggcatcagtggctacttggtggactctgtggccaagacgatggatgccggctgcaagccctacatggcccctgagaggatcaacccagagctgaaccagaagggctacaatgtcaagtccgacgtctggagcctgggcatcaccatgattgagatggccatcctgcggttcccttacgagtcctgggggaccccgttccagcagctgaagcaggtggtggaggagccgtccccccagctcccagccgaccgtttctcccccgagtttgtggacttcactgctcagtgcctgaggaagaaccccgcagagcgtatgagctacctggagctgatggagcaccccttcttcaccttgcacaaaaccaagaagacggacattgctgccttcgtgaaggagatcctgggagaagactcatag

SEQ ID NO: 45 - DNA, 837 bp, Homo sapiens
atggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatgtgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagagacgtcaagccttctaatgtactcatcaatgctctcggtcaagtgaagatgtgcgattttggaatcagtggctacttggtggactctgttgctaaaacaattgatgcaggttgcaaaccatacatggcccctgaaagaataaacccagagctcaaccagaagggatacagtgtgaagtctgacatttggagtctgggcatcacgatgattgagttggccatccttcgatttccctatgattcatggggaactccatttcagcagctcaaacaggtggtagaggagccatcgccacaactcccagcagacaagttctctgcagagtttgttgactttacctcacagtgcttaaagaagaattccaaagaacggcctacatacccagagctaatgcaacatccatttttcaccctacatgaatccaaaggaacagatgtggcatcttttgtaaaactgattcttggagactaa

SEQ ID NO: 46 - DNA, 1083 bp, Homo sapiens
atgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattaaccagcttcagcagattatgcgtctgacaggaacaccccccgcttatctcattaacaggatgccaagccatgaggcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctga

SEQ ID NO: 47 - DNA, 1656 bp, Homo sapiens
atggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggtttggcatggattttaaagaaatagaattaattggctcaggtggatttggccaagttttcaaagcaaaacacagaattgacggaaagacttacgttattaaacgtgttaaatataataacgagaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaagccaagtaatatattcttagtagatacaaaacaagtaaagattggagactttggacttgtaacatctctgaaaaatgatggaaagcgaacaaggagtaagggaactttgcgatacatgagcccagaacagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttag

SEQ ID NO: 48 - DNA, 2892 bp, Homo sapiens
atggcggctcagcggatccgagcggccaactccaatggcctccctcgctgcaagtcagaggggaccctgattgacctgagcgaagggttttcagagacgagctttaatgacatcaaagtgccttctcccagtgccttgctcgtagacaaccccacacctttcggaaatgcaaaggaagtgattgcgatcaaggactattgccccaccaacttcaccacactgaagttctccaagggcgaccatctctacgtcttggacacatctggcggtgagtggtggtacgcacacaacaccaccgaaatgggctacatcccctcctcctatgtgcagcccttgaactaccggaactcaacactgagtgacagcggtatgattgataatcttccagacagcccagacgaggtagccaaggagctggagctgctcgggggatggacagatgacaaaaaagtaccaggcagaatgtacagtaataaccctttctggaatggggtccagaccaatccatttctgaatgggaacgtgcccgtcatgcccagcctggatgagctgaatcccaaaagtactgtggatttgctcctttttgacgcaggtacatcctccttcaccgaatccagctcagccaccacgaatagcactggcaacatcttcgatgagcttccagtcacaaacggactccacgcagagccgccggtcaggcgggacaaccccttcttcagaagcaagcgctcctacagtctctcggaactctccgtcctccaagccaagtccgatgctcccacatcgtcgagtttcttcaccggcttgaaatcacctgcccccgagcaatttcagagccgggaggattttcgaactgcctggctaaaccacaggaagctggcccggtcttgccacgacctggacttgcttggccaaagccctggttggggccagacccaagccgtggagacaaacatcgtgtgcaagctggatagctccgggggtgctgtccagcttcctgacaccagcatcagcatccacgtgcccgagggccacgtcgcccctggggagacccagcagatctccatgaaagccctgctggaccccccgctggagctcaacagtgacaggtcctgcagcatcagccctgtgctggaggtcaagctgagcaacctggaggtgaaaacctctatcatcttggagatgaaagtgtcagccgagataaaaaatgacctttttagcaaaagcacagtgggcctccagtgcctgaggagcgactcgaaggaagggccatatgtctccgtcccgctcaactgcagctgtggggacacggtccaggcacagctgcacaacctggagccctgtatgtacgtggctgtcgtggcccatggcccaagcatcctctacccttccaccgtgtgggacttcatcaataaaaaagtcacagtgggtctctacggccctaaacacatccacccatccttcaagacggtagtgaccatttttgggcatgactgtgccccaaagacgctcctggtcagcgaggtcacacgccaggcacccaaccctgccccggtggccctgcagctgtgggggaagcaccagttcgttttgtccaggccccaggatctcaaggtctgtatgttttccaatatgacgaattacgaggtcaaagccagcgagcaggccaaagtggtgcgaggattccagctgaagctgggcaaggtgagccgcctgatcttccccatcacctcccagaaccccaacgagctctctgacttcacgctgcgggttcaggtgaaggacgaccaggaggccatcctcacccagttttgtgtccagactcctcagccaccccctaaaagtgccatcaagccttccgggcaaaggaggtttctcaagaagaacgaagtcgggaaaatcatcctgtccccgtttgccaccactacaaagtacccgactttccaggaccgcccggtgtccagcctcaagtttggtaagttgctcaagactgtggtgcggcagaacaagaaccactacctgctggagtacaagaagggcgacgggatcgccctgctcagcgaggagcgggtcaggctccggggccagctgtggaccaaggagtggtacatcggctactaccagggcagggtgggcctcgtgcacaccaagaacgtgctggtggtcggcagggcccggcccagcctgtgctcgggccccgagctgagcacctcggtgctgctggagcagatcctgcggccctgcaaattcctcacgtacatctatgcctccgtgaggaccctgctcatggagaacatcagcagctggcgctccttcgctgacgccctgggctacgtgaacctgccgctcacctttttctgccgggcagagctggatagtgagcccgagcgggtggcgtccgtcctagaaaagctgaaggaggactgtaacaacactgagaacaaagaacggaagtccttccagaaggagcttgtgatggccctactgaagatggactgccagggcctggtggtcagactcatccaggactttgtgctcctgaccacggctgtagaggtggcccagcgctggcgggagctggctgagaagctggccaaggtctccaagcagcagatggacgcctacgagtctccccaccgggacaggaacggggttgtggacagcgaggccatgtggaagcctgcgtatgacttcttactcacctggagccatcagatcggggacagctaccgggatgtcatccaggagctgcacctgggcctggacaagatgaaaaaccccatcaccaagcgctggaagcacctcactgggactctgatcttggtgaactccctggacgttctgagagcagccgccttcagccctgcggaccaggacgacttcgtgatttga

SEQ ID NO: 49 - DNA, 1113 bp, Homo sapiens
atgctgtccaactcccagggccagagcccgccggtgccgttccccgccccggccccgccgccgcagccccccacccctgccctgccgcaccccccggcgcagccgccgccgccgcccccgcagcagttcccgcagttccacgtcaagtccggcctgcagatcaagaagaacgccatcatcgatgactacaaggtcaccagccaggtcctggggctgggcatcaacggcaaagttttgcagatcttcaacaagaggacccaggagaaattcgccctcaaaatgcttcaggactgccccaaggcccgcagggaggtggagctgcactggcgggcctcccagtgcccgcacatcgtacggatcgtggatgtgtacgagaatctgtacgcagggaggaagtgcctgctgattgtcatggaatgtttggacggtggagaactctttagccgaatccaggatcgaggagaccaggcattcacagaaagagaagcatccgaaatcatgaagagcatcggtgaggccatccagtatctgcattcaatcaacattgcccatcgggatgtcaagcctgagaatctcttatacacctccaaaaggcccaacgccatcctgaaactcactgactttggctttgccaaggaaaccaccagccacaactctttgaccactccttgttatacaccgtactatgtggctccagaagtgctgggtccagagaagtatgacaagtcctgtgacatgtggtccctgggtgtcatcatgtacatcctgctgtgtgggtatccccccttctactccaaccacggccttgccatctctccgggcatgaagactcgcatccgaatgggccagtatgaatttcccaacccagaatggtcagaagtatcagaggaagtgaagatgctcattcggaatctgctgaaaacagagcccacccagagaatgaccatcaccgagtttatgaaccacccttggatcatgcaatcaacaaaggtccctcaaaccccactgcacaccagccgggtcctgaaggaggacaaggagcggtgggaggatgtcaaggggtgtcttcatgacaagaacagcgaccaggccacttggctgaccaggttgtga

SEQ ID NO: 50 - DNA, 5928 bp, Homo sapiens
ggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcaggaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagaatccaggagtcctccagctgagaacgaggtgtccacccccatgcaggcacttactactaataaagacgatgataatattctcttcagagattctgcaaatgcgacaagcctcccagtgcaagattcttcttcagtaccactgcccacattcctggttgctggagggagcctggccttcggaacgctcctctgcattgccattgttctgaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatagctggctgggtggcaccagcagcctggaccctgtggatgataaaacacaaacgggctcagcaaaagatgcttctcactgccatgccagcttatctcaggggtgtgcggcctttggcttcacggaagagccttgcggaaggttctacgccaggggaaaatcagcctgctccagctgttcagctggttgaggtttcaaacctccctttccaaatgcccagcttaaaggggctagagtgaacttgggccactgtgaagagaaccatatcaagactctttggacactcacacggacactcaaaagctgggcaggttggtgggggcctcggtgtggagaagcggctggcagcccacccctcaacacctctgcacaagctgcaccctcaggcaggtgggatggatttccagccaaagcctcctccagccgccatgctcctggcccactgcatcgtttcatcttccaactcaaactcttaaaacccaagtgccttagcaaattctgtttttctaggcctggggacggcttttacttaaaccgccaaggctgggggaagaagctctctcctccctttcttccctacagttgaaaaacagctgagggtgagtgggtgaataatacagtatctcagggcctggtcgttttcaacagaattataattagttcctcattagcattttgctaaatgtgaatgatgatcctaggcatttgctgaatacagaggcaactgcattggctttgggttgcaggacctcaggtgagaagcagaggaaggagaggagaggggcacagggtctctaccatcccctgtagagtgggagctgagtgggggatcacagcctctgaaaaccaatgttctctcttctccacctcccacaaaggagagctagcagcagggagggcttctgccatttctgagatcaaaacggttttactgcagctttgtttgttgtcagctgaacctgggtaactagggaagataatattaaggaagacaatgtgaaaagaaaaatgagcctggcaagaatgtgtttaaacttggtttttaaaaaactgctgactgttttctcttgagagggtggaatatccaatattcgctgtgtcagcatagaagtaacttacttaggtgtgggggaagcaccataactttgtttagcccaaaaccaagtcaagtgaaaaaggaggaagagaaaaaatattttcctgccaggcatggtggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtcccagatacttggggggctgaggtgggaggatctcttgagcctgggaggtcaaggctgcagtgagccgagattgcaccactgcactccagcctgggtgacagagcaagtgagaccctgtctcaaaaaaagaaaaagaaaaagaaaaaatattttccctattagagaagagattgtggtttcattctgtattttgtttttgtcttaaaaagtggaaaaatagcctgcctcttctctactctagggaaaaaccagcgtgtgactactcccccaggtggttatggagagggtgtccggtccctgtcccagtgccgagaaggaagcctcccacgactgcccggcagggtcctagaaattccccaccctgaaagccctgagctttctgctatcaaagaggttttaaaaaaatcccatttaaaaaaaatcccttacctcggtgccttcctctttttatttagttccttgagttgattcagctctgcaagaattgaagcaggactaaatgtctagttgtaacaccatgattaaccacttcagctgacttttctgtccgagctttgaaaattcagtggtgttagtggttacccagttagctctcaagttatcagggtattccagagtggggatatgatttaaatcagccgtgtaaccatggacccaatatttaccagaccacaaaacttttctaatactctaccctcttagaaaaaccaccaccatcaccagacaggtgcgaaaggatgaaagtgaccatgttttgtttacggttttccaggtttaagctgttactgtcttcagtaagccgtgattttcattgctgggcttgtctgtagattttagaccctattgctgcttgaggcaactcatcttaggttggcaaaaaggcaggatggccgggcgcggtggctcacgcctgtaatcctagcactttgggaggccaaggtgggaggattgcttgagctcaggagtttgagaccaacctgggtaacatagtgagacaccatctctattatgaacaataacagttaagaaaaaaaaaggcaggcaggcggttatggtggttccctcccatcccaccacataaagtttctgagacttgagaacagcaaaatgctgttaaagggaaatattaagaatgagaatctgcagtaagggtgattctgtgcccacagttcttcaattctttataccgttttacccacatgtggtgttaccaaagccgggcagaaccatgctagcggaagatgtgaaatccagatagctcattattgccaagagctaggcagctttgatctccaaattgttattgctttcatttttattgtaatggaattgctttgttttgtttttttgtttttgtattgaagagggttgttttccctttatttttcataagctaatgtaaatgaagaaaaaatgtcttctctgggctgtaggcctggctcagcgtacacaggtatacatcctaagctctctatgttctctaatctgtggtgactgaacatgtgtctcaatgcacggggcatttctacctgtgtttctgcagcacccccactgccttgagtccccagcagtgctgttatttgcctaacacctgtagccatctgccacgcagccagacgtgaaacgctgagacagagaccatttaggttaaatacgacagcttatcctgctgggtggggaaagtaaaaaatatgctggttcaaggcctaaagtaaaatgatcaataatgtttgtagcattaatgaaatattttcaagaaatgtgtccaggggtagcactggctatgttgacgaggcctttggtaactcagagagctcttggccctgatggggacttgcccttacgctttctttatcaggctctgagttcacacggagcctctggcacttccctgctgtcttgggagaaaggaaactggttgccgcggcaggttgtggaatctgttgctggaaccaggctggaagcccacctggtagtgaacagggcccagtggggcaggctgggcatgttgtggtctatgggtttgtttcctggagaatgttcaggaatgtcttcccagctgctttggtgctgagctctattatctcacagcacgtccagaaggctaacccaggtggggaggatgctgacaccagctccaggtggagttggtggtcttaatttggagatgcaggggcaacctgtgaccctttgaggcaagagccctgcacccagctgtcccgtgcagccgtgggcaggggctgcacacggaggggcaggcgggccagttcagggtccgtgccaggccctcctcagtgccctgtgaaggcctcctgtcctccgtgcggctgggcaccagcaccagggagtttctatggcaaccttagtgattattaaggaacactgtcagttttatgaacatatgctcaaatgaaattctactttaggaggaaaggattggaacagcatgtcacaaggctgttaattaacagagagaccttattggatggagatcacatctgttaaatagaatacctcaactctacgttgttttcttggagataaataatagtttcaagtttttgtttgtttgttttacctaattacctgaaagcaaataccaaaggctgatgtctgtatatggggcaaagggtcagtatatttttcagtgtttttttttctaccagctattttgcatttaaagtgaacattgtgtttggaataaatactcttaaaaaataaaaaaaaaaaaaaa

SEQ ID NO: 51 - DNA, 5834 bp, Homo sapiens
ggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcaggaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagaatccaggagtcctccagctgagaacgaggtgtccacccccatgcaggcacttactactaataaagacgatgataatattctcttcagagattctgcaaatgcgacaagcctcccaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatagctggctgggtggcaccagcagcctggaccctgtggatgataaaacacaaacgggctcagcaaaagatgcttctcactgccatgccagcttatctcaggggtgtgcggcctttggcttcacggaagagccttgcggaaggttctacgccaggggaaaatcagcctgctccagctgttcagctggttgaggtttcaaacctccctttccaaatgcccagcttaaaggggctagagtgaacttgggccactgtgaagagaaccatatcaagactctttggacactcacacggacactcaaaagctgggcaggttggtgggggcctcggtgtggagaagcggctggcagcccacccctcaacacctctgcacaagctgcaccctcaggcaggtgggatggatttccagccaaagcctcctccagccgccatgctcctggcccactgcatcgtttcatcttccaactcaaactcttaaaacccaagtgccttagcaaattctgtttttctaggcctggggacggcttttacttaaaccgccaaggctgggggaagaagctctctcctccctttcttccctacagttgaaaaacagctgagggtgagtgggtgaataatacagtatctcagggcctggtcgttttcaacagaattataattagttcctcattagcattttgctaaatgtgaatgatgatcctaggcatttgctgaatacagaggcaactgcattggctttgggttgcaggacctcaggtgagaagcagaggaaggagaggagaggggcacagggtctctaccatcccctgtagagtgggagctgagtgggggatcacagcctctgaaaaccaatgttctctcttctccacctcccacaaaggagagctagcagcagggagggcttctgccatttctgagatcaaaacggttttactgcagctttgtttgttgtcagctgaacctgggtaactagggaagataatattaaggaagacaatgtgaaaagaaaaatgagcctggcaagaatgtgtttaaacttggtttttaaaaaactgctgactgttttctcttgagagggtggaatatccaatattcgctgtgtcagcatagaagtaacttacttaggtgtgggggaagcaccataactttgtttagcccaaaaccaagtcaagtgaaaaaggaggaagagaaaaaatattttcctgccaggcatggtggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtcccagatacttggggggctgaggtgggaggatctcttgagcctgggaggtcaaggctgcagtgagccgagattgcaccactgcactccagcctgggtgacagagcaagtgagaccctgtctcaaaaaaagaaaaagaaaaagaaaaaatattttccctattagagaagagattgtggtttcattctgtattttgtttttgtcttaaaaagtggaaaaatagcctgcctcttctctactctagggaaaaaccagcgtgtgactactcccccaggtggttatggagagggtgtccggtccctgtcccagtgccgagaaggaagcctcccacgactgcccggcagggtcctagaaattccccaccctgaaagccctgagctttctgctatcaaagaggttttaaaaaaatcccatttaaaaaaaatcccttacctcggtgccttcctctttttatttagttccttgagttgattcagctctgcaagaattgaagcaggactaaatgtctagttgtaacaccatgattaaccacttcagctgacttttctgtccgagctttgaaaattcagtggtgttagtggttacccagttagctctcaagttatcagggtattccagagtggggatatgatttaaatcagccgtgtaaccatggacccaatatttaccagaccacaaaacttttctaatactctaccctcttagaaaaaccaccaccatcaccagacaggtgcgaaaggatgaaagtgaccatgttttgtttacggttttccaggtttaagctgttactgtcttcagtaagccgtgattttcattgctgggcttgtctgtagattttagaccctattgctgcttgaggcaactcatcttaggttggcaaaaaggcaggatggccgggcgcggtggctcacgcctgtaatcctagcactttgggaggccaaggtgggaggattgcttgagctcaggagtttgagaccaacctgggtaacatagtgagacaccatctctattatgaacaataacagttaagaaaaaaaaaggcaggcaggcggttatggtggttccctcccatcccaccacataaagtttctgagacttgagaacagcaaaatgctgttaaagggaaatattaagaatgagaatctgcagtaagggtgattctgtgcccacagttcttcaattctttataccgttttacccacatgtggtgttaccaaagccgggcagaaccatgctagcggaagatgtgaaatccagatagctcattattgccaagagctaggcagctttgatctccaaattgttattgctttcatttttattgtaatggaattgctttgttttgtttttttgtttttgtattgaagagggttgttttccctttatttttcataagctaatgtaaatgaagaaaaaatgtcttctctgggctgtaggcctggctcagcgtacacaggtatacatcctaagctctctatgttctctaatctgtggtgactgaacatgtgtctcaatgcacggggcatttctacctgtgtttctgcagcacccccactgccttgagtccccagcagtgctgttatttgcctaacacctgtagccatctgccacgcagccagacgtgaaacgctgagacagagaccatttaggttaaatacgacagcttatcctgctgggtggggaaagtaaaaaatatgctggttcaaggcctaaagtaaaatgatcaataatgtttgtagcattaatgaaatattttcaagaaatgtgtccaggggtagcactggctatgttgacgaggcctttggtaactcagagagctcttggccctgatggggacttgcccttacgctttctttatcaggctctgagttcacacggagcctctggcacttccctgctgtcttgggagaaaggaaactggttgccgcggcaggttgtggaatctgttgctggaaccaggctggaagcccacctggtagtgaacagggcccagtggggcaggctgggcatgttgtggtctatgggtttgtttcctggagaatgttcaggaatgtcttcccagctgctttggtgctgagctctattatctcacagcacgtccagaaggctaacccaggtggggaggatgctgacaccagctccaggtggagttggtggtcttaatttggagatgcaggggcaacctgtgaccctttgaggcaagagccctgcacccagctgtcccgtgcagccgtgggcaggggctgcacacggaggggcaggcgggccagttcagggtccgtgccaggccctcctcagtgccctgtgaaggcctcctgtcctccgtgcggctgggcaccagcaccagggagtttctatggcaaccttagtgattattaaggaacactgtcagttttatgaacatatgctcaaatgaaattctactttaggaggaaaggattggaacagcatgtcacaaggctgttaattaacagagagaccttattggatggagatcacatctgttaaatagaatacctcaactctacgttgttttcttggagataaataatagtttcaagtttttgtttgtttgttttacctaattacctgaaagcaaataccaaaggctgatgtctgtatatggggcaaagggtcagtatatttttcagtgtttttttttctaccagctattttgcatttaaagtgaacattgtgtttggaataaatactcttaaaaaataaaaaaaaaaaaaaa

SEQ ID NO: 52 - DNA, 2058 bp, Homo sapiens
ggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcaggaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagacaggctttctcctcgttgcccaggatggagtacagcagtgcaatcacagctcacggcaacttctgcctcctgggttcaagcaatcctcccgcctcagcctcctaagtagctgggaccacaggcgtgtgccacaatgctaattttttaaaaatgttttgtagagacagggtttcaccatgctgcccaggctggtctcgaactcctggcctcaagtgatccaccagcctcagactcccaaagtgctgggattactggtgtgagccactgcacctgactaaactttaaatttttttttttagacggaatctcgctctgttgcccaggctggagtgcagtggcatgatattggctcactgcaagctctgcctcttgggttcacgctattctcctgcctcagcctcctgagtagctgggactacaggtgcacaccaccacgcccggctaatttttttttttttttagtagagacggggtttcactgtgttggccaggctggtcttgaactcctgacctcgtgatccacccgcctcgccctcccaaaatgctgggattacaggtgtgagccaccgcgcctggcctaaacttttaaaattttaatcaaattaatacatgcacatggcaaagaagtaataaacagcttataacactgaaaaaaaaaaaaaaaaaaaaaa

SEQ ID NO: 53 - DNA, 3085 bp, Homo sapiens
gagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgagtgaaacccaatggaaaaagcatgacatttagaagtagaagacttagcttcaaatccctactccttcacttactaattttgtgatttggaaatatccgcgcaagatgttgacgttgcagacttgggtagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattc

SEQ ID NO: 54 - DNA, 1197 bp, Homo sapiens
gtctcaatattagagtctcaacccccaataaatataggactggagatgtctgaggctcattctgccctcgagcccaccgggaacgaaagagaagctctatctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcattttaaaaaattcagcaaaaaaaaaa

SEQ ID NO: 55 - DNA, 1006 bp, Homo sapiens
gtctcaatattagagtctcaacccccaataaatataggactggagatgtctgaggctcattctgccctcgagcccaccgggaacgaaagagaagctctatctcccctccaggagcccagctatgaactccttctccacaaacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcattttaaaaaattcagcaaaaaaaaaa

SEQ ID NO: 56 - DNA, 1629 bp, Homo sapiens
tttcctgggcggggccaaggctggggcaggggagtcagcagaggcctcgctcgggcgcccagtggtcctgccgcctggtctcacctcgctatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctggggg

SEQ ID NO: 57 - DNA, 1567 bp, Homo sapiens
tttcctgggcggggccaaggctggggcaggggagtcagcagaggcctcgctcgggcgcccagtggtcctgccgcctggtctcacctcgctatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaaggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctggggg

SEQ ID NO: 58 - DNA, 1669 bp, Homo sapiens
tttcctgggcggggccaaggctggggcaggggagtcagcagaggcctcgctcgggcgcccagtggtcctgccgcctggtctcacctcgctatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtgagtcctggacaatgggccctggagaaagcctaggaaggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctggggg

SEQ ID NO: 59 - DNA, 1641 bp, Homo sapiens
tttcctgggcggggccaaggctggggcaggggagtcagcagaggcctcgctcgggcgcccagtggtcctgccgcctggtctcacctcgctatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcagtgagtcctcagaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctggggg

SEQ ID NO: 60 - DNA, 1473 bp, Homo sapiens
tttcctgggcggggccaaggctggggcaggggagtcagcagaggcctcgctcgggcgcccagtggtcctgccgcctggtctcacctcgctatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctggggg

SEQ ID NO: 61 - DNA, 1834 bp, Homo sapiens
actttgacagtcttctcatgctgcctctgccaccttctctgccagaagataccatttcaactttaacacagcatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaaggtgatcagaatcctcaaattgcggcacatgtcataagtgaggccagcagtaaaacaacatctgtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactctgaacagtgtcaccttgcaggctgtggtggagctgacgctgggagtcttcataatacagcacagcggttaagcccaccccctgttaactgcctatttataaccctaggatcctccttatggagaactatttattatacactccaaggcatgtagaactgtaataagtgaattacaggtcacatgaaaccaaaacgggccctgctccataagagcttatatatctgaagcagcaaccccactgatgcagacatccagagagtcctatgaaaagacaaggccattatgcacaggttgaattctgagtaaacagcagataacttgccaagttcagttttgtttctttgcgtgcagtgtctttccatggataatgcatttgatttatcagtgaagatgcagaagggaaatggggagcctcagctcacattcagttatggttgactctgggttcctatggccttgttggagggggccaggctctagaacgtctaacacagtggagaaccgaaaccccccccccccccccgccaccctctcggacagttattcattctctttcaatctctctctctccatctctctctttcagtctctctctctcaacctctttcttccaatctctctttctcaatctctctgtttccctttgtcagtctcttccctcccccagtctctcttctcaatccccctttctaacacacacacacacacacacacacacacacacacacacacacacacacacacagagtcaggccgttgctagtcagttctcttctttccaccctgtccctatctctaccactatagatgagggtgaggagtagggagtgcagccctgagcctgcccactcctcattacgaaatgactgtatttaaaggaaatctattgtatctacctgcagtctccattgtttccagagtgaacttgtaattatcttgttatttattttttgaataataaagacctcttaacattaa

SEQ ID NO: 62 - protein, 182 aa, Homo sapiens
MEQGKGLAVLILAIILLQGTLAQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 63 - protein, 150 aa, Homo sapiens
FKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 64 - protein, 106 aa, Homo sapiens
FKIPIEELEDRVFVNCNTSITWVEGTVGTLLSDITRLDLGKRILDPRGIYRCNGTDIYKDKESTVQVHYRTADTQALLRNDQVYQPLRDRDDAQYSHLGGNWARNK

SEQ ID NO: 65 - protein, 185 aa, Homo sapiens
DGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 66 - protein, 143 aa, Homo sapiens
QSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 67 - protein, 142 aa, Homo sapiens
QSFGLLDPKLCYLLDGILFIYGVILTALFLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 68 - protein, 99 aa, Homo sapiens
MAAAAASRGVGAKLGLREIRIHLCQRSPGSQGVRDFIEKRYVELKKANPDLPILIRECSDVQPKLWARYAFGQETNVPLNNFSADQVTRALENVLSGKA

SEQ ID NO: 69 - protein, 297 aa, Homo sapiens
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 70 - protein, 251 aa, Homo sapiens
ELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 71 - protein, 179 aa, Homo sapiens
ELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGEEKPQASPEGRPESETSCLVTTTDFQIQTEMAATMETSIFTTEYQVAVAGCVFLLISVLLLSGLTWQRRQRKSRRTI

SEQ ID NO: 72 - protein, 155 aa, Homo sapiens
ELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPDFQIQTEMAATMETSIFTTEYQVAVAGCVFLLISVLLLSGLTWQRRQRKSRRTI

SEQ ID NO: 73 - protein, 202 aa, Homo sapiens
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 74 - protein, 105 aa, Homo sapiens
NKILVKQSPMLVAYDNAVNLSWKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 75 - protein, 83 aa, Homo sapiens
KHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 76 - protein, 254 aa, Homo sapiens
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 77 - protein, 299 aa, Homo sapiens
YFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 78 - protein, 299 aa, Homo sapiens; identical to SEQ ID NO: 77

SEQ ID NO: 79 - protein, 251 aa, Homo sapiens
YFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIGTNTMEREESEQTKKREKIHIPERSDEAQRVFKSSKTSSCDKSDTCF

SEQ ID NO: 80 - protein, 190 aa, Homo sapiens
EIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 81 - protein, 247 aa, Homo sapiens
MGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 82 - protein, 1181 aa, Homo sapiens
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKKGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQEQPFIVSNQNKRLTFSVTLKNKRESAYNTGIVVDFSENLFFASFSLPVDGTEVTCQVAASQKSVACDVGYPALKREQQVTFTINFDFNLQNLQNQASLSFQALSESQEENKADNLVNLKIPLLYDAEIHLTRSTNINFYEISSDGNVPSIVHSFEDVGPKFIFSLKVTTGSVPVSMATVIIHIPQYTKEKNPLMYLTGVQTDKAGDISCNADINPLKIGQTSSSVSFKSENFRHTKELNCRTASCSNVTCWLKDVHMKGEYFVNVTTRIWNGTFASSTFQTVQLTAAAEINTYNPEIYVIEDNTVTIPLMIMKPDEKAEVPTGVIIGSIIAGILLLLALVAILWKLGFFKRKYEKMTKNPDEIDETTELSS

SEQ ID NO: 83 - protein, 469 aa, Homo sapiens
MHSFPPLLLLLFWGVVSHSFPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 84 - protein, 287 aa, Homo sapiens
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTDSIHQDYTTQNLIRMAVAGLVLVALLAILVENWHSHTALNKEASADVAEPSWSQQMCQPGLTFARTPSVCK

SEQ ID NO: 85 - DNA, 2947 bp, Homo sapiens
agtaaccaggcaacaccattgaaggctcatatgtaaaaatccatgccttcctttctcccaatctccattcccaaacttagccactggcttctggctgaggccttacgcatacctcccggggcttgcacacaccttcttctacagaagacacaccttgggcatatcctacagaagaccaggcttctctctggtccttggtagagggctactttactgtaacagggccagggtggagagttctctcctgaagctccatcccctctataggaaatgtgttgacaatattcagaagagtaagaggatcaagacttctttgtgctcaaataccactgttctcttctctaccctgccctaaccaggagcttgtcaccccaaactctgaggtgatttatgccttaatcaagcaaacttccctcttcagaaaagatggctcattttccctcaaaagttgccaggagctgccaagtattctgccaattcaccctggagcacaatcaacaaattcagccagaacacaactacagctactattagaactattattattaataaattcctctccaaatctagccccttgacttcggatttcacgatttctcccttcctcctagaaacttgataagtttcccgcgcttccctttttctaagactacatgtttgtcatcttataaagcaaaggggtgaataaatgaaccaaatcaataacttctggaatatctgcaaacaacaataatatcagctatgccatctttcactattttagccagtatcgagttgaatgaacatagaaaaatacaaaactgaattcttccctgtaaattccccgttttgacgacgcacttgtagccacgtagccacgcctacttaagacaattacaaaaggcgaagaagactgactcaggcttaagctgccagccagagagggagtcatttcattggcgtttgagtcagcaaagaagtcaagatggccaaagttccagacatgtttgaagacctgaagaactgttacagtgaaaatgaagaagacagttcctccattgatcatctgtctctgaatcagaaatccttctatcatgtaagctatggcccactccatgaaggctgcatggatcaatctgtgtctctgagtatctctgaaacctctaaaacatccaagcttaccttcaaggagagcatggtggtagtagcaaccaacgggaaggttctgaagaagagacggttgagtttaagccaatccatcactgatgatgacctggaggccatcgccaatgactcagaggaagaaatcatcaagcctaggtcagcaccttttagcttcctgagcaatgtgaaatacaactttatgaggatcatcaaatacgaattcatcctgaatgacgccctcaatcaaagtataattcgagccaatgatcagtacctcacggctgctgcattacataatctggatgaagcagtgaaatttgacatgggtgcttataagtcatcaaaggatgatgctaaaattaccgtgattctaagaatctcaaaaactcaattgtatgtgactgcccaagatgaagaccaaccagtgctgctgaaggagatgcctgagatacccaaaaccatcacaggtagtgagaccaacctcctcttcttctgggaaactcacggcactaagaactatttcacatcagttgcccatccaaacttgtttattgccacaaagcaagactactgggtgtgcttggcaggggggccaccctctatcactgactttcagatactggaaaaccaggcgtaggtctggagtctcacttgtctcacttgtgcagtgttgacagttcatatgtaccatgtacatgaagaagctaaatcctttactgttagtcatttgctgagcatgtactgagccttgtaattctaaatgaatgtttacactctttgtaagagtggaaccaacactaacatataatgttgttatttaaagaacaccctatattttgcatagtaccaatcattttaattattattcttcataacaattttaggaggaccagagctactgactatggctaccaaaaagactctacccatattacagatgggcaaattaaggcataagaaaactaagaaatatgcacaatagcagttgaaacaagaagccacagacctaggatttcatgatttcatttcaactgtttgccttctacttttaagttgctgatgaactcttaatcaaatagcataagtttctgggacctcagttttatcattttcaaaatggagggaataatacctaagccttcctgccgcaacagttttttatgctaatcagggaggtcattttggtaaaatacttcttgaagccgagcctcaagatgaaggcaaagcacgaaatgttattttttaattattatttatatatgtatttataaatatatttaagataattataatatactatatttatgggaaccccttcatcctctgagtgtgaccaggcatcctccacaatagcagacagtgttttctgggataagtaagtttgatttcattaatacagggcattttggtccaagttgtgcttatcccatagccaggaaactctgcattctagtacttgggagacctgtaatcatataataaatgtacattaattaccttgagccagtaattggtccgatctttgactcttttgccattaaacttacctgggcattcttgtttcaattccacctgcaatcaagtcctacaagctaaaattagatgaactcaactttgacaaccatgagaccactgttatcaaaactttcttttctggaatgtaatcaatgtttcttctaggttctaaaaattgtgatcagaccataatgttacattattatcaacaatagtgattgatagagtgttatcagtcataactaaataaagcttgcaacaaaattctctgacaaaaaaaaaaaaaaaa

SEQ ID NO: 86 - DNA, 1498 bp, Homo sapiens
accaaacctcttcgaggcacaaggcacaacaggctgctctgggattctcttcagccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccaggcctctctcacctctcctactcacttaaagcccgcctgacagaaaccacggccacatttggttctaagaaaccctctgtcattcgctcccacattctgatgagcaaccgcttccctatttatttatttatttgtttgtttgttttattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttctgaaataaacttcactgaag

SEQ ID NO: 87 - DNA, 1163 bp, Homo sapiens
attctctccccagcttgctgagccctttgctcccctggcgactgcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcaggaataaagatggctgctgaaccagtagaagacaattgcatcaactttgtggcaatgaaatttattgacaatacgctttactttatagctgaagatgatgaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactagctattaaaatttcatgccgggcgcagtggctcacgcctgtaatcccagccctttgggaggctgaggcgggcagatcaccagaggtcaggtgttcaagaccagcctgaccaacatggtgaaacctcatctctactaaaaatacaaaaaattagctgagtgtagtgacgcatgccctcaatcccagctactcaagaggctgaggcaggagaatcacttgcactccggaggtagaggttgtggtgagccgagattgcaccattgcgctctagcctgggcaacaacagcaaaactccatctcaaaaaataaaataaataaataaacaaataaaaaattcataatgtgaaaaaaaaaaaaaaaaaa

SEQ ID NO: 88 - DNA, 1151 bp, Homo sapiens
attctctccccagcttgctgagccctttgctcccctggcgactgcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcaggaataaagatggctgctgaaccagtagaagacaattgcatcaactttgtggcaatgaaatttattgacaatacgctttactttatagaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactagctattaaaatttcatgccgggcgcagtggctcacgcctgtaatcccagccctttgggaggctgaggcgggcagatcaccagaggtcaggtgttcaagaccagcctgaccaacatggtgaaacctcatctctactaaaaatacaaaaaattagctgagtgtagtgacgcatgccctcaatcccagctactcaagaggctgaggcaggagaatcacttgcactccggaggtagaggttgtggtgagccgagattgcaccattgcgctctagcctgggcaacaacagcaaaactccatctcaaaaaataaaataaataaataaacaaataaaaaattcataatgtgaaaaaaaaaaaaaaaaaa

SEQ ID NO: 89 - DNA, 888 bp, Homo sapiens
aaaacccaagtgcagtagaagccattgttcataatggtagggatacagggtccttcgtaacagattatcagtgtggcctatgctggaaagtctggtgacctctgattttttttgcttccaggtctttggccttggcactctttgtcatattagagttcctgggtctaggcctgggcaggattcataggtgcagctgcttctgctggaggtagactgcatccaacaaagtaagggtgctgggtgagttctgggagtatagattctgactggggtcactgctgggctggccgccagtctttcatctgacccagggttaaactgtggcttgggactgactcaggtcctctcttggggtcggtctgcacataaaaggactcctatccttggcagttctgaaacaacaccaccacaatggaaaaagcattgaaaattgacacacctcagcaggggagcattcaggatatcaatcatcgggtgtgggttcttcaggaccagacgctcatagcagtcccgaggaaggaccgtatgtctccagtcactattgccttaatctcatgccgacatgtggagacccttgagaaagacagagggaaccccatctacctgggcctgaatggactcaatctctgcctgatgtgtgctaaagtcggggaccagcccacactgcagctgaaggaaaaggatataatggatttgtacaaccaacccgagcctgtgaagtcctttctcttctaccacagccagagtggcaggaactccaccttcgagtctgtggctttccctggctggttcatcgctgtcagctctgaaggaggctgtcctctcatccttacccaagaactggggaaagccaacactactgactttgggttaactatgctgttttaa

SEQ ID NO: 90 - DNA, 1186 bp, Homo sapiens
cacgggttcctccccactctgtctttctcacctctccttcacttttcctagcctcctcaccaccatctgatctatcttgttctcttcacaaaaggctctgaagacatcatgaacccacaacgggaggcagcacccaaatcctatgctattcgtgattctcgacagatggtgtgggtcctgagtggaaattctttaatagcagctcctcttagccgcagcattaagcctgtcactcttcatttaatagcctgtagagacacagaattcagtgacaaggaaaagggtaatatggtttacctgggaatcaagggaaaagatctctgtctcttctgtgcagaaattcagggcaagcctactttgcagcttaagcttcagggctcccaagataacatagggaaggacacttgctggaaactagttggaattcacacatgcataaacctggatgtgagagagagctgcttcatgggaacccttgaccaatggggaataggagtgggtagaaagaagtggaagagttcctttcaacatcaccatctcaggaagaaggacaaagatttctcatccatgcggaccaacataggaatgccaggaaggatgtagaaataaggggaggaagattcccatctctacaatctttgagtgggtttgctatcaatgaaatgctacaaatggaataagttgcagaaatttttctcttttcttgggttctggagagtttgtaaaacaaggacactatgtatttttaaagagttggtaaatcttacctgtaaagctagagaaggtcggagtctttttaggagtagatttggactacataacctgtaaatgtgttttgtccagtccttagagtgttttttaaaaaattgtaaagtcaaggttttcatgaaaaatgggaagatcagacaacattgctcctgaattcccacagagcagcaagctactagagctcaatctgttatttcttttcctgatgtacaggggttaagtcctatggaagaaacagcagaattattcaaaattatttacataatgtgcaattattcactagagcatgaggagtgaaacgctctgtttagtatgtataacttaaaaggaacacatacaattaaaagtaattgaaagacatttcttcttaaaaattctataatcttacactggtaaaataaactagtttttcccatgt

SEQ ID NO: 91 - DNA, 1068 bp, Homo sapiens
cacgggttcctccccactctgtctttctcacctctccttcacttttcctagcctcctcaccaccatctgatctatcttgttctcttcacaaaaggctctgaagacatcatgaacccacaacgggaggcagcacccaaatcctatgctattcgtgattctcgacagatggtgtgggtcctgagtggaaattctttaatagcagctcctcttagccgcagcattaagcctgtcactcttcatttaatagcctgtagagacacagaattcagtgacaaggaaaagggtaatatggtttacctgggaatcaagggaaaagatctctgtctcttctgtgcagaaattcagggcaagcctactttgcagcttaaggaaaaaaatatcatggacctgtatgtggagaagaaagcacagaagccctttctctttttccacaataaagaaggctccacttctgtctttcagtcagtctcttaccctggctggttcatagccacctccaccacatcaggacagcccatctttctcaccaaggagagaggcataactaataacactaacttctacttagattctgtggaataaatccagcctaggctgtgggtggctggttccaggatagagaatcaagctgtcagagtcatcttaacagatcattatgcgactgagttcactagcagttcagcccatccatagcttacctcattcttactatccaaaagccacctcctcctccaaacatccatttctgtaccaagaccctcactcgaatgtcactatcccaagatgaaacctaaaaatcactttccattctttcttgatcttaccccaccatccactcagctgccatgcccagtttagtcaaccccccaaatgctgcttcatgcaaccttccattcctattccttttgccaacccatgatgtagagatgtggattcatgacattttgttcatacaacttcttcaataaaacattataatatgtgccccaaagataaagctgaagaatgagatgaatgtgaaattaaaggtttgcatgtctttctaatcctaaaaaaaaaaaaaaaaaa

SEQ ID NO: 92 - DNA, 1212 bp, Homo sapiens
gaagctgctggagccacgattcagtcccctggactgtagataaagaccctttcttgccaggtgctgagacaaccacactatgagaggcactccaggagacgctgatggtggaggaagggccgtctatcaatcaatgtgtaaacctattactgggactattaatgatttgaatcagcaagtgtggacccttcagggtcagaaccttgtggcagttccacgaagtgacagtgtgaccccagtcactgttgctgttatcacatgcaagtatccagaggctcttgagcaaggcagaggggatcccatttatttgggaatccagaatccagaaatgtgtttgtattgtgagaaggttggagaacagcccacattgcagctaaaagagcagaagatcatggatctgtatggccaacccgagcccgtgaaacccttccttttctaccgtgccaagactggtaggacctccacccttgagtctgtggccttcccggactggttcattgcctcctccaagagagaccagcccatcattctgacttcagaacttgggaagtcatacaacactgcctttgaattaaatataaatgactgaactcagcctagaggtggcagcttggtctttgtcttaaagtttctggttcccaatgtgttttcgtctacattttcttagtgtcattttcacgctggtgctgagacaggggcaaggctgctgttatcatctcattttataatgaagaagaagcaattacttcatagcaactgaagaacaggatgtggcctcagaagcaggagagctgggtggtataaggctgtcctctcaagctggtgctgtgtaggccacaaggcatctgcatgagtgactttaagactcaaagaccaaacactgagctttcttctaggggtgggtatgaagatgcttcagagctcatgcgcgttacccacgatggcatgactagcacagagctgatctctgtttctgttttgctttattccctcttgggatgatatcatccagtctttatatgttgccaatatacctcattgtgtgtaatagaaccttcttagcattaagaccttgtaaacaaaaataattcttgtgttaagttaaatcatttttgtcctaattgtaatgtgtaatcttaaagttaaataaactttgtgtatttatataataataaagctaaaactgatataaaataaagaaagagtaaactg

SEQ ID NO: 93 - DNA, 1107 bp, Homo sapiens
gaagctgctggagccacgattcagtcccctggactgtagataaagaccctttcttgccaggtgctgagacaaccacactatgagaggcactccaggagacgctgatggtggaggaagggccgtctatcaatcaatcactgttgctgttatcacatgcaagtatccagaggctcttgagcaaggcagaggggatcccatttatttgggaatccagaatccagaaatgtgtttgtattgtgagaaggttggagaacagcccacattgcagctaaaagagcagaagatcatggatctgtatggccaacccgagcccgtgaaacccttccttttctaccgtgccaagactggtaggacctccacccttgagtctgtggccttcccggactggttcattgcctcctccaagagagaccagcccatcattctgacttcagaacttgggaagtcatacaacactgcctttgaattaaatataaatgactgaactcagcctagaggtggcagcttggtctttgtcttaaagtttctggttcccaatgtgttttcgtctacattttcttagtgtcattttcacgctggtgctgagacaggggcaaggctgctgttatcatctcattttataatgaagaagaagcaattacttcatagcaactgaagaacaggatgtggcctcagaagcaggagagctgggtggtataaggctgtcctctcaagctggtgctgtgtaggccacaaggcatctgcatgagtgactttaagactcaaagaccaaacactgagctttcttctaggggtgggtatgaagatgcttcagagctcatgcgcgttacccacgatggcatgactagcacagagctgatctctgtttctgttttgctttattccctcttgggatgatatcatccagtctttatatgttgccaatatacctcattgtgtgtaatagaaccttcttagcattaagaccttgtaaacaaaaataattcttgtgttaagttaaatcatttttgtcctaattgtaatgtgtaatcttaaagttaaataaactttgtgtatttatataataataaagctaaaactgatataaaataaagaaagagtaaactg

SEQ ID NO: 94 - DNA, 1366 bp, Homo sapiens
ggcagtgggactgggtttgagctgggcttatcctccaactgtgagggaggctacagcacactccaccccactctcagggctgggaattgttgtggctcagctatttgggggaatctgttttccagtttctcagaaccagcgcaagcacacacatcccaggctcacacccctggtggctggacttgctcccggatagcctcagtcagggagaggcagagctgcctggagcctgctgggctggtggaagccttggtggattctggcaggccaattatagacgaatggcctggggaacccgtgcagcccttggctgagtggttctaagccccagcacgtctgcctctggcttcacccagcctccttttctaactgcccttctctcctccccatcagtgaggaccagacaccactgattgcaggaatgtgttccctccccatggcaagatactacataattaaatatgcagaccagaaggctctatacacaagagatggccagctgctggtgggagatcctgttgcagacaactgctgtgcagagaagatctgcatacttcctaacagaggcttggcccgcaccaaggtccccattttcctggggatccagggagggagccgctgcctggcatgtgtggagacagaagaggggccttccctacagctggaggatgtgaacattgaggaactgtacaaaggtggtgaagaggccacacgcttcaccttcttccagagcagctcaggctccgccttcaggcttgaggctgctgcctggcctggctggttcctgtgtggcccggcagagccccagcagccagtacagctcaccaaggagagtgagccctcagcccgtaccaagttttactttgaacagagctggtagggagacaggaaactgcgttttagccttgtgcccccaaaccaagctcatcctgctcagggtctatggtaggcagaataatgtcccccgaaatatgtccacatcctaatcccaagatctgtgcatatgttaccatacatgtccaaagaggttttgcaaatgtgattatgttaaggatcttgaaatgaggagacaatcctgggttatccttgtgggctcagtttaatcacaagaaggaggcaggaagggagagtcagagagagaatggaagataccatgcttctaattttgaagatggagtgaggggccttgagccaacaaatgcaggtgtttttagaaggtggaaaagccaagggaacggattctcctctagagtctccggaaggaacacagctcttgacacatggatttcagctcagtgacacccatttcagacttctgacctccacaactataaaataataaacttgtgttattgtaaacctctaa

SEQ ID NO: 95 - DNA, 1027 bp, Homo sapiens
agttggagtctccagggatcagggttccaggaactcaggatctgcagtgaggaccagacaccactgattgcaggaatgtgttccctccccatggcaagatactacataattaaatatgcagaccagaaggctctatacacaagagatggccagctgctggtgggagatcctgttgcagacaactgctgtgcagagaagatctgcatacttcctaacagaggcttggcccgcaccaaggtccccattttcctggggatccagggagggagccgctgcctggcatgtgtggagacagaagaggggccttccctacagctggaggatgtgaacattgaggaactgtacaaaggtggtgaagaggccacacgcttcaccttcttccagagcagctcaggctccgccttcaggcttgaggctgctgcctggcctggctggttcctgtgtggcccggcagagccccagcagccagtacagctcaccaaggagagtgagccctcagcccgtaccaagttttactttgaacagagctggtagggagacaggaaactgcgttttagccttgtgcccccaaaccaagctcatcctgctcagggtctatggtaggcagaataatgtcccccgaaatatgtccacatcctaatcccaagatctgtgcatatgttaccatacatgtccaaagaggttttgcaaatgtgattatgttaaggatcttgaaatgaggagacaatcctgggttatccttgtgggctcagtttaatcacaagaaggaggcaggaagggagagtcagagagagaatggaagataccatgcttctaattttgaagatggagtgaggggccttgagccaacaaatgcaggtgtttttagaaggtggaaaagccaagggaacggattctcctctagagtctccggaaggaacacagctcttgacacatggatttcagctcagtgacacccatttcagacttctgacctccacaactataaaataataaacttgtgttattgtaaacctctaaaaaaaaa

SEQ ID NO: 96 - DNA, 2718 bp, Homo sapiens
agtctacagactcctccgaacacagagctgcagctcttcagggaagaaatcaaaacaagatcacaagaatactgaaaaatgaagcctaaaatgaagtattcaaccaacaaaatttccacagcaaagtggaagaacacagcaagcaaagccttgtgtttcaagctgggaaaatcccaacagaaggccaaagaagtttgccccatgtactttatgaagctccgctctggccttatgataaaaaaggaggcctgttactttaggagagaaaccaccaaaaggccttcactgaaaacaggtagaaagcacaaaagacatctggtactcgctgcctgtcaacagcagtctactgtggagtgctttgcctttggtatatcaggggtccagaaatatactagagcacttcatgattcaagtatcacaggaatttcacctattacagagtatcttgcttctctaagcacatacaatgatcaatccattacttttgctttggaggatgaaagttatgagatatatgttgaagacttgaaaaaagatgaaaagaaagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctatgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagatgtcttaggcaacactcagagcagatctcccttactgtcaggggatatggaacttcaaaggcccacatggcaagccaggtaacataaatgtgtgaaaaagtaaagataactaaaaaatttagaaaaataaatccagtatttgtaaagtgaataacttcatttctaattgtttaatttttaaaattctgatttttatatattgagtttaagcaaggcattcttacacgaggaagtgaagtaaattttagttcagacataaaatttcacttattaggaatatgtaacatgctaaaacttttttttttttaaagagtactgagtcacaacatgttttagagcatccaagtaccatataatccaactatcatggtaaggccagaaatcttctaacctaccagagcctagatgagacaccgaattaacattaaaatttcagtaactgactgtccctcatgtccatggcctaccatcccttctgaccctggcttccagggacctatgtcttttaatactcactgtcacattgggcaaagttgcttctaatccttatttcccatgtgcacaagtctttttgtattccagcttcctgataacactgcttactgtggaatattcatttgacatctgtctcttttcatttcttttaactaccatgcccttgatatatcttttgcacctgctgaacttcatttctgtatcacctgacctctggatgccaaaacgtttattctgctttgtctgttgtagaattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctagtagaatataagataaaagaggctgagaattaccatacaagggtattacaactgtaaaacaatttatctttgtttcattgttctgtcaataattgttaccaaagagataaaaataaaagcagaatgtatatcatcccatctgaaaaacactaattattgacatgtgcatctgtacaataaacttaaaatgattattaaataatcaaatatatctactacattgtttatattattgaataaagtatattttccaaatgtaaaaaaaaaaaaa

SEQ ID NO: 97 - DNA, 2592 bp, Homo sapiens
agtctacagactcctccgaacacagagctgcagctcttcagggaagaaatcaaaacaagatcacaagaatactgaaaaatgaagcctaaaatgaagtattcaaccaacaaaatttccacagcaaagtggaagaacacagcaagcaaagccttgtgtttcaagctgggaaaatcccaacagaaggccaaagaagtttgccccatgtactttatgaagctccgctctggccttatgataaaaaaggaggcctgttactttaggagagaaaccaccaaaaggccttcactgaaaacaggtagaaagcacaaaagacatctggtactcgctgcctgtcaacagcagtctactgtggagtgctttgcctttggtatatcaggggtccagaaatatactagagcacttcatgattcaagtatcacagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctatgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagatgtcttaggcaacactcagagcagatctcccttactgtcaggggatatggaacttcaaaggcccacatggcaagccaggtaacataaatgtgtgaaaaagtaaagataactaaaaaatttagaaaaataaatccagtatttgtaaagtgaataacttcatttctaattgtttaatttttaaaattctgatttttatatattgagtttaagcaaggcattcttacacgaggaagtgaagtaaattttagttcagacataaaatttcacttattaggaatatgtaacatgctaaaacttttttttttttaaagagtactgagtcacaacatgttttagagcatccaagtaccatataatccaactatcatggtaaggccagaaatcttctaacctaccagagcctagatgagacaccgaattaacattaaaatttcagtaactgactgtccctcatgtccatggcctaccatcccttctgaccctggcttccagggacctatgtcttttaatactcactgtcacattgggcaaagttgcttctaatccttatttcccatgtgcacaagtctttttgtattccagcttcctgataacactgcttactgtggaatattcatttgacatctgtctcttttcatttcttttaactaccatgcccttgatatatcttttgcacctgctgaacttcatttctgtatcacctgacctctggatgccaaaacgtttattctgctttgtctgttgtagaattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctagtagaatataagataaaagaggctgagaattaccatacaagggtattacaactgtaaaacaatttatctttgtttcattgttctgtcaataattgttaccaaagagataaaaataaaagcagaatgtatatcatcccatctgaaaaacactaattattgacatgtgcatctgtacaataaacttaaaatgattattaaataatcaaatatatctactacattgtttatattattgaataaagtatattttccaaatgtaaaaaaaaaaaaa

SEQ ID NO: 98 - DNA, 2340 bp, Homo sapiens
agtctacagactcctccgaacacagagctgcagctcttcagggaagaaatcaaaacaagatcacaagaatactgaaaaatgaagcctaaaatgaagtattcaaccaacaaaatttccacagcaaagtggaagaacacagcaagcaaagccttgtgtttcaagctgggaaataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctatgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagatgtcttaggcaacactcagagcagatctcccttactgtcaggggatatggaacttcaaaggcccacatggcaagccaggtaacataaatgtgtgaaaaagtaaagataactaaaaaatttagaaaaataaatccagtatttgtaaagtgaataacttcatttctaattgtttaatttttaaaattctgatttttatatattgagtttaagcaaggcattcttacacgaggaagtgaagtaaattttagttcagacataaaatttcacttattaggaatatgtaacatgctaaaacttttttttttttaaagagtactgagtcacaacatgttttagagcatccaagtaccatataatccaactatcatggtaaggccagaaatcttctaacctaccagagcctagatgagacaccgaattaacattaaaatttcagtaactgactgtccctcatgtccatggcctaccatcccttctgaccctggcttccagggacctatgtcttttaatactcactgtcacattgggcaaagttgcttctaatccttatttcccatgtgcacaagtctttttgtattccagcttcctgataacactgcttactgtggaatattcatttgacatctgtctcttttcatttcttttaactaccatgcccttgatatatcttttgcacctgctgaacttcatttctgtatcacctgacctctggatgccaaaacgtttattctgctttgtctgttgtagaattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctagtagaatataagataaaagaggctgagaattaccatacaagggtattacaactgtaaaacaatttatctttgtttcattgttctgtcaataattgttaccaaagagataaaaataaaagcagaatgtatatcatcccatctgaaaaacactaattattgacatgtgcatctgtacaataaacttaaaatgattattaaataatcaaatatatctactacattgtttatattattgaataaagtatattttccaaatgtaaaaaaaaaaaaa

SEQ ID NO: 99 - DNA, 2705 bp, Homo sapiens
acagatgccaaacgagatggagagagggtgagtaggagcaaaatttctcatgagaatactgaaaaatgaagcctaaaatgaagtattcaaccaacaaaatttccacagcaaagtggaagaacacagcaagcaaagccttgtgtttcaagctgggaaaatcccaacagaaggccaaagaagtttgccccatgtactttatgaagctccgctctggccttatgataaaaaaggaggcctgttactttaggagagaaaccaccaaaaggccttcactgaaaacaggtagaaagcacaaaagacatctggtactcgctgcctgtcaacagcagtctactgtggagtgctttgcctttggtatatcaggggtccagaaatatactagagcacttcatgattcaagtatcacaggaatttcacctattacagagtatcttgcttctctaagcacatacaatgatcaatccattacttttgctttggaggatgaaagttatgagatatatgttgaagacttgaaaaaagatgaaaagaaagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctatgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagatgtcttaggcaacactcagagcagatctcccttactgtcaggggatatggaacttcaaaggcccacatggcaagccaggtaacataaatgtgtgaaaaagtaaagataactaaaaaatttagaaaaataaatccagtatttgtaaagtgaataacttcatttctaattgtttaatttttaaaattctgatttttatatattgagtttaagcaaggcattcttacacgaggaagtgaagtaaattttagttcagacataaaatttcacttattaggaatatgtaacatgctaaaacttttttttttttaaagagtactgagtcacaacatgttttagagcatccaagtaccatataatccaactatcatggtaaggccagaaatcttctaacctaccagagcctagatgagacaccgaattaacattaaaatttcagtaactgactgtccctcatgtccatggcctaccatcccttctgaccctggcttccagggacctatgtcttttaatactcactgtcacattgggcaaagttgcttctaatccttatttcccatgtgcacaagtctttttgtattccagcttcctgataacactgcttactgtggaatattcatttgacatctgtctcttttcatttcttttaactaccatgcccttgatatatcttttgcacctgctgaacttcatttctgtatcacctgacctctggatgccaaaacgtttattctgctttgtctgttgtagaattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctagtagaatataagataaaagaggctgagaattaccatacaagggtattacaactgtaaaacaatttatctttgtttcattgttctgtcaataattgttaccaaagagataaaaataaaagcagaatgtatatcatcccatctgaaaaacactaattattgacatgtgcatctgtacaataaacttaaaatgattattaaataatcaaatatatctactacattgtttatattattgaataaagtatattttccaaatgtaaaaaaaaaaaaa

SEQ ID NO: 100 - DNA, 2713 bp, Homo sapiens
aaatactacaattgctgactacaggaaacctcatcatctgagaccagcactttataaattagaatactgaaaaatgaagcctaaaatgaagtattcaaccaacaaaatttccacagcaaagtggaagaacacagcaagcaaagccttgtgtttcaagctgggaaaatcccaacagaaggccaaagaagtttgccccatgtactttatgaagctccgctctggccttatgataaaaaaggaggcctgttactttaggagagaaaccaccaaaaggccttcactgaaaacaggtagaaagcacaaaagacatctggtactcgctgcctgtcaacagcagtctactgtggagtgctttgcctttggtatatcaggggtccagaaatatactagagcacttcatgattcaagtatcacaggaatttcacctattacagagtatcttgcttctctaagcacatacaatgatcaatccattacttttgctttggaggatgaaagttatgagatatatgttgaagacttgaaaaaagatgaaaagaaagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctatgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagatgtcttaggcaacactcagagcagatctcccttactgtcaggggatatggaacttcaaaggcccacatggcaagccaggtaacataaatgtgtgaaaaagtaaagataactaaaaaatttagaaaaataaatccagtatttgtaaagtgaataacttcatttctaattgtttaatttttaaaattctgatttttatatattgagtttaagcaaggcattcttacacgaggaagtgaagtaaattttagttcagacataaaatttcacttattaggaatatgtaacatgctaaaacttttttttttttaaagagtactgagtcacaacatgttttagagcatccaagtaccatataatccaactatcatggtaaggccagaaatcttctaacctaccagagcctagatgagacaccgaattaacattaaaatttcagtaactgactgtccctcatgtccatggcctaccatcccttctgaccctggcttccagggacctatgtcttttaatactcactgtcacattgggcaaagttgcttctaatccttatttcccatgtgcacaagtctttttgtattccagcttcctgataacactgcttactgtggaatattcatttgacatctgtctcttttcatttcttttaactaccatgcccttgatatatcttttgcacctgctgaacttcatttctgtatcacctgacctctggatgccaaaacgtttattctgctttgtctgttgtagaattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctagtagaatataagataaaagaggctgagaattaccatacaagggtattacaactgtaaaacaatttatctttgtttcattgttctgtcaataattgttaccaaagagataaaaataaaagcagaatgtatatcatcccatctgaaaaacactaattattgacatgtgcatctgtacaataaacttaaaatgattattaaataatcaaatatatctactacattgtttatattattgaataaagtatattttccaaatgtaaaaaaaaaaaaa

SEQ ID NO: 101 - DNA, 2700 bp, Homo sapiens
agtctacagactcctccgaacacagagctgcagctcttcagggaagaaatcaaaacaagatcacaagaatactgaaaaatgaagcctaaaatgaagtattcaaccaacaaaatttccacagcaaagtggaagaacacagcaagcaaagccttgtgtttcaagctgggaaaatcccaacagaaggccaaagaagtttgccccatgtactttatgaagctccgctctggccttatgataaaaaaggaggcctgttactttaggagagaaaccaccaaaaggccttcactgaaaacaggtagaaagcacaaaagacatctggtactcgctgcctgtcaacagcagtctactgtggagtgctttgcctttggtatatcaggggtccagaaatatactagagcacttcatgattcaagtatcacagagtatcttgcttctctaagcacatacaatgatcaatccattacttttgctttggaggatgaaagttatgagatatatgttgaagacttgaaaaaagatgaaaagaaagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctatgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagatgtcttaggcaacactcagagcagatctcccttactgtcaggggatatggaacttcaaaggcccacatggcaagccaggtaacataaatgtgtgaaaaagtaaagataactaaaaaatttagaaaaataaatccagtatttgtaaagtgaataacttcatttctaattgtttaatttttaaaattctgatttttatatattgagtttaagcaaggcattcttacacgaggaagtgaagtaaattttagttcagacataaaatttcacttattaggaatatgtaacatgctaaaacttttttttttttaaagagtactgagtcacaacatgttttagagcatccaagtaccatataatccaactatcatggtaaggccagaaatcttctaacctaccagagcctagatgagacaccgaattaacattaaaatttcagtaactgactgtccctcatgtccatggcctaccatcccttctgaccctggcttccagggacctatgtcttttaatactcactgtcacattgggcaaagttgcttctaatccttatttcccatgtgcacaagtctttttgtattccagcttcctgataacactgcttactgtggaatattcatttgacatctgtctcttttcatttcttttaactaccatgcccttgatatatcttttgcacctgctgaacttcatttctgtatcacctgacctctggatgccaaaacgtttattctgctttgtctgttgtagaattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctagtagaatataagataaaagaggctgagaattaccatacaagggtattacaactgtaaaacaatttatctttgtttcattgttctgtcaataattgttaccaaagagataaaaataaaagcagaatgtatatcatcccatctgaaaaacactaattattgacatgtgcatctgtacaataaacttaaaatgattattaaataatcaaatatatctactacattgtttatattattgaataaagtatattttccaaatgtaaaaaaaaaaaaa

SEQ ID NO: 102 - DNA, 2687 bp, Homo sapiens
acagatgccaaacgagatggagagagggtgagtaggagcaaaatttctcatgagaatactgaaaaatgaagcctaaaatgaagtattcaaccaacaaaatttccacagcaaagtggaagaacacagcaagcaaagccttgtgtttcaagctgggaaaatcccaacagaaggccaaagaagtttgccccatgtactttatgaagctccgctctggccttatgataaaaaaggaggcctgttactttaggagagaaaccaccaaaaggccttcactgaaaacaggtagaaagcacaaaagacatctggtactcgctgcctgtcaacagcagtctactgtggagtgctttgcctttggtatatcaggggtccagaaatatactagagcacttcatgattcaagtatcacagagtatcttgcttctctaagcacatacaatgatcaatccattacttttgctttggaggatgaaagttatgagatatatgttgaagacttgaaaaaagatgaaaagaaagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctatgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagatgtcttaggcaacactcagagcagatctcccttactgtcaggggatatggaacttcaaaggcccacatggcaagccaggtaacataaatgtgtgaaaaagtaaagataactaaaaaatttagaaaaataaatccagtatttgtaaagtgaataacttcatttctaattgtttaatttttaaaattctgatttttatatattgagtttaagcaaggcattcttacacgaggaagtgaagtaaattttagttcagacataaaatttcacttattaggaatatgtaacatgctaaaacttttttttttttaaagagtactgagtcacaacatgttttagagcatccaagtaccatataatccaactatcatggtaaggccagaaatcttctaacctaccagagcctagatgagacaccgaattaacattaaaatttcagtaactgactgtccctcatgtccatggcctaccatcccttctgaccctggcttccagggacctatgtcttttaatactcactgtcacattgggcaaagttgcttctaatccttatttcccatgtgcacaagtctttttgtattccagcttcctgataacactgcttactgtggaatattcatttgacatctgtctcttttcatttcttttaactaccatgcccttgatatatcttttgcacctgctgaacttcatttctgtatcacctgacctctggatgccaaaacgtttattctgctttgtctgttgtagaattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctagtagaatataagataaaagaggctgagaattaccatacaagggtattacaactgtaaaacaatttatctttgtttcattgttctgtcaataattgttaccaaagagataaaaataaaagcagaatgtatatcatcccatctgaaaaacactaattattgacatgtgcatctgtacaataaacttaaaatgattattaaataatcaaatatatctactacattgtttatattattgaataaagtatattttccaaatgtaaaaaaaaaaaaa

SEQ ID NO: 103 - DNA, 2592 bp, Homo sapiens
agtctacagactcctccgaacacagagctgcagctcttcagggaagaaatcaaaacaagatcacaagaatactgaaaaatgaagcctaaaatgaagtattcaaccaacaaaatttccacagcaaagtggaagaacacagcaagcaaagccttgtgtttcaagctgggaaaatcccaacagaaggccaaagaagtttgccccatgtactttatgaagctccgctctggccttatgataaaaaaggaggcctgttactttaggagagaaaccaccaaaaggccttcactgaaaacaggaatttcacctattacagagtatcttgcttctctaagcacatacaatgatcaatccattacttttgctttggaggatgaaagttatgagatatatgttgaagacttgaaaaaagatgaaaagaaagataaggtgttactgagttactatgagtctcaacacccctcaaatgaatcaggtgacggtgttgatggtaagatgttaatggtaaccctgagtcctacaaaagacttctggttgcatgccaacaacaaggaacactctgtggagctccataagtgtgaaaaaccactgccagaccaggccttctttgtccttcataatatgcactccaactgtgtttcatttgaatgcaagactgatcctggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagtttcagtccagaaagaacttcatatttagagctaaggccactgaggaaagagccatagcttaagtctctatgtagacagggatccattttaaagagctacttagagaaataattttccacagttccaaacgataggctcaaacactagagctgctagtaaaaagaagaccagatgcttcacagaattatcattttttcaactggaataaaacaccaggtttgtttgtagatgtcttaggcaacactcagagcagatctcccttactgtcaggggatatggaacttcaaaggcccacatggcaagccaggtaacataaatgtgtgaaaaagtaaagataactaaaaaatttagaaaaataaatccagtatttgtaaagtgaataacttcatttctaattgtttaatttttaaaattctgatttttatatattgagtttaagcaaggcattcttacacgaggaagtgaagtaaattttagttcagacataaaatttcacttattaggaatatgtaacatgctaaaacttttttttttttaaagagtactgagtcacaacatgttttagagcatccaagtaccatataatccaactatcatggtaaggccagaaatcttctaacctaccagagcctagatgagacaccgaattaacattaaaatttcagtaactgactgtccctcatgtccatggcctaccatcccttctgaccctggcttccagggacctatgtcttttaatactcactgtcacattgggcaaagttgcttctaatccttatttcccatgtgcacaagtctttttgtattccagcttcctgataacactgcttactgtggaatattcatttgacatctgtctcttttcatttcttttaactaccatgcccttgatatatcttttgcacctgctgaacttcatttctgtatcacctgacctctggatgccaaaacgtttattctgctttgtctgttgtagaattttagataaagctattaatggcaatatttttttgctaaacgtttttgttttttactgtcactagggcaataaaatttatactcaaccatataataacattttttaactactaaaggagtagtttttattttaaagtcttagcaatttctattacaacttttcttagacttaacacttatgataaatgactaacatagtaacagaatctttatgaaatatgaccttttctgaaaatacatacttttacatttctactttattgagacctattagatgtaagtgctagtagaatataagataaaagaggctgagaattaccatacaagggtattacaactgtaaaacaatttatctttgtttcattgttctgtcaataattgttaccaaagagataaaaataaaagcagaatgtatatcatcccatctgaaaaacactaattattgacatgtgcatctgtacaataaacttaaaatgattattaaataatcaaatatatctactacattgtttatattattgaataaagtatattttccaaatgtaaaaaaaaaaaaa

SEQ ID NO: 104 - DNA, 5170 bp, Homo sapiens
gtggccggcggccggagccgactcggagcgcgcggcgccggccgggaggagccggagagcggccgggccgggcggtgggggcgccggcctgccccgcgcgccccagggagcggcaggaatgtgacaatcgcgcgcccgcgcaccgaagcactcctcgctcggctcctagggctctcgcccctctgagctgagccgggttccgcccggggctgggatcccatcaccctccacggccgtccgtccaggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgttaaaaaaaaaaaaaaaaaa

SEQ ID NO: 105 - DNA, 4990 bp, Homo sapiens
attggcagctcttcacttgtatcttttcatatcaaaaatgggaggtgacacccagtttaaggaaaattccaaggcatttgtctcgactaatgtgaaagatgattacagtggccagaggactgccaaggctccttctcaagctgcttgagtcaatgagggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgttaaaaaaaaaaaaaaaaaa

SEQ ID NO: 106 - DNA, 5083 bp, Homo sapiens
attggcagctcttcacttgtatcttttcatatcaaaaatgggaggtgacacccagtttaaggaaaattccaaggcatttgtctcgactaatgtgaaagatgattacagtggccagaggactgccaaggctccttctcaagctgcttgagtcaatgagggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgttaaaaaaaaaaaaaaaaaa

SEQ ID NO: 107 - DNA, 5224 bp, Homo sapiens
attaaagccctaagaggctgtgacacagccatctccaaaaccccactttctccttcctttgagcctccgtaccagctggggcgtccggcaagatgtgagttgtcactctgctgcggcacagacctgaattaacaactctagctagggctgacttcaaaaagcactttcgttttttaataaccaacatcagctcagcaggcttcatttgggaaaagaaaccttgtcggattaccccgacattctccacctcctgggaggccagccattcccaaatgccccaaggatgaagaacggagacggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgttaaaaaaaaaaaaaaaaaa

SEQ ID NO: 108 - DNA, 5065 bp, Homo sapiens
aggatggcccatgaagacctccaaacaagctggaggggccagtcacttgctgaagactagcgaagtggagggggaaagcccgagggagctgcagactcgaccactgcgccctcccctcctctccctgcaaggagcccaaggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgttaaaaaaaaaaaaaaaaaa

SEQ ID NO: 109 - DNA, 5007 bp, Homo sapiens
ctgatgccctggagtcgccaactcaattcgcgggtcgcagccaggctccatgggggtagtagagccaggtcgtagtggctaggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgttaaaaaaaaaaaaaaaaaa

SEQ ID NO: 110 - DNA, 4858 bp, Homo sapiens
gtagacgcaccctctgaagatggtgactccctcctgagaagctggaccccttggtaaaagacaaggccttctccaagataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgttaaaaaaaaaaaaaaaaaa

SEQ ID NO: 111 - DNA, 4735 bp, Homo sapiens
gtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgttaaaaaaaaaaaaaaaaaa

SEQ ID NO: 112 - DNA, 4756 bp, Homo sapiens
gtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcacctggaatcagattattaagggaataagccatgacgtcaatagcagcccagggcacttcagagtagagggcttgggaagatcttttaaaaaggcagtaggcccggtgtggtggctcacgcctataatcccagcactttgggaggctgaagtgggtggatcaccagaggtcaggagttcgagaccagcccagccaacatggcaaaaccccatctctactaaaaatacaaaaatgagctaggcatggtggcacacgcctgtaatcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccctggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattattctaattttatatatagagaaagtgacctattttttaaaaaaatcacactctaagttctattgaacctaggacttgagcctccatttctggcttctagtctggtgttctgagtacttgatttcaggtcaataacggtcccccctcactccacactggcacgtttgtgagaagaaatgacattttgctaggaagtgaccgagtctaggaatgcttttattcaagacaccaaattccaaacttctaaatgttggaattttcaaaaattgtgtttagattttatgaaaaactcttctactttcatctattctttccctagaggcaaacatttcttaaaatgtttcattttcattaaaaatgaaagccaaatttatatgccaccgattgcaggacacaagcacagttttaagagttgtatgaacatggagaggacttttggtttttatatttctcgtatttaatatgggtgaacaccaacttttatttggaataataattttcctcctaaacaaaaacacattgagtttaagtctctgactcttgcctttccacctgctttctcctgggcccgctttgcctgcttgaaggaacagtgctgttctggagctgctgttccaacagacagggcctagctttcatttgacacacagactacagccagaagcccatggagcagggatgtcacgtcttgaaaagcctattagatgttttacaaatttaattttgcagattattttagtctgtcatccagaaaatgtgtcagcatgcatagtgctaagaaagcaagccaatttggaaacttaggttagtgacaaaattggccagagagtgggggtgatgatgaccaagaattacaagtagaatggcagctggaatttaaggagggacaagaatcaatggataagcgtgggtggaggaagatccaaacagaaaagtgcaaagttattccccatcttccaagggttgaattctggaggaagaagacacattcctagttccccgtgaacttcctttgacttattgtccccactaaaacaaaacaaaaaacttttaatgccttccacattaattagattttcttgcagtttttttatggcatttttttaaagatgccctaagtgttgaagaagagtttgcaaatgcaacaaaatatttaattaccggttgttaaaactggtttagcacaatttatattttccctctcttgcctttcttatttgcaataaaaggtattgagccattttttaaatgacatttttgataaattatgtttgtactagttgatgaaggagttttttttaacctgtttatataattttgcagcagaagccaaattttttgtatattaaagcaccaaattcatgtacagcatgcatcacggatcaatagactgtacttattttccaataaaattttcaaactttgtactgttaaaaaaaaaaaaaaaaaa

SEQ ID NO: 113 - DNA, 950 bp, Homo sapiens
attaaagccctaagaggctgtgacacagccatctccaaaaccccactttctccttcctttgagcctccgtaccagctggggcgtccggcaagatgtgagttgtcactctgctgcggcacagacctgaattaacaactctagctagggctgacttcaaaaagcactttcgttttttaataaccaacatcagctcagcaggcttcatttgggaaaagaaaccttgtcggattaccccgacattctccacctcctgggaggccagccattcccaaatgccccaaggatgaagaacggagacggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggtaattttattttaaatatgacatttcacttttccagaaaataaaatagttccctggacaatagaaaaaaaaaaaaaaaaaa

SEQ ID NO: 114 - DNA, 4801 bp, Homo sapiens
aaagggggaaaagaaagtgcggcggaaagtaagaggctcactggggaagactgccgggatccaggtctccggggtccgctttggccagaggcgcggaaggaagcagtgcccggcgacactgcacccatcccggctgcttttgctgcgccctctcagcttcccaagaaaggcatcgtcatgtgatcatcacctaagaactagaacatcagcaggccctagaagcctcactcttgcccctccctttaatatctcaaaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaagtgccagctccaagatacacagtggaactggcttgtggttttggagccacagtcctgctagtggtgattctcattgttgtttaccatgtttactggctagagatggtcctattttaccgggctcattttggaacagatgaaaccattttagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaattgtcacagatgagactttgagcttcattcagaaaagcagacgcctcctggttgttctaagccccaactacgtgctccagggaacccaagccctcctggagctcaaggctggcctagaaaatatggcctctcggggcaacatcaacgtcattttagtacagtacaaagctgtgaaggaaacgaaggtgaaagagctgaagagggctaagacggtgctcacggtcattaaatggaaaggggaaaaatccaagtatccacagggcaggttctggaagcagctgcaggtggccatgccagtgaagaaaagtcccaggcggtctagcagtgatgagcagggcctctcgtattcatctttgaaaaatgtatgaaaggaataatgaaaagggtaaaaagaacaaggggtgctccaggaagaaagagtccccccagtcttcattcgcagtttatggtttcataggcaaaaataatggtctaagcctcccaatagggataaatttagggtgactgtgtggctgactattctgcttcctcaggcaacactaaagtttagaaagatatcatcaacgttctgtcaccagtctctgatgccactatgttctttgcaggcaaagacttgttcaatgcgaatttccccttctacattgtctatccctgtttttatatgtctccattctttttaaaatcttaacatatggagcagcctttcctatgaatttaaatatgcctttaaaataagtcactgttgacagggtcatgagtttccgagtatagttttctttttatcttatttttactcgtccgttgaaaagataatcaaggcctacattttagctgaggataatgaacttttttcctcattcggctgtataatacataaccacagcaagactgacatccacttaggatgatacaaagcagtgtaactgaaaatgtttcttttaattgatttaaaggacttgtcttctataccacccttgtcctcatctcaggtaatttatgaaatctatgtaaacttgaaaaatatttcttaatttttgtttttgctccagtcaattcctgattatccacaggtcaacccacattttttcattccttctccctatctgcttatatcgcattgctcatttagagtttgcaggaggctccatactaggttcagtctgaaagaaatctcctaatggtgctatagagagggaggtaacagaaagactcttttagggcatttttctgactcatgaaaagagcacagaaaaggatgtttggcaatttgtcttttaagtcttaaccttgctaatgtgaatactgggaaagtgattttttctcactcgtttttgttgctccattgtaaagggcggaggtcagtcttagtggccttgagagttgcttttggcattaatattctaagagaattaactgtatttcctgtcacctattcactagtgcaggaaatatacttgctccaaataagtcagtatgagaagtcactgtcaatgaaagttgttttgtttgttttcagtaatattttgctgtttttaagacttggaaaactaagtgcagagtttacagagtggtaaatatctatgttacatgtagattatacatatatatacacacgtgtatatgagatatatatcttatatctccacaaacacaaattatatatatacatatccacacacatacattacatatatctgtgtatataaatccacatgcacatgaaatatatatatatatataatttgtgtgtgtgtatgtgtatgtatatgactttaaatagctatgggtacaatattaaaaaccactggaactcttgtccagtttttaaattatgtttttactggaatgtttttgtgtcagtgttttctgtacatattatttgttaattcacagctcacagagtgatagttgtcatagttcttgccttccctaagtttatataaataacttaagtattgctacagtttatctaggttgcagtggcatctgctgtgcacagagcttccatggtcactgctaagcagtagccagccatcgggcattaattgatttcctactatattcccagcagacacatttagaaactaagctatgttaacctcagtgctcaactatttgaactgttgagtgataaaggaaacaaatataactgtaaatgaatcttggtatcctgtgaaacagaataattcgtaatttaagaaagcccttatcccggtaacatgaatgttgatgaacaaatgtaaaattatatcctatatttaagtacccataataaatcatttccctctataagtgttattgattattttaaattgaaaaaagtttcacttggatgaaaaaagtagaaaagtaggtcattcttggatctacttttttttagccttattaatatttttccctattagaaaccacaattactccctctattaacccttcacttactagaccagaaaagaacttattccagataagctttgaatatcaattcttacataaactttaggcaaacagggaatagtctagtcaccaaaggaccattctcttgccaatgctgcattccttttgcacttttggattccatatttatcccaaatgctgttgggcacccctagaaataccttgatgttttttctatttatatgcctgcctttggtacttaattttacaaatgctgtaatataaagcatatcaagtttatgtgatacgtatcattgcaagagaatttgtttcaagatttttttttaatgttccagaagatggccaatagagaacattcaagggaaatggggaaacataatttagagaacaagaacaaaccatgtctcaaatttttttaaaaaaaattaatggttttaaatatatgctatagggacgttccatgcccaggttaacaaagaactgtgatatatagagtgtctaattacaaaatcatatacgatttatttaattctcttctgtattgtaacttagatgattcccaaggactctaataaaaaatcacttcattgtatttggaaacaaaaacatcattcattaattacttattttctttccataggttttaatattttgagagtgtcttttttatttcattcatgaacttttgtatttttcatttttcatttgatttgtaaatttacttatgttaaaaataaaccatttattttcagctttgaattttaaaaaaaaaaaaaaaaaa

SEQ ID NO: 115 - DNA, 2114 bp, Homo sapiens
aaagggggaaaagaaagtgcggcggaaagtaagaggctcactggggaagactgccgggatccaggtctccggggtccgctttggccagaggcgcggaaggaagcagtgcccggcgacactgcacccatcccggctgcttttgctgcgccctctcagcttcccaagaaaggcatcgtcatgtgatcatcacctaagaactagaacatcagcaggccctagaagcctcactcttgcccctccctttaatatctcaaaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaaggtaatagatgcggtcagtgatgaatctctcagctccaaattaacattgtggtgaataaggacaaaaggagagattgagaacaagagagctccagcacctagcccgacggcatctaacccatagtaatgaatcaaacttaaatgaaaaatatgaaagttttcatctatgtaagatactcaaaatattgtttctgatattgttagtaccgtaatgcccaaatgtagctaaaaaaatcgacgtgagtacagtgagacacaattttgtgtctgtacaattatgaaaaattaaaaacaaagaaaatattcaaagctaccaaagatagaaaaaactggtagagccacatattgttggtgaattattaagacccttttaaaaatcattcatggtagacttcaagagtcataaaaaagattgcatcatctgacctaagactttcggaatttttcctgaacaaataacagaaagggaattatataccttttaatattattagaagcattatctgtagttgtaaaacattattaatagcagccatccaattgtatgcaactaattaaggtattgaatgtttattttccaaaaatgcataattataatattattttaaacactatgtatcaatatttaagcaggtttataatataccagcagccacaattgctaaaatgaaaatcatttaaattatgattttaaatggtataaacatgatttctatgttgatagtactatattattctacaataaatggaaattataaagccttcttgtcagaagtgctgctcctaaaaaaaaaaaaaaaaaaaaaa

SEQ ID NO: 116 - DNA, 4965 bp, Homo sapiens
aaagggggaaaagaaagtgcggcggaaagtaagaggctcactggggaagactgccgggatccaggtctccggggtccgctttggccagaggcgcggaaggaagcagtgcccggcgacactgcacccatcccggctgcttttgctgcgccctctcagcttcccaagaaagggctttgacctgaagcttgaaattgagtttgggacaataatgtgtctcatggggaattgcatggactccttatcataagccaaatgctgaggtaaagctgcggaattgagtcgtcctccaagaagggagagaaaatgatgtcttgtgacatttccagataactggcatcgtcatgtgatcatcacctaagaactagaacatcagcaggccctagaagcctcactcttgcccctccctttaatatctcaaaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaagtgccagctccaagatacacagtggaactggcttgtggttttggagccacagtcctgctagtggtgattctcattgttgtttaccatgtttactggctagagatggtcctattttaccgggctcattttggaacagatgaaaccattttagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaattgtcacagatgagactttgagcttcattcagaaaagcagacgcctcctggttgttctaagccccaactacgtgctccagggaacccaagccctcctggagctcaaggctggcctagaaaatatggcctctcggggcaacatcaacgtcattttagtacagtacaaagctgtgaaggaaacgaaggtgaaagagctgaagagggctaagacggtgctcacggtcattaaatggaaaggggaaaaatccaagtatccacagggcaggttctggaagcagctgcaggtggccatgccagtgaagaaaagtcccaggcggtctagcagtgatgagcagggcctctcgtattcatctttgaaaaatgtatgaaaggaataatgaaaagggtaaaaagaacaaggggtgctccaggaagaaagagtccccccagtcttcattcgcagtttatggtttcataggcaaaaataatggtctaagcctcccaatagggataaatttagggtgactgtgtggctgactattctgcttcctcaggcaacactaaagtttagaaagatatcatcaacgttctgtcaccagtctctgatgccactatgttctttgcaggcaaagacttgttcaatgcgaatttccccttctacattgtctatccctgtttttatatgtctccattctttttaaaatcttaacatatggagcagcctttcctatgaatttaaatatgcctttaaaataagtcactgttgacagggtcatgagtttccgagtatagttttctttttatcttatttttactcgtccgttgaaaagataatcaaggcctacattttagctgaggataatgaacttttttcctcattcggctgtataatacataaccacagcaagactgacatccacttaggatgatacaaagcagtgtaactgaaaatgtttcttttaattgatttaaaggacttgtcttctataccacccttgtcctcatctcaggtaatttatgaaatctatgtaaacttgaaaaatatttcttaatttttgtttttgctccagtcaattcctgattatccacaggtcaacccacattttttcattccttctccctatctgcttatatcgcattgctcatttagagtttgcaggaggctccatactaggttcagtctgaaagaaatctcctaatggtgctatagagagggaggtaacagaaagactcttttagggcatttttctgactcatgaaaagagcacagaaaaggatgtttggcaatttgtcttttaagtcttaaccttgctaatgtgaatactgggaaagtgattttttctcactcgtttttgttgctccattgtaaagggcggaggtcagtcttagtggccttgagagttgcttttggcattaatattctaagagaattaactgtatttcctgtcacctattcactagtgcaggaaatatacttgctccaaataagtcagtatgagaagtcactgtcaatgaaagttgttttgtttgttttcagtaatattttgctgtttttaagacttggaaaactaagtgcagagtttacagagtggtaaatatctatgttacatgtagattatacatatatatacacacgtgtatatgagatatatatcttatatctccacaaacacaaattatatatatacatatccacacacatacattacatatatctgtgtatataaatccacatgcacatgaaatatatatatatatataatttgtgtgtgtgtatgtgtatgtatatgactttaaatagctatgggtacaatattaaaaaccactggaactcttgtccagtttttaaattatgtttttactggaatgtttttgtgtcagtgttttctgtacatattatttgttaattcacagctcacagagtgatagttgtcatagttcttgccttccctaagtttatataaataacttaagtattgctacagtttatctaggttgcagtggcatctgctgtgcacagagcttccatggtcactgctaagcagtagccagccatcgggcattaattgatttcctactatattcccagcagacacatttagaaactaagctatgttaacctcagtgctcaactatttgaactgttgagtgataaaggaaacaaatataactgtaaatgaatcttggtatcctgtgaaacagaataattcgtaatttaagaaagcccttatcccggtaacatgaatgttgatgaacaaatgtaaaattatatcctatatttaagtacccataataaatcatttccctctataagtgttattgattattttaaattgaaaaaagtttcacttggatgaaaaaagtagaaaagtaggtcattcttggatctacttttttttagccttattaatatttttccctattagaaaccacaattactccctctattaacccttcacttactagaccagaaaagaacttattccagataagctttgaatatcaattcttacataaactttaggcaaacagggaatagtctagtcaccaaaggaccattctcttgccaatgctgcattccttttgcacttttggattccatatttatcccaaatgctgttgggcacccctagaaataccttgatgttttttctatttatatgcctgcctttggtacttaattttacaaatgctgtaatataaagcatatcaagtttatgtgatacgtatcattgcaagagaatttgtttcaagatttttttttaatgttccagaagatggccaatagagaacattcaagggaaatggggaaacataatttagagaacaagaacaaaccatgtctcaaatttttttaaaaaaaattaatggttttaaatatatgctatagggacgttccatgcccaggttaacaaagaactgtgatatatagagtgtctaattacaaaatcatatacgatttatttaattctcttctgtattgtaacttagatgattcccaaggactctaataaaaaatcacttcattgtatttggaaacaaaaacatcattcattaattacttattttctttccataggttttaatattttgagagtgtcttttttatttcattcatgaacttttgtatttttcatttttcatttgatttgtaaatttacttatgttaaaaataaaccatttattttcagctttgaattttaaaaaaaaaaaaaaaaaa

SEQ ID NO: 117 - DNA, 4714 bp, Homo sapiens
aaagggggaaaagaaagtgcggcggaaagtaagaggctcactggggaagactgccgggatccaggtctccggggtccgctttggccagaggcgcggaaggaagcagtgcccggcgacactgcacccatcccggctgcttttgctgcgccctctcagcttcccaagaaaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaagtgccagctccaagatacacagtggaactggcttgtggttttggagccacagtcctgctagtggtgattctcattgttgtttaccatgtttactggctagagatggtcctattttaccgggctcattttggaacagatgaaaccattttagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaattgtcacagatgagactttgagcttcattcagaaaagcagacgcctcctggttgttctaagccccaactacgtgctccagggaacccaagccctcctggagctcaaggctggcctagaaaatatggcctctcggggcaacatcaacgtcattttagtacagtacaaagctgtgaaggaaacgaaggtgaaagagctgaagagggctaagacggtgctcacggtcattaaatggaaaggggaaaaatccaagtatccacagggcaggttctggaagcagctgcaggtggccatgccagtgaagaaaagtcccaggcggtctagcagtgatgagcagggcctctcgtattcatctttgaaaaatgtatgaaaggaataatgaaaagggtaaaaagaacaaggggtgctccaggaagaaagagtccccccagtcttcattcgcagtttatggtttcataggcaaaaataatggtctaagcctcccaatagggataaatttagggtgactgtgtggctgactattctgcttcctcaggcaacactaaagtttagaaagatatcatcaacgttctgtcaccagtctctgatgccactatgttctttgcaggcaaagacttgttcaatgcgaatttccccttctacattgtctatccctgtttttatatgtctccattctttttaaaatcttaacatatggagcagcctttcctatgaatttaaatatgcctttaaaataagtcactgttgacagggtcatgagtttccgagtatagttttctttttatcttatttttactcgtccgttgaaaagataatcaaggcctacattttagctgaggataatgaacttttttcctcattcggctgtataatacataaccacagcaagactgacatccacttaggatgatacaaagcagtgtaactgaaaatgtttcttttaattgatttaaaggacttgtcttctataccacccttgtcctcatctcaggtaatttatgaaatctatgtaaacttgaaaaatatttcttaatttttgtttttgctccagtcaattcctgattatccacaggtcaacccacattttttcattccttctccctatctgcttatatcgcattgctcatttagagtttgcaggaggctccatactaggttcagtctgaaagaaatctcctaatggtgctatagagagggaggtaacagaaagactcttttagggcatttttctgactcatgaaaagagcacagaaaaggatgtttggcaatttgtcttttaagtcttaaccttgctaatgtgaatactgggaaagtgattttttctcactcgtttttgttgctccattgtaaagggcggaggtcagtcttagtggccttgagagttgcttttggcattaatattctaagagaattaactgtatttcctgtcacctattcactagtgcaggaaatatacttgctccaaataagtcagtatgagaagtcactgtcaatgaaagttgttttgtttgttttcagtaatattttgctgtttttaagacttggaaaactaagtgcagagtttacagagtggtaaatatctatgttacatgtagattatacatatatatacacacgtgtatatgagatatatatcttatatctccacaaacacaaattatatatatacatatccacacacatacattacatatatctgtgtatataaatccacatgcacatgaaatatatatatatatataatttgtgtgtgtgtatgtgtatgtatatgactttaaatagctatgggtacaatattaaaaaccactggaactcttgtccagtttttaaattatgtttttactggaatgtttttgtgtcagtgttttctgtacatattatttgttaattcacagctcacagagtgatagttgtcatagttcttgccttccctaagtttatataaataacttaagtattgctacagtttatctaggttgcagtggcatctgctgtgcacagagcttccatggtcactgctaagcagtagccagccatcgggcattaattgatttcctactatattcccagcagacacatttagaaactaagctatgttaacctcagtgctcaactatttgaactgttgagtgataaaggaaacaaatataactgtaaatgaatcttggtatcctgtgaaacagaataattcgtaatttaagaaagcccttatcccggtaacatgaatgttgatgaacaaatgtaaaattatatcctatatttaagtacccataataaatcatttccctctataagtgttattgattattttaaattgaaaaaagtttcacttggatgaaaaaagtagaaaagtaggtcattcttggatctacttttttttagccttattaatatttttccctattagaaaccacaattactccctctattaacccttcacttactagaccagaaaagaacttattccagataagctttgaatatcaattcttacataaactttaggcaaacagggaatagtctagtcaccaaaggaccattctcttgccaatgctgcattccttttgcacttttggattccatatttatcccaaatgctgttgggcacccctagaaataccttgatgttttttctatttatatgcctgcctttggtacttaattttacaaatgctgtaatataaagcatatcaagtttatgtgatacgtatcattgcaagagaatttgtttcaagatttttttttaatgttccagaagatggccaatagagaacattcaagggaaatggggaaacataatttagagaacaagaacaaaccatgtctcaaatttttttaaaaaaaattaatggttttaaatatatgctatagggacgttccatgcccaggttaacaaagaactgtgatatatagagtgtctaattacaaaatcatatacgatttatttaattctcttctgtattgtaacttagatgattcccaaggactctaataaaaaatcacttcattgtatttggaaacaaaaacatcattcattaattacttattttctttccataggttttaatattttgagagtgtcttttttatttcattcatgaacttttgtatttttcatttttcatttgatttgtaaatttacttatgttaaaaataaaccatttattttcagctttgaattttaaaaaaaaaaaaaaaaaa

SEQ ID NO: 118 - DNA, 2027 bp, Homo sapiens
aaagggggaaaagaaagtgcggcggaaagtaagaggctcactggggaagactgccgggatccaggtctccggggtccgctttggccagaggcgcggaaggaagcagtgcccggcgacactgcacccatcccggctgcttttgctgcgccctctcagcttcccaagaaaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaaggtaatagatgcggtcagtgatgaatctctcagctccaaattaacattgtggtgaataaggacaaaaggagagattgagaacaagagagctccagcacctagcccgacggcatctaacccatagtaatgaatcaaacttaaatgaaaaatatgaaagttttcatctatgtaagatactcaaaatattgtttctgatattgttagtaccgtaatgcccaaatgtagctaaaaaaatcgacgtgagtacagtgagacacaattttgtgtctgtacaattatgaaaaattaaaaacaaagaaaatattcaaagctaccaaagatagaaaaaactggtagagccacatattgttggtgaattattaagacccttttaaaaatcattcatggtagacttcaagagtcataaaaaagattgcatcatctgacctaagactttcggaatttttcctgaacaaataacagaaagggaattatataccttttaatattattagaagcattatctgtagttgtaaaacattattaatagcagccatccaattgtatgcaactaattaaggtattgaatgtttattttccaaaaatgcataattataatattattttaaacactatgtatcaatatttaagcaggtttataatataccagcagccacaattgctaaaatgaaaatcatttaaattatgattttaaatggtataaacatgatttctatgttgatagtactatattattctacaataaatggaaattataaagccttcttgtcagaagtgctgctcctaaaaaaaaaaaaaaaaaaaaaa

SEQ ID NO: 119 - DNA, 2930 bp, Homo sapiens
aaagggggaaaagaaagtgcggcggaaagtaagaggctcactggggaagactgccgggatccaggtctccggggtccgctttggccagaggcgcggaaggaagcagtgcccggcgacactgcacccatcccggctgcttttgctgcgccctctcagcttcccaagaaaggcatcgtcatgtgatcatcacctaagaactagaacatcagcaggccctagaagcctcactcttgcccctccctttaatatctcaaaggatgacacttctgtggtgtgtagtgagtctctacttttatggaatcctgcaaagtgatgcctcagaacgctgcgatgactggggactagacaccatgaggcaaatccaagtgtttgaagatgagccagctcgcatcaagtgcccactctttgaacacttcttgaaattcaactacagcacagcccattcagctggccttactctgatctggtattggactaggcaggaccgggaccttgaggagccaattaacttccgcctccccgagaaccgcattagtaaggagaaagatgtgctgtggttccggcccactctcctcaatgacactggcaactatacctgcatgttaaggaacactacatattgcagcaaagttgcatttcccttggaagttgttcaaaaagacagctgtttcaattcccccatgaaactcccagtgcataaactgtatatagaatatggcattcagaggatcacttgtccaaatgtagatggatattttccttccagtgtcaaaccgactatcacttggtatatgggctgttataaaatacagaattttaataatgtaatacccgaaggtatgaacttgagtttcctcattgccttaatttcaaataatggaaattacacatgtgttgttacatatccagaaaatggacgtacgtttcatctcaccaggactctgactgtaaaggtagtaggctctccaaaaaatgcagtgccccctgtgatccattcacctaatgatcatgtggtctatgagaaagaaccaggagaggagctactcattccctgtacggtctattttagttttctgatggattctcgcaatgaggtttggtggaccattgatggaaaaaaacctgatgacatcactattgatgtcaccattaacgaaagtataagtcatagtagaacagaagatgaaacaagaactcagattttgagcatcaagaaagttacctctgaggatctcaagcgcagctatgtctgtcatgctagaagtgccaaaggcgaagttgccaaagcagccaaggtgaagcagaaagtgccagctccaagatacacagtggaactggcttgtggttttggagccacagtcctgctagtggtgattctcattgttgtttaccatgtttactggctagagatggtcctattttaccgggctcattttggaacagatgaaaccattttagatggaaaagagtatgatatttatgtatcctatgcaaggaatgcggaagaagaagaatttgtattactgaccctccgtggagttttggagaatgaatttggatacaagctgtgcatctttgaccgagacagtctgcctgggggaaatacagtggaagcagtttttgatttcattcagagaagcagaaggatgattgttgttctgagccctgactatgtgacagaaaagagcatcagcatgctggagtttaaactgggtgtcatgtgccagaactccattgccaccaagctcattgtggttgagtaccgtccccttgagcacccgcacccaggcattcttcagctcaaagagtctgtgtcttttgtgagctggaagggagaaaagtccaaacattctggctctaaattctggaaagctttgcggttggctcttcccctgagaagtctgagtgccagttctggctggaatgagagctgctcttcccagtctgacatcagtctggatcacgttcaaaggaggagaagtcgtttgaaagagcccccagaacttcagagctcagagagggctgcaggtagccctccagccccaggcacaatgtccaagcaccgagggaagtcctccgccacctgccgctgttgtgtcacctactgtgaaggagagaatcaccttaggaacaagagccgggcagagattcataaccagccccagtgggagacacacctctgtaagcctgttccccaagagtcagaaactcaatggatacaaaatggcaccagattggaaccccctgctccccagatctcagcccttgctcttcatcatttcacggacttatccaataacaacgacttttatatcctataattactgtgtgtggtgggtggtggctactatctctaccaaccctctgtatgtcatgaacctgtgggaaaatctgacatttttatcatctaatggactatcagatttctgtcccctttattgatttttaaaaactatttatttctaggagacaaaagacctgaaggacctgaatccagaattattgcctctaaaggcctcagaagagcacactcttcttgggccctagaaggtcagtatgtgaaagttgcctaaagtctgatcctctatcttgtccaatggtttaaaactgagctaagaatttaaatgtgtttcttttcagtgagttgatcaacctcacattataagtcagtcaggtgtacttgggctatgatgcttacagggtgtatgcattcccagggagcagcatggaaaggagctggttctggtggaagctgtaggacgaagctcaacagaaaacctacagcacatttttcctcaaagaaccaaacatacccacccagggatacatggcgttctctgtctcactgtaaactagtgttctctaaactgcctaacattgttagcatcaataaaattctatttttacgtcaaaaaaaaaaaaaaaaaaaa

SEQ ID NO: 120 - DNA, 3661 bp, Homo sapiens
tcaggaggcggagatcgctgcttctcacctactttctgaacttggcctccgcagtcgcgacctggcgtgaaggaggagctgccgcccccgccccagcctcggggacgcctctctgaagagaagccatttgaagcagaatccaaaccatgaattgtagagaattacccttgaccctttgggtgcttatatctgtaagcactgcagaatcttgtacttcacgtccccacattactgtggttgaaggggaacctttctatctgaaacattgctcgtgttcacttgcacatgagattgaaacaaccaccaaaagctggtacaaaagcagtggatcacaggaacatgtggagctgaacccaaggagttcctcgagaattgctttgcatgattgtgttttggagttttggccagttgagttgaatgacacaggatcttactttttccaaatgaaaaattatactcagaaatggaaattaaatgtcatcagaagaaataaacacagctgtttcactgaaagacaagtaactagtaaaattgtggaagttaaaaaattttttcagataacctgtgaaaacagttactatcaaacactggtcaacagcacatcattgtataagaactgtaaaaagctactactggagaacaataaaaacccaacgataaagaagaacgccgagtttgaagatcaggggtattactcctgcgtgcatttccttcatcataatggaaaactatttaatatcaccaaaaccttcaatataacaatagtggaagatcgcagtaatatagttccggttcttcttggaccaaagcttaaccatgttgcagtggaattaggaaaaaacgtaaggctcaactgctctgctttgctgaatgaagaggatgtaatttattggatgttcggggaagaaaatggatcggatcctaatatacatgaagagaaagaaatgagaattatgactccagaaggcaaatggcatgcttcaaaagtattgagaattgaaaatattggtgaaagcaatctaaatgttttatataattgcactgtggccagcacgggaggcacagacaccaaaagcttcatcttggtgagaaaagcagacatggctgatatcccaggccacgtcttcacaagaggaatgatcatagctgttttgatcttggtggcagtagtgtgcctagtgactgtgtgtgtcatttatagagttgacttggttctattttatagacatttaacgagaagagatgaaacattaacagatggaaaaacatatgatgcttttgtgtcttacctaaaagaatgccgacctgaaaatggagaggagcacacctttgctgtggagattttgcccagggtgttggagaaacattttgggtataagttatgcatatttgaaagggatgtagtgcctggaggagctgttgttgatgaaatccactcactgatagagaaaagccgaagactaatcattgtcctaagtaaaagttatatgtctaatgaggtcaggtatgaacttgaaagtggactccatgaagcattggtggaaagaaaaattaaaataatcttaattgaatttacacctgttactgacttcacattcttgccccaatcactaaagcttttgaaatctcacagagttctgaagtggaaggccgataaatctctttcttataactcaaggttctggaagaaccttctttacttaatgcctgcaaaaacagtcaagccaggtagagacgaaccggaagtcttgcctgttctttccgagtcttaatcttcagaaacagtgaacgccaaaaagaactcaagatattctggggactgagcatatgaacctgttcataacaaaggctgtgactcgaaataattaactttgtcaaaatcctgctcacaatttgaagatgaaacttgtcattaggttggcgggaatgagactaaagattgcgctgtgggctgtggtcacgtgctcccagaagacctggaattcaaaagaaatggagctattctttttctccctctttcataactggatgcagctgctcatactcaatcccatattcagcaagtgtgaagctggacgtgatgcaaaataaccgatgccctacaaaaagggcgcatctttaagagttttaatgccagtgcttaattcgaatgaggggattttaagtgtctgaagaggcattttctagggaccagtgggtgactgagtaactgaaatgctgctttcactccctaacaccatggatctggttgtgcataggatgtgggaggaggggctggcagggccgccttcagaggctgcagggcctcagcctcaggatgcatttaatgtatcctggccacagttgcagccaacggttcttgaaagctcggtaaggccctgcaacgcagagcctgcttatgtggatctatttatgggaacttcttaaaaggaccccagaatagctctttatctttcacaagagacacaaattctaattgagttaattatctgggcctttcactttggatgctctgaaacatttgttgattttgtgtgaatgtttatatcaaaatgtttgccaggttgtattagccattgaatagcaaaaaactgatagttacttgcttgttttttaaaaattacatattaaaaatgcccttggcataaggcagcatggtgtggcagttaagagatgggctgtgcagcccatcctgagctccagtcctgagtttgctacttacttctgtggcctctggaaccttatccaacctcttggtgcttcagtttcctcatctgtgaaattagaatttataataattgcacctacctcccaggggtaactaaatgaataaatataataaagtacttacagtggttcctgacacagactcagcactccgtcagtgttgccatgactatttttattatcattattaatgattacttagatcaattatttagcagtggactaatggaagctacagagcagggaagggaagcagatctagggaggaaggcagttttgatttgaggaggtttgcacatgtagagaagcatactggagaagcatatccagagggcgaaagatatctctccattgtgcatctgcctcttttgacgttggaagacacatgtcttactccccaaagggagcccagcactgggagccttcttgatgatctcaaaaataatagctattcaagaaaatcaccaagtgactgtgaaaccgtcagttcggaaggctggttagaacatgtgggagcaacatgaatgttctacaaaagtttaaagcagagattgtttcaaatgggtgtagtagatattactgaaaaccaaaaaagagtgagattgtcagtgtaagaatgtgatttaatgtttgtagtgcttacaattttgtgtaccaactggatgactaaaaagagtaaaataatttaattaatagctcatattttatgtgtgaaaacatgttagtgaacatatataatcaaaatagatttcattgctattgcatagtctctaatacatagaatgattttgcttttctcttttattatacttgctttaaaatacttgaaatatattttgcattaaatgcatttcaagttaaatgtcttaaatgtatacattagatgtgtgttttaaaatgcataaaacacgttgaaatacattaatgaaccatt

SEQ ID NO: 121 - DNA, 3471 bp, Homo sapiens
tcaggaggcggagatcgctgcttctcacctactttctgaacttggcctccgcagtcgcgacctggcgtgaaggaggagctgccgcccccgccccagcctcggggacgcctctctgaagagaagccatttgaagcagaatccaaaccatgaattgtagagaattacccttgaccctttgggtgcttatatctgtaagcactgcagaaattatactcagaaatggaaattaaatgtcatcagaagaaataaacacagctgtttcactgaaagacaagtaactagtaaaattgtggaagttaaaaaattttttcagataacctgtgaaaacagttactatcaaacactggtcaacagcacatcattgtataagataggaccacctatttgcaggaaaacaagctcagggctccactgattctacattatgaactgtaaaaagctactactggagaacaataaaaacccaacgataaagaagaacgccgagtttgaagatcaggggtattactcctgcgtgcatttccttcatcataatggaaaactatttaatatcaccaaaaccttcaatataacaatagtggaagatcgcagtaatatagttccggttcttcttggaccaaagcttaaccatgttgcagtggaattaggaaaaaacgtaaggctcaactgctctgctttgctgaatgaagaggatgtaatttattggatgttcggggaagaaaatggatcggatcctaatatacatgaagagaaagaaatgagaattatgactccagaaggcaaatggcatgcttcaaaagtattgagaattgaaaatattggtgaaagcaatctaaatgttttatataattgcactgtggccagcacgggaggcacagacaccaaaagcttcatcttggtgagaaaagacatggctgatatcccaggccacgtcttcacaagaggaatgatcatagctgttttgatcttggtggcagtagtgtgcctagtgactgtgtgtgtcatttatagagttgacttggttctattttatagacatttaacgagaagagatgaaacattaacagatggaaaaacatatgatgcttttgtgtcttacctaaaagaatgccgacctgaaaatggagaggagcacacctttgctgtggagattttgcccagggtgttggagaaacattttgggtataagttatgcatatttgaaagggatgtagtgcctggaggagctgttgttgatgaaatccactcactgatagagaaaagccgaagactaatcattgtcctaagtaaaagttatatgtctaatgaggtcaggtatgaacttgaaagtggactccatgaagcattggtggaaagaaaaattaaaataatcttaattgaatttacacctgttactgacttcacattcttgccccaatcactaaagcttttgaaatctcacagagttctgaagtggaaggccgataaatctctttcttataactcaaggttctggaagaaccttctttacttaatgcctgcaaaaacagtcaagccaggtagagacgaaccggaagtcttgcctgttctttccgagtcttaatcttcagaaacagtgaacgccaaaaagaactcaagatattctggggactgagcatatgaacctgttcataacaaaggctgtgactcgaaataattaactttgtcaaaatcctgctcacaatttgaagatgaaacttgtcattaggttggcgggaatgagactaaagattgcgctgtgggctgtggtcacgtgctcccagaagacctggaattcaaaagaaatggagctattctttttctccctctttcataactggatgcagctgctcatactcaatcccatattcagcaagtgtgaagctggacgtgatgcaaaataaccgatgccctacaaaaagggcgcatctttaagagttttaatgccagtgcttaattcgaatgaggggattttaagtgtctgaagaggcattttctagggaccagtgggtgactgagtaactgaaatgctgctttcactccctaacaccatggatctggttgtgcataggatgtgggaggaggggctggcagggccgccttcagaggctgcagggcctcagcctcaggatgcatttaatgtatcctggccacagttgcagccaacggttcttgaaagctcggtaaggccctgcaacgcagagcctgcttatgtggatctatttatgggaacttcttaaaaggaccccagaatagctctttatctttcacaagagacacaaattctaattgagttaattatctgggcctttcactttggatgctctgaaacatttgttgattttgtgtgaatgtttatatcaaaatgtttgccaggttgtattagccattgaatagcaaaaaactgatagttacttgcttgttttttaaaaattacatattaaaaatgcccttggcataaggcagcatggtgtggcagttaagagatgggctgtgcagcccatcctgagctccagtcctgagtttgctacttacttctgtggcctctggaaccttatccaacctcttggtgcttcagtttcctcatctgtgaaattagaatttataataattgcacctacctcccaggggtaactaaatgaataaatataataaagtacttacagtggttcctgacacagactcagcactccgtcagtgttgccatgactatttttattatcattattaatgattacttagatcaattatttagcagtggactaatggaagctacagagcagggaagggaagcagatctagggaggaaggcagttttgatttgaggaggtttgcacatgtagagaagcatactggagaagcatatccagagggcgaaagatatctctccattgtgcatctgcctcttttgacgttggaagacacatgtcttactccccaaagggagcccagcactgggagccttcttgatgatctcaaaaataatagctattcaagaaaatcaccaagtgactgtgaaaccgtcagttcggaaggctggttagaacatgtgggagcaacatgaatgttctacaaaagtttaaagcagagattgtttcaaatgggtgtagtagatattactgaaaaccaaaaaagagtgagattgtcagtgtaagaatgtgatttaatgtttgtagtgcttacaattttgtgtaccaactggatgactaaaaagagtaaaataatttaattaatagctcatattttatgtgtgaaaacatgttagtgaacatatataatcaaaatagatttcattgctattgcatagtctctaatacatagaatgattttgcttttctcttttattatacttgctttaaaatacttgaaatatattttgcattaaatgcatttcaagttaaatgtcttaaatgtatacattagatgtgtgttttaaaatgcataaaacacgttgaaatacattaatgaaccatt

SEQ ID NO: 122 - DNA, 1964 bp, Homo sapiens
cccgcccacggtggcggggaaatacctaggcatggaagtggcatgacagggctcgtgtccctgtcatattttccactctccacgaggtcctgcgcgcttcaatcctgcaggcagcccggtttggggatgtggtccttgctgctctgcgggttgtccatcgcccttccactgtctgtcacagcagatggatgcaaggacatttttatgaaaaatgagatactttcagcaagccagccttttgcttttaattgtacattccctcccataacatctggggaagtcagtgtaacatggtataaaaattctagcaaaatcccagtgtccaaaatcatacagtctagaattcaccaggacgagacttggattttgtttctccccatggaatggggggactcaggagtctaccaatgtgttataaagggtagagacagctgtcatagaatacatgtaaacctaactgtttttgaaaaacattggtgtgacacttccataggtggtttaccaaatttatcagatgagtacaagcaaatattacatcttggaaaagatgatagtctcacatgtcatctgcacttcccgaagagttgtgttttgggtccaataaagtggtataaggactgtaacgagattaaaggggagcggttcactgttttggaaaccaggcttttggtgagcaatgtctcggcagaggacagagggaactacgcgtgtcaagccatactgacacactcagggaagcagtacgaggttttaaatggcatcactgtgagcattacagaaagagctggatatggaggaagtgtccctaaaatcatttatccaaaaaatcattcaattgaagtacagcttggtaccactctgattgtggactgcaatgtaacagacaccaaggataatacaaatctacgatgctggagagtcaataacactttggtggatgattactatgatgaatccaaacgaatcagagaaggggtggaaacccatgtctcttttcgggaacataatttgtacacagtaaacatcaccttcttggaagtgaaaatggaagattatggccttcctttcatgtgccacgctggagtgtccacagcatacattatattacagctcccagctccggattttcgagcttacttgataggagggcttatcgccttggtggctgtggctgtgtctgttgtgtacatatacaacatttttaagatcgacattgttctttggtatcgaagtgccttccattctacagagaccatagtagatgggaagctgtatgacgcctatgtcttataccccaagccccacaaggaaagccagaggcatgccgtggatgccctggtgttgaatatcctgcccgaggtgttggagagacaatgtggatataagttgtttatattcggcagagatgaattccctggacaagccgtggccaatgtcatcgatgaaaacgttaagctgtgcaggaggctgattgtcattgtggtccccgaatcgctgggctttggcctgttgaagaacctgtcagaagaacaaatcgcggtctacagtgccctgatccaggacgggatgaaggttattctcattgagctggagaaaatcgaggactacacagtcatgccagagtcaattcagtacatcaaacagaagcatggtgccatccggtggcatggggacttcacggagcagtcacagtgtatgaagaccaagttttggaagacagtgagataccacatgccgcccagaaggtgtcggccgtttcctccggtccagctgctgcagcacacaccttgctaccgcaccgcaggcccagaactaggctcaagaagaaagaagtgtactctcacgactggctaagacttgctggactgacacctatggctggaagatgacttgttttgctccatgtctcctcattcctacacctattttctgctgcaggatgaggctagggttagcattctaga

SEQ ID NO: 123 - DNA, 2058 bp, Homo sapiens
aaagagaggctggctgttgtatttagtaaagctataaagctgtaagagaaattggctttctgagttgtgaaactgtgggcagaaagttgaggaagaaagaactcaagtacaacccaatgaggttgagatataggctactcttcccaactcagtcttgaagagtatcaccaactgcctcatgtgtggtgaccttcactgtcgtatgccagtgactcatctggagtaatctcaacaacgagttaccaatacttgctcttgattgataaacagaatggggttttggatcttagcaattctcacaattctcatgtattccacagcagcaaagtttagtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgcagttgctgattctggtatttatacctgtattgtcagaagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaaggatgagcaaggcttttctctgtttccagtaatcggagcccctgcacaaaatgaaataaaggaagtggaaattggaaaaaacgcaaacctaacttgctctgcttgttttggaaaaggcactcagttcttggctgccgtcctgtggcagcttaatggaacaaaaattacagactttggtgaaccaagaattcaacaagaggaagggcaaaatcaaagtttcagcaatgggctggcttgtctagacatggttttaagaatagctgacgtgaaggaagaggatttattgctgcagtacgactgtctggccctgaatttgcatggcttgagaaggcacaccgtaagactaagtaggaaaaatccaattgatcatcatagcatctactgcataattgcagtatgtagtgtatttttaatgctaatcaatgtcctggttatcatcctaaaaatgttctggattgaggccactctgctctggagagacatagctaaaccttacaagactaggaatgatggaaagctctatgatgcttatgttgtctacccacggaactacaaatccagtacagatggggccagtcgtgtagagcactttgttcaccagattctgcctgatgttcttgaaaataaatgtggctataccttatgcatttatgggagagatatgctacctggagaagatgtagtcactgcagtggaaaccaacatacgaaagagcaggcggcacattttcatcctgacccctcagatcactcacaataaggagtttgcctacgagcaggaggttgccctgcactgtgccctcatccagaacgacgccaaggtgatacttattgagatggaggctctgagcgagctggacatgctgcaggctgaggcgcttcaggactccctccagcatcttatgaaagtacaggggaccatcaagtggagggaggaccacattgccaataaaaggtccctgaattctaaattctggaagcacgtgaggtaccaaatgcctgtgccaagcaaaattcccagaaaggcctctagtttgactcccttggctgcccagaagcaatagtgcctgctgtgatgtgcaaaggcatctgagtttgaagctttcctgacttctcctagctggcttatgcccctgcactgaagtgtgaggagcaggaatattaaagggattcaggcctc

SEQ ID NO: 124 - DNA, 3909 bp, Homo sapiens
agtctatgaggagggacctacaaagactggaaactattcttagctccgtcactgactccaagttcatcccctctgtctttcagtttggttgagatataggctactcttcccaactcagtcttgaagagtatcaccaactgcctcatgtgtggtgaccttcactgtcgtatgccagtgactcatctggagtaatctcaacaacgagttaccaatacttgctcttgattgataaacagaatggggttttggatcttagcaattctcacaattctcatgtattccacagcagcaaagtttagtaaacaatcatggggcctggaaaatgaggctttaattgtaagatgtcctagacaaggaaaacctagttacaccgtggattggtattactcacaaacaaacaaaagtattcccactcaggaaagaaatcgtgtgtttgcctcaggccaacttctgaagtttctaccagctgcagttgctgattctggtatttatacctgtattgtcagaagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaaggatgagcaaggcttttctctgtttccagtaatcggagcccctgcacaaaatgaaataaaggaagtggaaattggaaaaaacgcaaacctaacttgctctgcttgttttggaaaaggcactcagttcttggctgccgtcctgtggcagcttaatggaacaaaaattacagactttggtgaaccaagaattcaacaagaggaagggcaaaatcaaagtttcagcaatgggctggcttgtctagacatggttttaagaatagctgacgtgaaggaagaggatttattgctgcagtacgactgtctggccctgaatttgcatggcttgagaaggcacaccgtaagactaagtaggaaaaatccaagtaaggagtgtttctgagactttgatcacctgaactttctctagcaagtgtaagcagaatggagtgtggttccaagagatccatcaagacaatgggaatggcctgtgccataaaatgtgcttctcttcttcgggatgttgtttgctgtctgatctttgtagactgttcctgtttgctgggagcttctctgctgcttaaattgttcgtcctcccccactccctcctatcgttggtttgtctagaacactcagctgcttctttggtcatccttgttttctaactttatgaactccctctgtgtcactgtatgtgaaaggaaatgcaccaacaaccgtaaactgaacgtgttcttttgtgctcttttataacttgcattacatgttgtaagcatggtccgttctatacctttttctggtcataatgaacactcattttgttagcgagggtggtaaagtgaacaaaaaggggaagtatcaaactactgccatttcagtgagaaaatcctaggtgctactttataataagacatttgttaggccattcttgcattgatataaagaaatacctgagactgggtgatttatatgaaaagaggtttaattggctcacagttctgcaggctgtatgggaagcatggcggcatctgcttctggggacacctcaggagctttactcatggcagaaggcaaagcaaaggcaggcacttcacacagtaaaagcaggagcgagagagaggtgccacactgaaacagccagatctcatgagaagtcactcactattgcaaggacagcatcaaagagatggtgctaaaccattcatgatgaactcacccccatgatccaatcacctcccaccaggctccacctcgaatactggggattaccattcagcatgagatttgggcaggaacacagacccaaaccataccacacacattatcattgttaaactttgtaaagtatttaaggtacatggaacacacgggaagtctggtagctcagcccatttctttattgcatctgttattcaccatgtaattcaggtaccacgtattccagggagcctttcttggccctcagtttgcagtatacacactttccaagtactcttgtagcatcctgtttgtatcatagcactggtcacattgccttacctaaatctgtttgacagtctgctcaacacgactgcaagctccatgagggcagggacatcatctcttccatctttgggtccttagtgcaatacctggcagctagccagtgctcagctaaatatttgttgactgaataaatgaatgcacaaccaaattattgataccaaatgttttttttgtgtacatttctacttctctagctataagtcttaattatacaacaaaatactatttttatatttatgtttggtaaattcaataactttcctcatcatttggaaagtcaaattgtttattgcttccctacagttttttctgaatctagcaggattttaatgatatcattataatttgacacaataaaaggacaacatgaaactgatgaatctttattgggttaatttcagacactatataatcttttaaaaatgtaacattcttttttatatataaataattggtggcatcacaaatagccaaagcagggtggagagagtgatccttcctgggtgcaggcaagaaggggatatgttttctacagagttttcaaaacagtgataaagctgtctacaagtcattgtgctttttatcatcactatgcccagacaatgtgaaacatcagagatgaagtgctcttcccacagaggtggactgatccttctccccactcccttggtgtgtctctgaatgcaatgttgtcttggaaaacagctttccaagcatttcactcctgagcacttgccagtttcctcacttgttcttcacatatccaggcaaagacatcctgtttgctatatgaagcattgtatcccgtataaaaggaaggaaagagagaaatatatttttacactcatcactcctcaggggctgtacaatcatgtagaaattgtttaatgtgcctgtcaaatagccaaagagtgttaaaccctgagttcccacccatgtgtgtggtatggttaggattcatccagatacacagagagaggcacaacaggaggagaaaggataggggtgtggggacagcgggcccccaatatggtgtaatcgtggcaggtctctgcctgaagtgctatgtggggtttttcttgttttaattttgactttaacccctgatttgtaagtttttcataaaataaacagaatcataactcatgtagatggctataagtgccgtagtgttctgtgggtctctggtgtctgccagtgataagtgtggcaccccaggaaggctgtggaccccatcaaggtgctatgtgagggccatgcttggggtggtggtgggcccagtagaccctgcagccatccatccagcctgcccactcacactgcccttgtgtactcctgctttgctacgttatcattgatcaatgtccctggttacctatgtgtttgaattatcttcgtgttacaggtgtttaatgattttgctccttctagcttatttgtatttcacctgtttttctttaaatcaacatggttacactctgtttcagcaactgtataaattaaacacaaattattactactgctaaaaaaaaaaaaaaaaaa

SEQ ID NO: 125 - DNA, 3589 bp, Homo sapiens
aaagagaggctggctgttgtatttagtaaagctataaagctgtaagagaaattggctttctgagttgtgaaactgtgggcagaaagttgaggaagaaagaactcaagtacaacccaatgagggccaacttctgaagtttctaccagctgcagttgctgattctggtatttatacctgtattgtcagaagtcccacattcaataggactggatatgcgaatgtcaccatatataaaaaacaatcagattgcaatgttccagattatttgatgtattcaacagtatctggatcagaaaaaaattccaaaatttattgtcctaccattgacctctacaactggacagcacctcttgagtggtttaagaattgtcaggctcttcaaggatcaaggtacagggcgcacaagtcatttttggtcattgataatgtgatgactgaggacgcaggtgattacacctgtaaatttatacacaatgaaaatggagccaattatagtgtgacggcgaccaggtccttcacggtcaaggatgagcaaggcttttctctgtttccagtaatcggagcccctgcacaaaatgaaataaaggaagtggaaattggaaaaaacgcaaacctaacttgctctgcttgttttggaaaaggcactcagttcttggctgccgtcctgtggcagcttaatggaacaaaaattacagactttggtgaaccaagaattcaacaagaggaagggcaaaatcaaagtttcagcaatgggctggcttgtctagacatggttttaagaatagctgacgtgaaggaagaggatttattgctgcagtacgactgtctggccctgaatttgcatggcttgagaaggcacaccgtaagactaagtaggaaaaatccaagtaaggagtgtttctgagactttgatcacctgaactttctctagcaagtgtaagcagaatggagtgtggttccaagagatccatcaagacaatgggaatggcctgtgccataaaatgtgcttctcttcttcgggatgttgtttgctgtctgatctttgtagactgttcctgtttgctgggagcttctctgctgcttaaattgttcgtcctcccccactccctcctatcgttggtttgtctagaacactcagctgcttctttggtcatccttgttttctaactttatgaactccctctgtgtcactgtatgtgaaaggaaatgcaccaacaaccgtaaactgaacgtgttcttttgtgctcttttataacttgcattacatgttgtaagcatggtccgttctatacctttttctggtcataatgaacactcattttgttagcgagggtggtaaagtgaacaaaaaggggaagtatcaaactactgccatttcagtgagaaaatcctaggtgctactttataataagacatttgttaggccattcttgcattgatataaagaaatacctgagactgggtgatttatatgaaaagaggtttaattggctcacagttctgcaggctgtatgggaagcatggcggcatctgcttctggggacacctcaggagctttactcatggcagaaggcaaagcaaaggcaggcacttcacacagtaaaagcaggagcgagagagaggtgccacactgaaacagccagatctcatgagaagtcactcactattgcaaggacagcatcaaagagatggtgctaaaccattcatgatgaactcacccccatgatccaatcacctcccaccaggctccacctcgaatactggggattaccattcagcatgagatttgggcaggaacacagacccaaaccataccacacacattatcattgttaaactttgtaaagtatttaaggtacatggaacacacgggaagtctggtagctcagcccatttctttattgcatctgttattcaccatgtaattcaggtaccacgtattccagggagcctttcttggccctcagtttgcagtatacacactttccaagtactcttgtagcatcctgtttgtatcatagcactggtcacattgccttacctaaatctgtttgacagtctgctcaacacgactgcaagctccatgagggcagggacatcatctcttccatctttgggtccttagtgcaatacctggcagctagccagtgctcagctaaatatttgttgactgaataaatgaatgcacaaccaaattattgataccaaatgttttttttgtgtacatttctacttctctagctataagtcttaattatacaacaaaatactatttttatatttatgtttggtaaattcaataactttcctcatcatttggaaagtcaaattgtttattgcttccctacagttttttctgaatctagcaggattttaatgatatcattataatttgacacaataaaaggacaacatgaaactgatgaatctttattgggttaatttcagacactatataatcttttaaaaatgtaacattcttttttatatataaataattggtggcatcacaaatagccaaagcagggtggagagagtgatccttcctgggtgcaggcaagaaggggatatgttttctacagagttttcaaaacagtgataaagctgtctacaagtcattgtgctttttatcatcactatgcccagacaatgtgaaacatcagagatgaagtgctcttcccacagaggtggactgatccttctccccactcccttggtgtgtctctgaatgcaatgttgtcttggaaaacagctttccaagcatttcactcctgagcacttgccagtttcctcacttgttcttcacatatccaggcaaagacatcctgtttgctatatgaagcattgtatcccgtataaaaggaaggaaagagagaaatatatttttacactcatcactcctcaggggctgtacaatcatgtagaaattgtttaatgtgcctgtcaaatagccaaagagtgttaaaccctgagttcccacccatgtgtgtggtatggttaggattcatccagatacacagagagaggcacaacaggaggagaaaggataggggtgtggggacagcgggcccccaatatggtgtaatcgtggcaggtctctgcctgaagtgctatgtggggtttttcttgttttaattttgactttaacccctgatttgtaagtttttcataaaataaacagaatcataactcatgtagatggctataagtgccgtagtgttctgtgggtctctggtgtctgccagtgataagtgtggcaccccaggaaggctgtggaccccatcaaggtgctatgtgagggccatgcttggggtggtggtgggcccagtagaccctgcagccatccatccagcctgcccactcacactgcccttgtgtactcctgctttgctacgttatcattgatcaatgtccctggttacctatgtgtttgaattatcttcgtgttacaggtgtttaatgattttgctccttctagcttatttgtatttcacctgtttttctttaaatcaacatggttacactctgtttcagcaactgtataaattaaacacaaattattactactgctaaaaaaaaaaaaaaaaaa

SEQ ID NO: 126 - DNA, 1794 bp, Homo sapiens
atttctttataaaccacaactctgggcccgcaatggcagtccactgccttgctgcagtcacagaatggaaatctgcagaggcctccgcagtcacctaatcactctcctcctcttcctgttccattcagagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcctaaaaaaaaaaaaaaaaaaaaaaaaaaaaaaaaaaaaaaaaaaaaaaaaaaaa

SEQ ID NO: 127 - DNA, 1865 bp, Homo sapiens
gggcagctccaccctgggagggactgtggcccaggtactgcccgggtgctactttatgggcagcagctcagttgagttagagtctggaagacctcagaagacctcctgtcctatgaggccctccccatggctttagctgacttgtatgaagaaggaggtggaggaggaggagaaggtgaagacaatgctgactcaaaggagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcctaaaaaaaaaaaaaaaaaaaaaaaaaaaaaaaaaaaaaaaaaaaaaaaaaaaa

SEQ ID NO: 128 - DNA, 1802 bp, Homo sapiens
gggcagctccaccctgggagggactgtggcccaggtactgcccgggtgctactttatgggcagcagctcagttgagttagagtctggaagacctcagaagacctcctgtcctatgaggccctccccatggctttagagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcctaaaaaaaaaaaaaaaaaaaaaaaaaaaaaaaaaaaaaaaaaaaaaaaaaaaa

SEQ ID NO: 129 - DNA, 1973 bp, Homo sapiens
gggcagctccaccctgggagggactgtggcccaggtactgcccgggtgctactttatgggcagcagctcagttgagttagagtctggaagacctcagaagacctcctgtcctatgaggccctccccatggctttagggggattataaaactaatcatcaaagccaagaaggcaagagcaagcatgtaccgctgaaaacacaagataactgcataagtaatgactttcagtgcagattcatagctaacccataaactgctggggcaaaaatcatcttggaaggctctgaacctcagaaaggattcacaagacgatctgccgaccctctgggagaaaatccagcaagatgcaagccttcagaatctgggatgttaaccagaagaccttctatctgaggaacaaccaactagttgctggatacttgcaaggaccaaatgtcaatttagaagaaaagatagatgtggtacccattgagcctcatgctctgttcttgggaatccatggagggaagatgtgcctgtcctgtgtcaagtctggtgatgagaccagactccagctggaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgcctaaaaaaaaaaaaaaaaaaaaaaaaaaaaaaaaaaaaaaaaaaaaaaaaaaaa

SEQ ID NO: 130 - DNA, 2717 bp, Homo sapiens
cgctgggaatcctgctcctcctcaggtcctggcagtttcagggcccctccctaggccttacttaaaaggctgaggcatccttggaggaacaggcagactccacagctcccgccaggagaaaggaacattctgaggggagtctacaccctgtggagctcaagatggtcctgagtggggcgctgtgcttccgaatgaaggactcggcattgaaggtgctttatctgcataataaccagcttctagctggagggctgcatgcagggaaggtcattaaaggtgaagagatcagcgtggtccccaatcggtggctggatgccagcctgtcccccgtcatcctgggtgtccagggtggaagccagtgcctgtcatgtggggtggggcaggagccgactctaacactagagccagtgaacatcatggagctctatcttggtgccaaggaatccaagagcttcaccttctaccggcgggacatggggctcacctccagcttcgagtcggctgcctacccgggctggttcctgtgcacggtgcctgaagccgatcagcctgtcagactcacccagcttcccgagaatggtggctggaatgcccccatcacagacttctacttccagcagtgtgactagggcaacgtgccccccagaactccctgggcagagccagctcgggtgaggggtgagtggaggagacccatggcggacaatcactctctctgctctcaggacccccacgtctgacttagtgggcacctgaccactttgtcttctggttcccagtttggataaattctgagatttggagctcagtccacggtcctcccccactggatggtgctactgctgtggaatcttgtaaaaaccatgtggggtaaactgggaataacatgaaaagatttctgtggaggtggggtgggggagtggtgggaatcattcctgcttaatggtaactgaccagtgttaccctgagccccgcaggccaacccatccccagttgagccttatagggtcagtagctctccacatgaagacctgtcactcaccactatgcaggagagggaggtggtcatagagtcagggatctatggcccttggcccagccccacctccttccctttaatcctgccactgtcatatgctacctttcctatctcttccctcatcatcttgttgtgggcatgaggaggtgctgatgtcagaagaaatggctcgagctcagaagataaaagataagtagggtatgctgatcctcttttaaaaacccaagatacaatcaaaatcccagatgctggtctctattcccatgaaaaagtgctcatgacatattgagaagacctacttacaaagtggcatatattgcaatttattttaattaaaagatacctatttatatatttctttatagaaaaaagtctggaagagtttacttcaattgtagcaatgtcagggtggtggcagtataggtgatttttcttttaattctgttaatttacctgtatttcctaatttttctacaatgaagatgaattccttgtataaaaataagaaaagaaattaatcttgaggtaagcagagtagacatcatctctgattgtcctcagcctccacttccccagagtaaattcaaattgaatcgagctctgctgctctggttggttgtagtagtgatcaggaaacagatctcagcaaagccactgaggaggaggctgtgctgagtttgtgtggctggaatctctgggtaaggaacttaaagaacaaaaatcatctggtaattctttcctagaaggatcacagcccctgggattccaaggcattggatccagtctctaagaaggctgctgtactggttgaattgtgtccccctcaaattcacatccttcttggaatctcagtctgtgagtttatttggagataaggtctctgcagatgtagttagttaagacaaggtcatgctggatgaaggtagacctaaattcaatatgactggtttccttgtatgaaaaggagaggacacagagacagaggagatgcggggaagactatgtaaagatgaaggcagagatcggagttttgcagccacaagctaagaaacaccaaggattgtggcaaccatcagaagcttggaagaggcaaagaagaattcttccctagaggctttagagggataacggctctgctgaaaccttaatctcagacttccagcctcctgaacgaagaaagaataaatttcggctgttttaagccaccaaggataattggttacagcagctctaggaaactaatacagctgctaaaatgatccctgtctcctcgtgtttacattctgtgtgtgtcccctcccacaatgtaccaaagttgtctttgtgaccaatagaatatggcagaagtgatggcatgccacttccaagattaggttataaaagacactgcagcttctacttgagccctctctctctgccacccaccgcccccaatctatcttggctcactcgctctgggggaagctagctgccatgctatgagcaggcctataaagagacttacgtggtaaaaaatgaagtctcctgcccacagccacattagtgaacctagaagcagagactctgtgagataatcgatgtttgttgttttaagttgctcagttttggtctaacttgttatgcagcaatagataaataatatgcagagaaagagaaaaaaaaaaaaaaaaaaaaaaaa

SEQ ID NO: 131 - DNA, 2689 bp, Homo sapiens
ggagagtcccacctctaacatctcctgtaggcctggcaatggcaggcaggaaagacagaggaaggaaggagggagaagggaaggagtgaaggaaggagtgaaaaaggggagtctacaccctgtggagctcaagatggtcctgagtggggcgctgtgcttccgaatgaaggactcggcattgaaggtgctttatctgcataataaccagcttctagctggagggctgcatgcagggaaggtcattaaaggtgaagagatcagcgtggtccccaatcggtggctggatgccagcctgtcccccgtcatcctgggtgtccagggtggaagccagtgcctgtcatgtggggtggggcaggagccgactctaacactagagccagtgaacatcatggagctctatcttggtgccaaggaatccaagagcttcaccttctaccggcgggacatggggctcacctccagcttcgagtcggctgcctacccgggctggttcctgtgcacggtgcctgaagccgatcagcctgtcagactcacccagcttcccgagaatggtggctggaatgcccccatcacagacttctacttccagcagtgtgactagggcaacgtgccccccagaactccctgggcagagccagctcgggtgaggggtgagtggaggagacccatggcggacaatcactctctctgctctcaggacccccacgtctgacttagtgggcacctgaccactttgtcttctggttcccagtttggataaattctgagatttggagctcagtccacggtcctcccccactggatggtgctactgctgtggaatcttgtaaaaaccatgtggggtaaactgggaataacatgaaaagatttctgtggaggtggggtgggggagtggtgggaatcattcctgcttaatggtaactgaccagtgttaccctgagccccgcaggccaacccatccccagttgagccttatagggtcagtagctctccacatgaagacctgtcactcaccactatgcaggagagggaggtggtcatagagtcagggatctatggcccttggcccagccccacctccttccctttaatcctgccactgtcatatgctacctttcctatctcttccctcatcatcttgttgtgggcatgaggaggtgctgatgtcagaagaaatggctcgagctcagaagataaaagataagtagggtatgctgatcctcttttaaaaacccaagatacaatcaaaatcccagatgctggtctctattcccatgaaaaagtgctcatgacatattgagaagacctacttacaaagtggcatatattgcaatttattttaattaaaagatacctatttatatatttctttatagaaaaaagtctggaagagtttacttcaattgtagcaatgtcagggtggtggcagtataggtgatttttcttttaattctgttaatttacctgtatttcctaatttttctacaatgaagatgaattccttgtataaaaataagaaaagaaattaatcttgaggtaagcagagtagacatcatctctgattgtcctcagcctccacttccccagagtaaattcaaattgaatcgagctctgctgctctggttggttgtagtagtgatcaggaaacagatctcagcaaagccactgaggaggaggctgtgctgagtttgtgtggctggaatctctgggtaaggaacttaaagaacaaaaatcatctggtaattctttcctagaaggatcacagcccctgggattccaaggcattggatccagtctctaagaaggctgctgtactggttgaattgtgtccccctcaaattcacatccttcttggaatctcagtctgtgagtttatttggagataaggtctctgcagatgtagttagttaagacaaggtcatgctggatgaaggtagacctaaattcaatatgactggtttccttgtatgaaaaggagaggacacagagacagaggagatgcggggaagactatgtaaagatgaaggcagagatcggagttttgcagccacaagctaagaaacaccaaggattgtggcaaccatcagaagcttggaagaggcaaagaagaattcttccctagaggctttagagggataacggctctgctgaaaccttaatctcagacttccagcctcctgaacgaagaaagaataaatttcggctgttttaagccaccaaggataattggttacagcagctctaggaaactaatacagctgctaaaatgatccctgtctcctcgtgtttacattctgtgtgtgtcccctcccacaatgtaccaaagttgtctttgtgaccaatagaatatggcagaagtgatggcatgccacttccaagattaggttataaaagacactgcagcttctacttgagccctctctctctgccacccaccgcccccaatctatcttggctcactcgctctgggggaagctagctgccatgctatgagcaggcctataaagagacttacgtggtaaaaaatgaagtctcctgcccacagccacattagtgaacctagaagcagagactctgtgagataatcgatgtttgttgttttaagttgctcagttttggtctaacttgttatgcagcaatagataaataatatgcagagaaagagaaaaaaaaaaaaaaaaaaaaaaaa

SEQ ID NO: 132 - DNA, 1282 bp, Homo sapiens
aagccacccagcctatgcatccgctcctcaatcctctcctgttggcactgggcctcatggcgcttttgttgaccacggtcattgctctcacttgccttggcggctttgcctccccaggccctgtgcctccctctacagccctcagggagctcattgaggagctggtcaacatcacccagaaccagaaggctccgctctgcaatggcagcatggtatggagcatcaacctgacagctggcatgtactgtgcagccctggaatccctgatcaacgtgtcaggctgcagtgccatcgagaagacccagaggatgctgagcggattctgcccgcacaaggtctcagctgggcagttttccagcttgcatgtccgagacaccaaaatcgaggtggcccagtttgtaaaggacctgctcttacatttaaagaaactttttcgcgagggacagttcaactgaaacttcgaaagcatcattatttgcagagacaggacctgactattgaagttgcagattcatttttctttctgatgtcaaaaatgtcttgggtaggcgggaaggagggttagggaggggtaaaattccttagcttagacctcagcctgtgctgcccgtcttcagcctagccgacctcagccttccccttgcccagggctcagcctggtgggcctcctctgtccagggccctgagctcggtggacccagggatgacatgtccctacacccctcccctgccctagagcacactgtagcattacagtgggtgccccccttgccagacatgtggtgggacagggacccacttcacacacaggcaactgaggcagacagcagctcaggcacacttcttcttggtcttatttattattgtgtgttatttaaatgagtgtgtttgtcaccgttggggattggggaagactgtggctgctagcacttggagccaagggttcagagactcagggccccagcactaaagcagtggacaccaggagtccctggtaataagtactgtgtacagaattctgctacctcactggggtcctggggcctcggagcctcatccgaggcagggtcaggagaggggcagaacagccgctcctgtctgccagccagcagccagctctcagccaacgagtaatttattgtttttccttgtatttaaatattaaatatgttagcaaagagttaatatatagaagggtaccttgaacactgggggaggggacattgaacaagttgtttcattgactatcaaactgaagccagaaataaagttggtgacagat

SEQ ID NO: 133 - DNA, 4006 bp, Homo sapiens
tgccaaggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggtaagaagcgcaattccacactctacataaccatgttactcattgttccagtcatcgtcgcaggtgcaatcatagtactcctgctttacctaaaaaggctcaagattattatattccctccaattcctgatcctggcaagatttttaaagaaatgtttggagaccagaatgatgatactctgcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacattgatgctgacagtcatgcagtctgggagtggggaagtgatcttttgttcccatcctcttcttttagcagtaaaatagctgagggaaaagggagggaaaaggaagttatgggaatacctgtggtggttgtgatccctaggtcttgggagctcttggaggtgtctgtatcagtggatttcccatcccctgtgggaaattagtaggctcatttactgttttaggtctagcctatgtggattttttcctaacatacctaagcaaacccagtgtcaggatggtaattcttattctttcgttcagttaagtttttcccttcatctgggcactgaagggatatgtgaaacaatgttaacatttttggtagtcttcaaccagggattgtttctgtttaacttcttataggaaagcttgagtaaaataaatattgtctttttgtatgtca

SEQ ID NO: 134 - DNA, 1376 bp, Homo sapiens
gtaagaacactctcgtgagtctaacggtcttccggatgaaggctatttgaagtcgccataacctggtcagaagtgtgcctgtcggcggggagagaggcaatatcaaggttttaaatctcggagaaatggctttcgtttgcttggctatcggatgcttatatacctttctgataagcacaacatttggctgtacttcatcttcagacaccgagataaaagttaaccctcctcaggattttgagatagtggatcccggatacttaggttatctctatttgcaatggcaacccccactgtctctggatcattttaaggaatgcacagtggaatatgaactaaaataccgaaacattggtagtgaaacatggaagaccatcattactaagaatctacattacaaagatgggtttgatcttaacaagggcattgaagcgaagatacacacgcttttaccatggcaatgcacaaatggatcagaagttcaaagttcctgggcagaaactacttattggatatcaccacaaggaattccagaaactaaagttcaggatatggattgcgtatattacaattggcaatatttactctgttcttggaaacctggcataggtgtacttcttgataccaattacaacttgttttactggtatgagggcttggatcatgcattacagtgtgttgattacatcaaggctgatggacaaaatataggatgcagatttccctatttggaggcatcagactataaagatttctatatttgtgttaatggatcatcagagaacaagcctatcagatccagttatttcacttttcagcttcaaaatatagttaaacctttgccgccagtctatcttacttttactcgggagagttcatgtgaaattaagctgaaatggagcatacctttgggacctattccagcaaggtgttttgattatgaaattgagatcagagaagatgatactaccttggtgactgctacagttgaaaatgaaacatacaccttgaaaacaacaaatgaaacccgacaattatgctttgtagtaagaagcaaagtgaatatttattgctcagatgacggaatttggagtgagtggagtgataaacaatgctgggaaggtgaagacctatcgaagaaaactttgctacgtttctggctaccatttggtttcatcttaatattagttatatttgtaaccggtctgcttttgcgtaagccaaacacctacccaaaaatgattccagaatttttctgtgatacatgaagactttccatatcaagagacatggtattgactcaacagtttccagtcatggccaaatgttcaatatgagtctcaataaactgaatttttcttgcgaatgttgaaaaa

SEQ ID NO: 135 - DNA, 3710 bp, Homo sapiens
gggtctccgcgcccaggaaagccccgcgcggcgcgggccagggaagggccacccaggggtcccccacttcccgcttgggcgcccggacggcgaatggagcaggggcgcgcagataattaaagatttacacacagctggaagaaatcatagagaagccgggcgtggtggctcatgcctataatcccagcacttttggaggctgaggcgggcagatcacttgagatcaggagttcgagaccagcctggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacgtggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctatgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctctttaaaaaaaaaaaaaaaaaaaaaa

SEQ ID NO: 136 - DNA, 3577 bp, Homo sapiens
gggtctccgcgcccaggaaagccccgcgcggcgcgggccagggaagggccacccaggggtcccccacttcccgcttgggcgcccggacggcgaatggagcaggggcgcgcaggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacgtggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctatgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctctttaaaaaaaaaaaaaaaaaaaaaa

SEQ ID NO: 137 - DNA, 3821 bp, Homo sapiens
gggtctccgcgcccaggaaagccccgcgcggcgcgggccagggaagggccacccaggggtcccccacttcccgcttgggcgcccggacggcgaatggagcaggggcgcgcaggtgccttggcatctcccaatggggtggctttgctctgggctcctgttccctgtgagctgcctggtcctgctgcaggtggcaagctctggactcttcaggatgccgtgtggagaaaggaagagggtggaagccaggaggtctggagggaggtctggagtggaggagatgagaggctccggatccctctgggaggtagatttgaggacagattggaattgaggtgaaagacagagaaagagaagtggccaggatgactccaagatttctgacctaaactactgggaaggacgcggttgtcatttctgaaatgcagaaggatgccagaagagaagggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagatttcagaatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacgtggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctatgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctctttaaaaaaaaaaaaaaaaaaaaaa

SEQ ID NO: 138 - DNA, 3589 bp, Homo sapiens
gggtctccgcgcccaggaaagccccgcgcggcgcgggccagggaagggccacccaggggtcccccacttcccgcttgggcgcccggacggcgaatggagcaggggcgcgcaggtgccttggcatctcccaatggggtggctttgctctgggctcctgttccctgtgagctgcctggtcctgctgcaggtggcaagctctgggaacatgaaggtcttgcaggagcccacctgcgtctccgactacatgagcatctctacttgcgagtggaagatgaatggtcccaccaattgcagcaccgagctccgcctgttgtaccagctggtttttctgctctccgaagcccacacgtgtatccctgagaacaacggaggcgcggggtgcgtgtgccacctgctcatggatgacgtggtcagtgcggataactatacactggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctatgcagtcaacatttggagtgaaaacgacccggcagataatctataacgtgacctacctagaaccctccctccgcatcgcagccagcaccctgaagtctgggatttcctacagggcacgggtgagggcctgggctcagtgctataacaccacctggagtgagtggagccccagcaccaagtggcacaactcctacagggagcccttcgagcagcacctcctgctgggcgtcagcgtttcctgcattgtcatcctggccgtctgcctgttgtgctatgtcagcatcaccaagattaagaaagaatggtgggatcagattcccaacccagcccgcagccgcctcgtggctataataatccaggatgctcaggggtcacagtgggagaagcggtcccgaggccaggaaccagccaagtgcccacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcccagagagctgggtccagacccactgctggccagacacctggaggaagtagaacccgagatgccctgtgtcccccagctctctgagccaaccactgtgccccaacctgagccagaaacctgggagcagatcctccgccgaaatgtcctccagcatggggcagctgcagcccccgtctcggcccccaccagtggctatcaggagtttgtacatgcggtggagcagggtggcacccaggccagtgcggtggtgggcttgggtcccccaggagaggctggttacaaggccttctcaagcctgcttgccagcagtgctgtgtccccagagaaatgtgggtttggggctagcagtggggaagaggggtataagcctttccaagacctcattcctggctgccctggggaccctgccccagtccctgtccccttgttcacctttggactggacagggagccacctcgcagtccgcagagctcacatctcccaagcagctccccagagcacctgggtctggagccgggggaaaaggtagaggacatgccaaagcccccacttccccaggagcaggccacagacccccttgtggacagcctgggcagtggcattgtctactcagcccttacctgccacctgtgcggccacctgaaacagtgtcatggccaggaggatggtggccagacccctgtcatggccagtccttgctgtggctgctgctgtggagacaggtcctcgccccctacaacccccctgagggccccagacccctctccaggtggggttccactggaggccagtctgtgtccggcctccctggcaccctcgggcatctcagagaagagtaaatcctcatcatccttccatcctgcccctggcaatgctcagagctcaagccagacccccaaaatcgtgaactttgtctccgtgggacccacatacatgagggtctcttaggtgcatgtcctcttgttgctgagtctgcagatgaggactagggcttatccatgcctgggaaatgccacctcctggaaggcagccaggctggcagatttccaaaagacttgaagaaccatggtatgaaggtgattggccccactgacgttggcctaacactgggctgcagagactggaccccgcccagcattgggctgggctcgccacatcccatgagagtagagggcactgggtcgccgtgccccacggcaggcccctgcaggaaaactgaggcccttgggcacctcgacttgtgaacgagttgttggctgctccctccacagcttctgcagcagactgtccctgttgtaactgcccaaggcatgttttgcccaccagatcatggcccacgtggaggcccacctgcctctgtctcactgaactagaagccgagcctagaaactaacacagccatcaagggaatgacttgggcggccttgggaaatcgatgagaaattgaacttcagggagggtggtcattgcctagaggtgctcattcatttaacagagcttccttaggttgatgctggaggcagaatcccggctgtcaaggggtgttcagttaaggggagcaacagaggacatgaaaaattgctatgactaaagcagggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgttatctgtgtttgctgaggagagtggaacagaaggggtggagttttgtataaataaagtttctttgtctctttaaaaaaaaaaaaaaaaaaaaaaaaaaaaaaaaaaaaaaa

SEQ ID NO: 139 - protein, 178 aa, Homo sapiens
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 140 - protein, 160 aa, Homo sapiens
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 141 - DNA, 1629 bp, Homo sapiens
acacatcaggggcttgctcttgcaaaaccaaaccacaagacagacttgcaaaagaaggcatgcacagctcagcactgctctgttgcctggtcctcctgactggggtgagggccagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactgagacatcagggtggcgactctatagactctaggacataaattagaggtctccaaaatcggatctggggctctgggatagctgacccagccccttgagaaaccttattgtacctctcttatagaatatttattacctctgatacctcaacccccatttctatttatttactgagcttctctgtgaacgatttagaaagaagcccaatattataatttttttcaatatttattattttcacctgtttttaagctgtttccatagggtgacacactatggtatttgagtgttttaagataaattataagttacataagggaggaaaaaaaatgttctttggggagccaacagaagcttccattccaagcctgaccacgctttctagctgttgagctgttttccctgacctccctctaatttatcttgtctctgggcttggggcttcctaactgctacaaatactcttaggaagagaaaccagggagcccctttgatgattaattcaccttccagtgtctcggagggattcccctaacctcattccccaaccacttcattcttgaaagctgtggccagcttgttatttataacaacctaaatttggttctaggccgggcgcggtggctcacgcctgtaatcccagcactttgggaggctgaggcgggtggatcacttgaggtcaggagttcctaaccagcctggtcaacatggtgaaaccccgtctctactaaaaatacaaaaattagccgggcatggtggcgcgcacctgtaatcccagctacttgggaggctgaggcaagagaattgcttgaacccaggagatggaagttgcagtgagctgatatcatgcccctgtactccagcctgggtgacagagcaagactctgtctcaaaaaataaaaataaaaataaatttggttctaatagaactcagttttaactagaatttattcaattcctctgggaatgttacattgtttgtctgtcttcatagcagattttaattttgaataaataaatgtatcttattcacatc

SEQ ID NO: 142 - protein, 178 aa, Mus sp.
MPGSALLCCLLLLTGMRISRGQYSREDNNCTHFPVGQSHMLLELRTAFSQVKTFFQTKDQLDNILLTDSLMQDFKGYLGCQALSEMIQFYLVEVMPQAEKHGPEIKEHLNSLGEKLKTLRMRLRRCHRFLPCENKSKAVEQVKSDFNKLQDQGVYKAMNEFDIFINCIEAYMMIKMKS

SEQ ID NO: 143 - DNA, 1306 bp, Mus sp.
acatttagagacttgctcttgcactaccaaagccacaaggcagccttgcagaaaagagagctccatcatgcctggctcagcactgctatgctgcctgctcttactgactggcatgaggatcagcaggggccagtacagccgggaagacaataactgcacccacttcccagtcggccagagccacatgctcctagagctgcggactgccttcagccaggtgaagactttctttcaaacaaaggaccagctggacaacatactgctaaccgactccttaatgcaggactttaagggttacttgggttgccaagccttatcggaaatgatccagttttacctggtagaagtgatgccccaggcagagaagcatggcccagaaatcaaggagcatttgaattccctgggtgagaagctgaagaccctcaggatgcggctgaggcgctgtcatcgatttctcccctgtgaaaataagagcaaggcagtggagcaggtgaagagtgattttaataagctccaagaccaaggtgtctacaaggccatgaatgaatttgacatcttcatcaactgcatagaagcatacatgatgatcaaaatgaaaagctaaaacacctgcagtgtgtattgagtctgctggactccaggacctagacagagctctctaaatctgatccagggatcttagctaacggaaacaactccttggaaaacctcgtttgtacctctctccgaaatatttattacctctgatacctcagttcccattctatttattcactgagcttctctgtgaactatttagaaagaagcccaatattataattttacagtatttattatttttaacctgtgtttaagctgtttccattggggacactttatagtatttaaagggagattatattatatgatgggaggggttcttccttgggaagcaattgaagcttctattctaaggctggccacacttgagagctgcagggccctttgctatggtgtcctttcaattgctctcatccctgagttcagagctcctaagagagttgtgaagaaactcatgggtcttgggaagagaaaccagggagatcctttgatgatcattcctgcagcagctcagagggttcccctactgtcatcccccagccgcttcatccctgaaaactgtggccagtttgttatttataaccacctaaaattagttctaatagaactcatttttaactagaagtaatgcaattcctctgggaatggtgtattgtttgtctgcctttgtagcagactctaattttgaataaatggatcttattcg

SEQ ID NO: 144 - protein, 178 aa, Rattus sp.
MPGSALLCCLLLLAGVKTSKGHSIRGDNNCTHFPVSQTHMLRELRAAFSQVKTFFQKKDQLDNILLTDSLLQDFKGYLGCQALSEMIKFYLVEVMPQAENHGPEIKEHLNSLGEKLKTLWIQLRRCHRFLPCENKSKAVEQVKNDFNKLQDKGVYKAMNEFDIFINCIEAYVTLKMKN

SEQ ID NO: 145 - DNA, 682 bp, Rattus sp.
catgcctggctcagcactgctatgttgcctgctcttactggctggagtgaagaccagcaaaggccattccatccggggtgacaataactgcacccacttcccagtcagccagacccacatgctccgagagctgagggctgccttcagtcaagtgaagactttctttcaaaagaaggaccagctggacaacatactgctgacagattccttactgcaggactttaagggttacttgggttgccaagccttgtcagaaatgatcaagttttacctggtagaagtgatgccccaggcagagaaccatggcccagaaatcaaggagcatttgaattccctgggagagaagctgaagaccctctggatacagctgcgacgctgtcatcgatttctcccctgtgagaataaaagcaaggcagtggagcaggtgaagaatgattttaataagctccaagacaaaggtgtctacaaggccatgaatgagtttgacatcttcatcaactgcatagaagcctacgtgacactcaaaatgaaaaattgaaccacccggcatctactggactgcaggacataaatagagcttctaaatctgatccagagatcttagctaacgggagcaactccttggaaaacctcgtttgtacctctctccaaaatatttattacctctgatacctcagttccc

SEQ ID NO: 146 - protein, 178 aa, Oryctolagus sp.
MLSSALLCCLVFLGGTGASRGQDTPAENSCIHFPGGLPHMLRELRAAFGRVKTFFQSKDQLNSMLLTESLLEDLKGYLGCQALSEMIQFYLKDVMPQAENHSPAIREHVNSLGENLKTLRLRLRQCHRFLPCENKSKAVEQVKSAFSKLQEEGVYKAMSEFDIFINYIETYMTMKIKS

SEQ ID NO: 147 - DNA, 1089 bp, Oryctolagus sp.
aaagcaaaccacaaggcggactcgtagaagcaggcagagttccaccatgctcagctcagctctgctatgttgcctggtcttcctgggtgggacaggggccagccgaggccaggacacccctgctgagaacagctgcattcactttccaggcggcctgccccacatgctccgcgagctccgtgctgcctttggcagggtgaagactttctttcaatcgaaggatcagctgaacagcatgttgttaaccgagtccctgctggaggaccttaagggttacctgggatgccaagccttgtcggagatgatccagttttacctgaaggacgtgatgccgcaagctgagaaccacagtccagccatcagggagcacgtgaactccctgggggaaaacctgaagaccctcaggctgaggctgcgacaatgtcaccgatttctcccctgtgaaaacaagagcaaggcagtggagcaggtgaagagcgccttcagcaagctgcaagaggaaggcgtctacaaagccatgagtgagtttgacatcttcatcaactacatagaaacctacatgacaatgaagataaaaagctaaaagccccaggatggcaactcggctagagtctaggacatcagttagggacctgcacaccctgggtcagctgacccagcaccttggaaagctgttgtacctctcaatatttattacctctgatacctcagctcccgatcctatttatttaccgagcttctctgtgaactctttagaaagaagcccactattataattttttcagtatttattattttcacctgcatttaagctgtacccatggggtgatgccctgtgggatttgagtgtcttaggagaaattataatttatgtgaaagggaaaatgtgccttggggagccgactgaggcttccattccttctgtgcctgaccacactttctaactcctaagccgagctccctcttaccctctggagcccggacctgggtctcgagtgttccagagactcctagcctcttaggaagagagaccggaagcccttgggtggtgaccttccggcagctcagagggaggctcctgacctcgat

SEQ ID NO: 148 - protein, 178 aa, Macaca mulatta
MHSSALLCCLVLLTGVRASPGQGTQSENSCTRFPGNLPHMLRDLRDAFSRVKTFFQMKDQLDNILLKESLLEDFKGYLGCQALSEMIQFYLEEVMPQAENHDPDIKEHVNSLGENLKTLRLRLRRCHRFLPCENKSKAVEQVKNAFSKLQEKGVYKAMSEFDIFINYIEAYMTMKIQN

SEQ ID NO: 149 - DNA, 643 bp, Macaca mulatta
agaaggcatgcacagctcagcactgctctgttgcctagtcctcctgactggggtgagggccagcccaggccagggcacccagtctgagaacagctgcacccgcttcccaggcaacctgcctcacatgcttcgagacctccgagatgccttcagcagagtgaagactttctttcaaatgaaggatcagctggacaacatattgttaaaggagtccttgctggaggactttaagggttacctgggttgccaagccttgtctgagatgatccagttttacctggaggaggtgatgccccaagctgagaaccacgacccagacatcaaggagcatgtgaactccctgggggagaatctgaagaccctcaggctgaggctgcggcgctgtcatcgatttcttccctgtgaaaacaagagcaaggccgtggagcaggtgaagaatgcctttagtaagctccaagagaaaggcgtctacaaagccatgagtgagtttgacatcttcatcaactacatagaagcctacatgacaatgaagatacaaaactgagacatcagggtggcgactctatagactctaggacataaattagaggtctccaaaatcagatccagggttctgggatagctgacccagccccttgagaaa

SEQ ID NO: 150 - protein, 578 aa, Homo sapiens
MLPCLVVLLAALLSLRLGSDAHGTELPSPPSVWFEAEFFHHILHWTPIPNQSESTCYEVALLRYGIESWNSISNCSQTLSYDLTAVTLDLYHSNGYRARVRAVDGSRHSNWTVTNTRFSVDEVTLTVGSVNLEIHNGFILGKIQLPRPKMAPANDTYESIFSHFREYEIAIRKVPGNFTFTHKKVKHENFSLLTSGEVGEFCVQVKPSVASRSNKGMWSKEECISLTRQYFTVTNVIIFFAFVLLLSGALAYCLALQLYVRRRKKLPSVLLFKKPSPFIFISQRPSPETQDTIHPLDEEAFLKVSPELKNLDLHGSTDSGFGSTKPSLQTEEPQFLLPDPHPQADRTLGNREPPVLGDSCSSGSSNSTDSGICLQEPSLSPSTGPTWEQQVGSNSRGQDDSGIDLVQNSEGRAGDTQGGSALGHHSPPEPEVPGEEDPAAVAFQGYLRQTRCAEEKATKTGCLEEESPLTDGLGPKFGRCLVDEAGLHPPALAKGYLKQDPLEMTLASSGAPTGQWNQPTEEWSLLALSSCSDLGISDWSFAHDLAPLGCVAAPGGLLGSFNSDLVTLPLISSLQSSE

SEQ ID NO: 151 - DNA, 3672 bp, Homo sapiens
gtcagtcccagcccaagggtagctggaggcgcgcaggccggctccgctccggccccggacgatgcggcgcgcccaggatgctgccgtgcctcgtagtgctgctggcggcgctcctcagcctccgtcttggctcagacgctcatgggacagagctgcccagccctccgtctgtgtggtttgaagcagaatttttccaccacatcctccactggacacccatcccaaatcagtctgaaagtacctgctatgaagtggcgctcctgaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaagtgactctgacagttggcagtgtgaacctagagatccacaatggcttcatcctcgggaagattcagctacccaggcccaagatggcccccgcaaatgacacatatgaaagcatcttcagtcacttccgagagtatgagattgccattcgcaaggtgccgggaaacttcacgttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtatttcaccgtgaccaacgtcatcatcttctttgcctttgtcctgctgctctccggagccctcgcctactgcctggccctccagctgtatgtgcggcgccgaaagaagctacccagtgtcctgctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacagggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggcccctggggcagaagttaggcacgaggcagtctgggcacttttctgcaagtccactggggctggccccagccaggccctgcagggctggtcagggtgtctggggcaggaggaggccaactcactgaactagtgcagggtatgtgggtggcactgacctgttctgttgactggggccctgcagactctggcagagctgagaagggcagggaccttctccctcctaggaactctttcctgtatcataaaggattatttgctcaggggaaccatggggctttctggagttgtggtgaggccaccaggctgaagtcagctcagacccagacctccctgcttaggccactcgagcatcagagcttccagcaggaggaagggctgtaggaatggaagcttcagggccttgctgctggggtcatttttaggggaaaaaggaggatatgatggtcacatggggaacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagccactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcgtagggatgtgaggttctgctgaggaaatgggtatgaatgtgccttgaacacaaagctctgtcaataagtgatacatgttttttattccaataaattgtcaagaccacaggaaaaaaaaaaaaaaaaaa

SEQ ID NO: 152 - DNA, 3802 bp, Homo sapiens
gtcagtcccagcccaagggtagctggaggcgcgcaggccggctccgctccggccccggacgatgcggcgcgcccaggatgctgccgtgcctcgtagtgctgctggcggcgctcctcagcctccgtcttggctcagacgctcatggctcacctgttgtggaagtggaagaggctgaaattgacaggaactgacggattgggaaggatagagaagtatgcgcaaggccaaacccccaacccgcaaacctcatcatccacccacttctagatgagccggacagagctgcccagccctccgtctgtgtggtttgaagcagaatttttccaccacatcctccactggacacccatcccaaatcagtctgaaagtacctgctatgaagtggcgctcctgaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaagtgactctgacagttggcagtgtgaacctagagatccacaatggcttcatcctcgggaagattcagctacccaggcccaagatggcccccgcaaatgacacatatgaaagcatcttcagtcacttccgagagtatgagattgccattcgcaaggtgccgggaaacttcacgttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtatttcaccgtgaccaacgtcatcatcttctttgcctttgtcctgctgctctccggagccctcgcctactgcctggccctccagctgtatgtgcggcgccgaaagaagctacccagtgtcctgctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacagggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggcccctggggcagaagttaggcacgaggcagtctgggcacttttctgcaagtccactggggctggccccagccaggccctgcagggctggtcagggtgtctggggcaggaggaggccaactcactgaactagtgcagggtatgtgggtggcactgacctgttctgttgactggggccctgcagactctggcagagctgagaagggcagggaccttctccctcctaggaactctttcctgtatcataaaggattatttgctcaggggaaccatggggctttctggagttgtggtgaggccaccaggctgaagtcagctcagacccagacctccctgcttaggccactcgagcatcagagcttccagcaggaggaagggctgtaggaatggaagcttcagggccttgctgctggggtcatttttaggggaaaaaggaggatatgatggtcacatggggaacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagccactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcgtagggatgtgaggttctgctgaggaaatgggtatgaatgtgccttgaacacaaagctctgtcaataagtgatacatgttttttattccaataaattgtcaagaccacaggaaaaaaaaaaaaaaaaaa

SEQ ID NO: 153 - protein, 325 aa, Homo sapiens
MAWSLGSWLGGCLLVSALGMVPPPENVRMNSVNFKNILQWESPAFAKGNLTFTAQYLSYRIFQDKCMNTTLTECDFSSLSKYGDHTLRVRAEFADEHSDWVNITFCPVDDTIIGPPGMQVEVLADSLHMRFLAPKIENEYETWTMKNVYNSWTYNVQYWKNGTDEKFQITPQYDFEVLRNLEPWTTYCVQVRGFLPDRNKAGEWSEPVCEQTTHDETVPSWMVAVILMASVFMVCLALLGCFALLWCVYKKTKYAFSPRNSLPQHLKEFLGHPHHNTLLFFSFPLSDENDVFDKLSVIAEDSESGKQNPGDSCSLGTPPGQGPQS

SEQ ID NO: 154 - DNA, 1966 bp, Homo sapiens
cccgcccatctccgctggttcccggaagccgccgcggacaagctctcccgggcgcgggcgggggtcgtgtgcttggaggaagccgcggaacccccagcgtccgtccatggcgtggagccttgggagctggctgggtggctgcctgctggtgtcagcattgggaatggtaccacctcccgaaaatgtcagaatgaattctgttaatttcaagaacattctacagtgggagtcacctgcttttgccaaagggaacctgactttcacagctcagtacctaagttataggatattccaagataaatgcatgaatactaccttgacggaatgtgatttctcaagtctttccaagtatggtgaccacaccttgagagtcagggctgaatttgcagatgagcattcagactgggtaaacatcaccttctgtcctgtggatgacaccattattggaccccctggaatgcaagtagaagtacttgctgattctttacatatgcgtttcttagcccctaaaattgagaatgaatacgaaacttggactatgaagaatgtgtataactcatggacttataatgtgcaatactggaaaaacggtactgatgaaaagtttcaaattactccccagtatgactttgaggtcctcagaaacctggagccatggacaacttattgtgttcaagttcgagggtttcttcctgatcggaacaaagctggggaatggagtgagcctgtctgtgagcaaacaacccatgacgaaacggtcccctcctggatggtggccgtcatcctcatggcctcggtcttcatggtctgcctggcactcctcggctgcttcgccttgctgtggtgcgtttacaagaagacaaagtacgccttctcccctaggaattctcttccacagcacctgaaagagtttttgggccatcctcatcataacacacttctgtttttctcctttccattgtcggatgagaatgatgtttttgacaagctaagtgtcattgcagaagactctgagagcggcaagcagaatcctggtgacagctgcagcctcgggaccccgcctgggcaggggccccaaagctaggctctgagaaggaaacacactcggctgggcacagtgacgtactccatctcacatctgcctcagtgagggatcagggcagcaaacaagggccaagaccatctgagccagccccacatctagaactcccagaccctggacttagccaccagagagctacattttaaaggctgtcttggcaaaaatactccatttgggaactcactgccttataaaggctttcatgatgttttcagaagttggccactgagagtgtaattttcagccttttatatcactaaaataagatcatgttttaattgtgagaaacagggccgagcacagtggctcacgcctgtaataccagcaccttagaggtcgaggcaggcggatcacttgaggtcaggagttcaagaccagcctggccaatatggtgaaacccagtctctactaaaaatacaaaaattagctaggcatgatggcgcatgcctataatcccagctactcgagtgcctgaggcaggagaattgcatgaacccgggaggaggaggaggaggttgcagtgagccgagatagcggcactgcactccagcctgggtgacaaagtgagactccatctcaaaaaaaaaaaaaaaaaaaattgtgagaaacagaaatacttaaaatgaggaataagaatggagatgttacatctggtagatgtaacattctaccagattatggatggactgatctgaaaatcgacctcaactcaagggtggtcagctcaatgctacacagagcacggacttttggattctttgcagtactttgaatttatttttctacctatatatgttttatatgctgctggtgctccattaaagttttactctgtgttgcactatatgtgttcatgataaaaaa

SEQ ID NO: 155 - DNA, 7878 bp, Homo sapiens
ttttccctgctctcaccgggcgggggagagaagccctctggacagcttctagagtgtgcaggttctcgtatccctcggccaagggtatcctctgcaaacctctgcaaacccagcgcaactacggtcccccggtcagacccaggatggggccagaacggacaggggccgcgccgctgccgctgctgctggtgttagcgctcagtcaaggcattttaaattgttgtttggcctacaatgttggtctcccagaagcaaaaatattttccggtccttcaagtgaacagtttggctatgcagtgcagcagtttataaatccaaaaggcaactggttactggttggttcaccctggagtggctttcctgagaaccgaatgggagatgtgtataaatgtcctgttgacctatccactgccacatgtgaaaaactaaatttgcaaacttcaacaagcattccaaatgttactgagatgaaaaccaacatgagcctcggcttgatcctcaccaggaacatgggaactggaggttttctcacatgtggtcctctgtgggcacagcaatgtgggaatcagtattacacaacgggtgtgtgttctgacatcagtcctgattttcagctctcagccagcttctcacctgcaactcagccctgcccttccctcatagatgttgtggttgtgtgtgatgaatcaaatagtatttatccttgggatgcagtaaagaattttttggaaaaatttgtacaaggcctggatataggccccacaaagacacaggtggggttaattcagtatgccaataatccaagagttgtgtttaacttgaacacatataaaaccaaagaagaaatgattgtagcaacatcccagacatcccaatatggtggggacctcacaaacacattcggagcaattcaatatgcaagaaaatatgcttattcagcagcttctggtgggcgacgaagtgctacgaaagtaatggtagttgtaactgacggtgaatcacatgatggttcaatgttgaaagctgtgattgatcaatgcaaccatgacaatatactgaggtttggcatagcagttcttgggtacttaaacagaaacgcccttgatactaaaaatttaataaaagaaataaaagcaatcgctagtattccaacagaaagatactttttcaatgtgtctgatgaagcagctctactagaaaaggctgggacattaggagaacaaattttcagcattgaaggtactgttcaaggaggagacaactttcagatggaaatgtcacaagtgggattcagtgcagattactcttctcaaaatgatattctgatgctgggtgcagtgggagcttttggctggagtgggaccattgtccagaagacatctcatggccatttgatctttcctaaacaagcctttgaccaaattctgcaggacagaaatcacagttcatatttaggttactctgtggctgcaatttctactggagaaagcactcactttgttgctggtgctcctcgggcaaattataccggccagatagtgctatatagtgtgaatgagaatggcaatatcacggttattcaggctcaccgaggtgaccagattggctcctattttggtagtgtgctgtgttcagttgatgtggataaagacaccattacagacgtgctcttggtaggtgcaccaatgtacatgagtgacctaaagaaagaggaaggaagagtctacctgtttactatcaaagagggcattttgggtcagcaccaatttcttgaaggccccgagggcattgaaaacactcgatttggttcagcaattgcagctctttcagacatcaacatggatggctttaatgatgtgattgttggttcaccactagaaaatcagaattctggagctgtatacatttacaatggtcatcagggcactatccgcacaaagtattcccagaaaatcttgggatccgatggagcctttaggagccatctccagtactttgggaggtccttggatggctatggagatttaaatggggattccatcaccgatgtgtctattggtgcctttggacaagtggttcaactctggtcacaaagtattgctgatgtagctatagaagcttcattcacaccagaaaaaatcactttggtcaacaagaatgctcagataattctcaaactctgcttcagtgcaaagttcagacctactaagcaaaacaatcaagtggccattgtatataacatcacacttgatgcagatggattttcatccagagtaacctccagggggttatttaaagaaaacaatgaaaggtgcctgcagaagaatatggtagtaaatcaagcacagagttgccccgagcacatcatttatatacaggagccctctgatgttgtcaactctttggatttgcgtgtggacatcagtctggaaaaccctggcactagccctgcccttgaagcctattctgagactgccaaggtcttcagtattcctttccacaaagactgtggtgaggacggactttgcatttctgatctagtcctagatgtccgacaaataccagctgctcaagaacaaccctttattgtcagcaaccaaaacaaaaggttaacattttcagtaacgctgaaaaataaaagggaaagtgcatacaacactggaattgttgttgatttttcagaaaacttgttttttgcatcattctccctgccggttgatgggacagaagtaacatgccaggtggctgcatctcagaagtctgttgcctgcgatgtaggctaccctgctttaaagagagaacaacaggtgacttttactattaactttgacttcaatcttcaaaaccttcagaatcaggcgtctctcagtttccaagccttaagtgaaagccaagaagaaaacaaggctgataatttggtcaacctcaaaattcctctcctgtatgatgctgaaattcacttaacaagatctaccaacataaatttttatgaaatctcttcggatgggaatgttccttcaatcgtgcacagttttgaagatgttggtccaaaattcatcttctccctgaaggtaacaacaggaagtgttccagtaagcatggcaactgtaatcatccacatccctcagtataccaaagaaaagaacccactgatgtacctaactggggtgcaaacagacaaggctggtgacatcagttgtaatgcagatatcaatccactgaaaataggacaaacatcttcttctgtatctttcaaaagtgaaaatttcaggcacaccaaagaattgaactgcagaactgcttcctgtagtaatgttacctgctggttgaaagacgttcacatgaaaggagaatactttgttaatgtgactaccagaatttggaacgggactttcgcatcatcaacgttccagacagtacagctaacggcagctgcagaaatcaacacctataaccctgagatatatgtgattgaagataacactgttacgattcccctgatgataatgaaacctgatgagaaagccgaagtaccaacaggagttataataggaagtataattgctggaatccttttgctgttagctctggttgcaattttatggaagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgaatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggggaaaaaaagtaatctttaaactggctggcccagagtttacattctaatttgcattgtgtcagaaacatgaaatgcttccaagcatgacaacttttaaagaaaaatatgatactctcagattttaagggggaaaactgttctctttaaaatatttgtctttaaacagcaactacagaagtggaagtgcttgatatgtaagtacttccacttgtgtatattttaatgaatattgatgttaacaagaggggaaaacaaaacacaggttttttcaatttatgctgctcatccaaagttgccacagatgatacttccaagtgataattttatttataaactaggtaaaatttgttgttggttccttttagaccacggctgccccttccacaccccatcttgctctaatgatcaaaacatgcttgaataactgagcttagagtatacctcctatatgtccatttaagttaggagagggggcgatatagagaataaggcacaaaattttgtttaaaactcagaatataacatgtaaaatcccatctgctagaagcccatcctgtgccagaggaaggaaaaggaggaaatttcctttctcttttaggaggcacaacagttctcttctaggatttgtttggctgactggcagtaacctagtgaatttctgaaagatgagtaatttctttggcaaccttcctcctcccttactgaaccactctcccacctcctggtggtaccattattatagaagccctctacagcctgactttctctccagcggtccaaagttatcccctcctttacccctcatccaaagttcccactccttcaggacagctgctgtgcattagatattaggggggaaagtcatctgtttaatttacacacttgcatgaattactgtatataaactccttaacttcagggagctattttcatttagtgctaaacaagtaagaaaaataagctcgagtgaatttctaaatgttggaatgttatgggatgtaaacaatgtaaagtaagacatctcaggatttcaccagaagttacagatgaggcactggaagccaccaaattagcaggtgcaccttctgtggctgtcttgtttctgaagtacttaaacttccacaagagtgaatttgacctaggcaagtttgttcaaaaggtagatcctgagatgatttggtcagattgggataaggcccagcaatctgcattttaacaagcaccccagtcactaggatgcagatggaccacactttgagaaacaccacccatttctactttttgcaccttattttctctgttcctgagcccccacattctctaggagaaacttagaggaaaagggcacagacactacatatctaaagctttggacaagtccttgacctctataaacttcagagtcctcattataaaatgggaagactgagctggagttcagcagtgatgcttttagttttaaaagtctatgatctggacttcctataatacaaatacacaatcctccaagaatttgacttggaaaaaaatgtcaaaggaaaacaggttatctgcccatgtgcatatggacaaccttgactaccctggcctggcccgtggtggcagtccagggctatctgtactgtttacagaattactttgtagttgacaacacaaaacaaacaaaaaaggcataaaatgccagcggtttatagaaaaaacagcatggtattctccagttaggtatgccagagtccaattcttttaacagctgtgagaatttgctgcttcattccaacaaaattttatttaaaaaaaaaaaaaaaagactggagaaactagtcattagcttgataaagaatatttaacagctagtggtgctggtgtgtacctgaagctccagctacttgagagactgagacaggaagatcgcttgagcccaggagttcaagtccagcctaagcaacatagcaagaccctgtctcaaaaaaatgactatttaaaaagacaatgtggccaggcacggtggctcacacctgtaatcccaacactttgggaggctgaggccggtggatcacgaggtcaggagtttgagactagcctggccaacatggtgaaaccccatctctaataatataaaaattagctgggcgtagtagcaggtgcctgtaatcccagttactcgggaagctgaggcaggagaatcacttgaacccgggaggcagaggtttcagtgagccgagatcgcgccactgcactccagcctgggtgacagggcaagactctgtctcaaacaaacaaacaaaaaaaaagttagtactgtatatgtaaatactagcttttcaatgtgctatacaaacaattatagcacatccttccttttactctgtctcacctcctttaggtgagtacttccttaaataagtgctaaacatacatatacggaacttgaaagctttggttagccttgccttaggtaatcagcctagtttacactgtttccagggagtagttgaattactataaaccattagccacttgtctctgcaccatttatcacaccaggacagggtctctcaacctgggcgctactgtcatttggggccaggtgattcttccttgcaggggctgtcctgtaccttgtaggacagcagccctgtcctagaaggtatgtttagcagcattcctggcctctagctacccgatgccagagcatgctccccccgcagtcatgacaatcaaaaaatgtctccagacattgtcaaatgcctcctggggggcagtatttctcaagcacttttaagcaaaggtaagtattcatacaagaaatttagggggaaaaaacattgtttaaataaaagctatgtgttcctattcaacaatatttttgctttaaaagtaagtagagggcataaaagatgtcatattcaaatttccatttcataaatggtgtacagacaaggtctatagaatgtggtaaaaacttgactgcaacacaaggcttataaaatagtaagatagtaaaatagcttatgaagaaactacagagatttaaaattgtgcatgactcatttcagcagcaaaataagaactcctaactgaacagaaatttttctacctagcaatgttattcttgtaaaatagttacctattaaaactgtgaagagtaaaactaaagccaatttattatagtcacacaagtgattatactaaaaattattataaaggttataattttataatgtatttacctgtcctgatatatagctataacccaatatatgaaaatctcaaaaattaagacatcatcatacagaaggcaggattccttaaactgagatccctgatccatctttaatatttcaatttgcacacataaaacaatgcccttttgtgtacattcaggcatacccattttaatcaatttgaaaggttaatttaaacctctagaggtgaatgagaaacatgggggaaaagtatgaaataggtgaaaatcttaactatttctttgaactctaaagactgaaactgtagccattatgtaaataaagtttcatatgtacctgtttattttggcagattaagtcaaaatatgaatgtatatattgcataactatgttagaattgtatatattttaaagaaattgtcttggatattttcctttatacataatagataagtcttttttcaaatgtggtgtttgatgtttttgattaaatgtgttttgcctctttccacaaaaactgtaaaaataaatgcatgtttgtacaaaaagttgcagaattcatttgatttatgagaaacaaaaattaaattgtagtcaacagttagtagtttttctcatatccaagtataacaaacagaaaagtttcattattgtaacccacttttttcataccacattattgaatattgttacaattgttttgaaaataaagccattttctttgggcttttataagttaaaaaaaaaa

SEQ ID NO: 156 - DNA, 3449 bp, Homo sapiens
gctctgcccgttgctcagcaagttacttggggttccagtttgataagaaaagacttcctgtggaggaatctgaagggaaggaggaggagctggcccattcctgcctgggaggttgtggaagaaggaagatggccagagctttgtgtccactgcaagccctctggcttctggagtgggtgctgctgctcttgggaccttgtgctgcccctccagcctgggccttgaacctggacccagtgcagctcaccttctatgcaggccccaatggcagccagtttggattttcactggacttccacaaggacagccatgggagagtggccatcgtggtgggcgccccgcggaccctgggccccagccaggaggagacgggcggcgtgttcctgtgcccctggagggccgagggcggccagtgcccctcgctgctctttgacctccgtgatgagacccgaaatgtaggctcccaaactttacaaaccttcaaggcccgccaaggactgggggcgtcggtcgtcagctggagcgacgtcattgtggcctgcgccccctggcagcactggaacgtcctagaaaagactgaggaggctgagaagacgcccgtaggtagctgctttttggctcagccagagagcggccgccgcgccgagtactccccctgtcgcgggaacaccctgagccgcatttacgtggaaaatgattttagctgggacaagcgttactgtgaagcgggcttcagctccgtggtcactcaggccggagagctggtgcttggggctcctggcggctattatttcttaggtctcctggcccaggctccagttgcggatattttctcgagttaccgcccaggcatccttttgtggcacgtgtcctcccagagcctctcctttgactccagcaacccagagtacttcgacggctactgggggtactcggtggccgtgggcgagttcgacggggatctcaacactacagaatatgtcgtcggtgcccccacttggagctggaccctgggagcggtggaaattttggattcctactaccagaggctgcatcggctgcgcggagagcagatggcgtcgtattttgggcattcagtggctgtcactgacgtcaacggggatgggaggcatgatctgctggtgggcgctccactgtatatggagagccgggcagaccgaaaactggccgaagtggggcgtgtgtatttgttcctgcagccgcgaggcccccacgcgctgggtgcccccagcctcctgctgactggcacacagctctatgggcgattcggctctgccatcgcacccctgggcgacctcgaccgggatggctacaatgacattgcagtggctgccccctacgggggtcccagtggccggggccaagtgctggtgttcctgggtcagagtgaggggctgaggtcacgtccctcccaggtcctggacagccccttccccacaggctctgcctttggcttctcccttcgaggtgccgtagacatcgatgacaacggatacccagacctgatcgtgggagcttacggggccaaccaggtggctgtgtacagagctcagccagtggtgaaggcctctgtccagctactggtgcaagattcactgaatcctgctgtgaagagctgtgtcctacctcagaccaagacacccgtgagctgcttcaacatccagatgtgtgttggagccactgggcacaacattcctcagaagctatccctaaatgccgagctgcagctggaccggcagaagccccgccagggccggcgggtgctgctgctgggctctcaacaggcaggcaccaccctgaacctggatctgggcggaaagcacagccccatctgccacaccaccatggccttccttcgagatgaggcagacttccgggacaagctgagccccattgtgctcagcctcaatgtgtccctaccgcccacggaggctggaatggcccctgctgtcgtgctgcatggagacacccatgtgcaggagcagacacgaatcgtcctggactgtggggaagatgacgtatgtgtgccccagcttcagctcactgccagcgtgacgggctccccgctcctagttggggcagataatgtcctggagctgcagatggacgcagccaacgagggcgagggggcctatgaagcagagctggccgtgcacctgccccagggcgcccactacatgcgggccctaagcaatgtcgagggctttgagagactcatctgtaatcagaagaaggagaatgagaccagggtggtgctgtgtgagctgggcaaccccatgaagaagaacgcccagataggaatcgcgatgttggtgagcgtggggaatctggaagaggctggggagtctgtgtccttccagctgcagatacggagcaagaacagccagaatccaaacagcaagattgtgctgctggacgtgccggtccgggcagaggcccaagtggagctgcgagggaactcctttccagcctccctggtggtggcagcagaagaaggtgagagggagcagaacagcttggacagctggggacccaaagtggagcacacctatgagctccacaacaatggccctgggactgtgaatggtcttcacctcagcatccaccttccgggacagtcccagccctccgacctgctctacatcctggatatacagccccaggggggccttcagtgcttcccacagcctcctgtcaaccctctcaaggtggactgggggctgcccatccccagcccctcccccattcacccggcccatcacaagcgggatcgcagacagatcttcctgccagagcccgagcagccctcgaggcttcaggatccagttctcgtaagctgcgactcggcgccctgtactgtggtgcagtgtgacctgcaggagatggcgcgcgggcagcgggccatggtcacggtgctggccttcctgtggctgcccagcctctaccagaggcctctggatcagtttgtgctgcagtcgcacgcatggttcaacgtgtcctccctcccctatgcggtgcccccgctcagcctgccccgaggggaagctcaggtgtggacacagctgctccgggccttggaggagagggccattccaatctggtgggtgctggtgggtgtgctgggtggcctgctgctgctcaccatcctggtcctggccatgtggaaggtcggcttcttcaagcggaaccggccacccctggaagaagatgatgaagagggggagtgatggtgcagcctacactattctagcaggagggttgggcgtgctacctgcaccgccccttctccaacaagttgcctccaagctttgggttggagctgttccattgggtcctcttggtgtcgtttccctcccaacagagctgggctaccccccctcctgctgcctaataaagagactgagccctgaaaaaaaaaaaaaaaaaaa

SEQ ID NO: 157 - DNA, 7281 bp, Homo sapiens
ataacgtctttgtcactaaaatgttccccaggggccttcggcgagtctttttgtttggttttttgtttttaatctgtggctcttgataatttatctagtggttgcctacacctgaaaaacaagacacagtgtttaactatcaacgaaagaactggacggctccccgccgcagtcccactccccgagtttgtggctggcatttgggccacgccgggctgggcggtcacagcgaggggcgcgcagtttggggtcacacagctccgcttctaggccccaaccaccgttaaaaggggaagcccgtgccccatcaggtccgctcttgctgagcccagagccatcccgcgctctgcgggctgggaggcccgggccaggacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctggcggcagaaaccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaataaactttgcaaggttttgtgcccatgaaaattgttctgctgatttacaggtttctgcaaagattgggtttttgaagccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctgtgaaaatgaagaggaaatggacaatctaaagcacagcagagtgactgtagcaatacctttaaaatatgaggttaagctgactgttcatgggtttgtaaacccaacttcatttgtgtatggatcaaatgatgaaaatgagcctgaaacgtgcatggtggagaaaatgaacttaactttccatgttatcaacactggcaatagtatggctcccaatgttagtgtggaaataatggtaccaaattcttttagcccccaaactgataagctgttcaacattttggatgtccagactactactggagaatgccactttgaaaattatcaaagagtgtgtgcattagagcagcaaaagagtgcaatgcagaccttgaaaggcatagtccggttcttgtccaagactgataagaggctattgtactgcataaaagctgatccacattgtttaaatttcttgtgtaattttgggaaaatggaaagtggaaaagaagccagtgttcatatccaactggaaggccggccatccattttagaaatggatgagacttcagcactcaagtttgaaataagagcaacaggttttccagagccaaatccaagagtaattgaactaaacaaggatgagaatgttgcgcatgttctactggaaggactacatcatcaaagacccaaacgttatttcaccatagtgattatttcaagtagcttgctacttggacttattgtacttctgttgatctcatatgttatgtggaaggctggcttctttaaaagacaatacaaatctatcctacaagaagaaaacagaagagacagttggagttatatcaacagtaaaagcaatgatgattaaggacttctttcaaattgagagaatggaaaacagactcaggttgtagtaaagaaatttaaaagacactgtttacaagaaaaaatgaattttgtttggacttcttttactcatgatcttgtgacatattatgtcttcatgcaaggggaaaatctcagcaatgattactctttgagatagaagaactgcaaaggtaataatacagccaaagataatctctcagcttttaaatgggtagagaaacactaaagcattcaatttattcaagaaaagtaagcccttgaagatatcttgaaatgaaagtataactgagttaaattatactggagaagtcttagacttgaaatactacttaccatatgtgcttgcctcagtaaaatgaaccccactgggtgggcagaggttcatttcaaatacatctttgatacttgttcaaaatatgttctttaaaaatataattttttagagagctgttcccaaattttctaacgagtggaccattatcactttaaagccctttatttataatacatttcctacgggctgtgttccaacaaccattttttttcagcagactatgaatattatagtattataggccaaactggcaaacttcagactgaacatgtacactggtttgagcttagtgaaattacttctggataattatttttttataattatggatttcaccatctttctttctgtatatatacatgtgtttttatgtaggtatatatttaccattcttcctatctattcttcctataacacacctttatcaagcatacccaggagtaatcttcaaatcttttgttatattctgaaacaaaagattgtgagtgttgcactttacctgatacacgctgatttagaaaatacagaaaccatacctcactaataactttaaaatcaaagctgtgcaaagactagggggcctatacttcatatgtattatgtactatgtaaaatattgactatcacacaactatttccttggatgtaattctttgttaccctttacaagtataagtgttaccttacatggaaacgaagaaacaaaattcataaatttaaattcataaatttagctgaaagatactgattcaatttgtatacagtgaatataaatgagacgacagcaaaattttcatgaaatgtaaaatatttttatagtttgttcatactatatgaggttctattttaaatgactttctggattttaaaaaatttctttaaatacaatcatttttgtaatatttattttatgcttatgatctagataattgcagaatatcattttatctgactctgccttcataagagagctgtggccgaattttgaacatctgttatagggagtgatcaaattagaaggcaatgtggaaaaacaattctgggaaagatttctttatatgaagtccctgccactagccagccatcctaattgatgaaagttatctgttcacaggcctgcagtgatggtgaggaatgttctgagatttgcgaaggcatttgagtagtgaaatgtaagcacaaaacctcctgaacccagagtgtgtatacacaggaataaactttatgacatttatgtatttttaaaaaactttgtatcgttataaaaaggctagtcattctttcaggagaacatctaggatcatagatgaaaaatcaagccccgatttagaactgtcttctccaggatggtctctaaggaaatttacatttggttctttcctactcagaactactcagaaacaactatatatttcaggttatctgagcacagtgaaagcagagtactatggttgtccaacacaggcctctcagatacaaggggaacacaattacatattgggctagattttgcccagttcaaaatagtatttgttatcaacttactttgttacttgtatcatgaattttaaaaccctaccactttaagaagacagggatgggttattcttttttggcaggtaggctatataactatgtgattttgaaatttaactgctctggattagggagcagtgaatcaaggcagacttatgaaatctgtattatatttgtaacagaatataggaaatttaacataattgatgagctcaaatcctgaaaaatgaaagaatccaaattatttcagaattatctaggttaaatattgatgtattatgatggttgcaaagtttttttgtgtgtccaataaacacattgtaaaaaaaagaatttgaattgatatctaaaaacagaatttgaattgatatttcatcttgacttttaaagccctagaggctaattgttagtaacatcaatttctattaggatatccgtttggccacacagcaggaggttagagcaatggagcattactgagttcctccccctgtcagatcagcagcagcattagattctcatagaagtgcgaaccatatggtgaactggtatgtgagggatctagagtgccatgttcctcaagagaatctaatgcctgatgatctgaggtggaacagttcatcctgaaaccattcccccatccacggaaaaattgtcttccatgaaactggtcccaaaaagggtggggaccacaggtttaaagcatggccacatttctttatattaaaattctagtttgtacatttcttttagaaacaattacatgttactttggaatcatttcttccatgcttcctccataaagactgataagtcttggatgcaatctgtaaagaaaatacattatttcatcaacttattttgttgtttttcacatacacctaataagtatggtacacaatgccaatgccaaatacaaattgataacaaacacagcattcccaacagagctgtaatctagaaaactgagaaggtctgattgataaatcatcaacaacaataattgctctaaaacctccttaactgacttccttgattgtccaatgctctccattacctctgtaaaacagtcagttatgcctctagaacacccatgtctagtgggcacccctgcatgcttcttctaaccactgagtgtcacaatgcctaccaagaatgcgtttgcaggttcctaaacctgtttataccagttgctatgtaaaattgttcccaagggaagttgaatgctctgtaaaggcctaataaaagcaaattactgaacaaaacatgttacagtaattatgagtgagaggaaactaagatggaaggataaaaatctaacactttactattcagatggctccactaaaagatttaagatcttgatccatttttaaaaatccaaaatggaagttgtagacattatctgtagtttatgcacaacaataaattagaaagccaatgtagacacgcataaccaaagaaaatgccttgggtctacataacagttgaataaatgtaaagttgcttttaaaaaaaaaaaaaaaaaa

SEQ ID NO: 158 - DNA, 4267 bp, Homo sapiens
attcgcctctgggaggtttaggaagcggctccgggtcggtggccccaggacagggaagagcgggcgctatggggagccggacgccagagtcccctctccacgccgtgcagctgcgctggggcccccggcgccgacccccgctgctgccgctgctgttgctgctgctgccgccgccacccagggtcgggggcttcaacttagacgcggaggccccagcagtactctcggggcccccgggctccttcttcggattctcagtggagttttaccggccgggaacagacggggtcagtgtgctggtgggagcacccaaggctaataccagccagccaggagtgctgcagggtggtgctgtctacctctgtccttggggtgccagccccacacagtgcacccccattgaatttgacagcaaaggctctcggctcctggagtcctcactgtccagctcagagggagaggagcctgtggagtacaagtccttgcagtggttcggggcaacagttcgagcccatggctcctccatcttggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctgatctgattgtggggtcctttggtgtggacaaggctgtggtatacaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactccattggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcaggaacgagtcagaatttcgagacaaactctcgccgattcacatcgctctcaacttctccttggacccccaagccccagtggacagccacggcctcaggccagccctacattatcagagcaagagccggatagaggacaaggctcagatcttgctggactgtggagaagacaacatctgtgtgcctgacctgcagctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccagggaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcagcaagaatctcaacaactcgcaaagcgacgtggtttcctttcggctctccgtggaggctcaggcccaggtcaccctgaacggtgtctccaagcctgaggcagtgctattcccagtaagcgactggcatccccgagaccagcctcagaaggaggaggacctgggacctgctgtccaccatgtctatgagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggagttggatcccgagggttccctgcaccaccagcaaaaacgggaagctccaagccgcagctctgcttcctcgggacctcagatcctgaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggccccagcctccctgaagcctttgcattttggagagtttcctgaaacaacttggaaagataactaggaaatccattcacagttctttgggccagacatgccacaaggacttcctgtccagctccaacctgcaaagatctgtcctcagccttgccagagatccaaaagaagcccccagctaagaacctggaacttggggagttaagacctggcagctctggacagccccaccctggtgggccaacaaagaacactaactatgcatggtgccccaggaccagctcaggacagatgccacacaaggatagatgctggcccagggcccagagcccagctccaaggggaatcagaactcaaatggggccagatccagcctggggtctggagttgatctggaacccagactcagacattggcacctaatccaggcagatccaggactatatttgggcctgctccagacctgatcctggaggcccagttcaccctgatttaggagaagccaggaatttcccaggaccctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgacccagtgcccccactgaccagaactagaaaaaaaaaaaaaaaaaaa

SEQ ID NO: 159 - DNA, 3879 bp, Homo sapiens
atcagacgcgcagaggaggcggggccgcggctggtttcctgccggggggcggctctgggccgccgagtcccctcctcccgcccctgaggaggaggagccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggcgtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttactcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctgtcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcaaaaaaaaaa

SEQ ID NO: 160 - DNA, 4894 bp, Homo sapiens
cgccgcgggaggcggacgagatgcgagcgcggccgcggccccggccgctctgggcgactgtgctggcgctgggggcgctggcgggcgttggcgtaggagggcccaacatctgtaccacgcgaggtgtgagctcctgccagcagtgcctggctgtgagccccatgtgtgcctggtgctctgatgaggccctgcctctgggctcacctcgctgtgacctgaaggagaatctgctgaaggataactgtgccccagaatccatcgagttcccagtgagtgaggcccgagtactagaggacaggcccctcagcgacaagggctctggagacagctcccaggtcactcaagtcagtccccagaggattgcactccggctccggccagatgattcgaagaatttctccatccaagtgcggcaggtggaggattaccctgtggacatctactacttgatggacctgtcttactccatgaaggatgatctgtggagcatccagaacctgggtaccaagctggccacccagatgcgaaagctcaccagtaacctgcggattggcttcggggcatttgtggacaagcctgtgtcaccatacatgtatatctccccaccagaggccctcgaaaacccctgctatgatatgaagaccacctgcttgcccatgtttggctacaaacacgtgctgacgctaactgaccaggtgacccgcttcaatgaggaagtgaagaagcagagtgtgtcacggaaccgagatgccccagagggtggctttgatgccatcatgcaggctacagtctgtgatgaaaagattggctggaggaatgatgcatcccacttgctggtgtttaccactgatgccaagactcatatagcattggacggaaggctggcaggcattgtccagcctaatgacgggcagtgtcatgttggtagtgacaatcattactctgcctccactaccatggattatccctctttggggctgatgactgagaagctatcccagaaaaacatcaatttgatctttgcagtgactgaaaatgtagtcaatctctatcagaactatagtgagctcatcccagggaccacagttggggttctgtccatggattccagcaatgtcctccagctcattgttgatgcttatgggaaaatccgttctaaagtagagctggaagtgcgtgacctccctgaagagttgtctctatccttcaatgccacctgcctcaacaatgaggtcatccctggcctcaagtcttgtatgggactcaagattggagacacggtgagcttcagcattgaggccaaggtgcgaggctgtccccaggagaaggagaagtcctttaccataaagcccgtgggcttcaaggacagcctgatcgtccaggtcacctttgattgtgactgtgcctgccaggcccaagctgaacctaatagccatcgctgcaacaatggcaatgggacctttgagtgtggggtatgccgttgtgggcctggctggctgggatcccagtgtgagtgctcagaggaggactatcgcccttcccagcaggacgaatgcagcccccgggagggtcagcccgtctgcagccagcggggcgagtgcctctgtggtcaatgtgtctgccacagcagtgactttggcaagatcacgggcaagtactgcgagtgtgacgacttctcctgtgtccgctacaagggggagatgtgctcaggccatggccagtgcagctgtggggactgcctgtgtgactccgactggaccggctactactgcaactgtaccacgcgtactgacacctgcatgtccagcaatgggctgctgtgcagcggccgcggcaagtgtgaatgtggcagctgtgtctgtatccagccgggctcctatggggacacctgtgagaagtgccccacctgcccagatgcctgcacctttaagaaagaatgtgtggagtgtaagaagtttgaccggggagccctacatgacgaaaatacctgcaaccgttactgccgtgacgagattgagtcagtgaaagagcttaaggacactggcaaggatgcagtgaattgtacctataagaatgaggatgactgtgtcgtcagattccagtactatgaagattctagtggaaagtccatcctgtatgtggtagaagagccagagtgtcccaagggccctgacatcctggtggtcctgctctcagtgatgggggccattctgctcattggccttgccgccctgctcatctggaaactcctcatcaccatccacgaccgaaaagaattcgctaaatttgaggaagaacgcgccagagcaaaatgggacacagccaacaacccactgtataaagaggccacgtctaccttcaccaatatcacgtaccggggcacttaatgataagcagtcatcctcagatcattatcagcctgtgccacgattgcaggagtccctgccatcatgtttacagaggacagtatttgtggggagggatttggggctcagagtggggtaggttgggagaatgtcagtatgtggaagtgtgggtctgtgtgtgtgtatgtgggggtctgtgtgtttatgtgtgtgtgttgtgtgtgggagtgtgtaatttaaaattgtgatgtgtcctgataagctgagctccttagcctttgtcccagaatgcctcctgcagggattcttcctgcttagcttgagggtgactatggagctgagcaggtgttcttcattacctcagtgagaagccagctttcctcatcaggccattgtccctgaagagaagggcagggctgaggcctctcattccagaggaagggacaccaagccttggctctaccctgagttcataaatttatggttctcaggcctgactctcagcagctatggtaggaactgctgggcttggcagcccgggtcatctgtacctctgcctcctttcccctccctcaggccgaaggaggagtcagggagagctgaactattagagctgcctgtgccttttgccatcccctcaacccagctatggttctctcgcaagggaagtccttgcaagctaattctttgacctgttgggagtgaggatgtctgggccactcaggggtcattcatggcctgggggatgtaccagcatctcccagttcataatcacaacccttcagatttgccttattggcagctctactctggaggtttgtttagaagaagtgtgtcacccttaggccagcaccatctctttacctcctaattccacaccctcactgctgtagacatttgctatgagctggggatgtctctcatgaccaaatgcttttcctcaaagggagagagtgctattgtagagccagaggtctggccctatgcttccggcctcctgtccctcatccatagcacctccacatacctggccctgtgccttggtgtgctgtatccatccatggggctgattgtatttaccttctacctcttggctgccttgtgaaggaattattcccatgagttggctgggaataagtgccaggatggaatgatgggtcagttgtatcagcacgtgtggcctgttcttctatgggttggacaacctcattttaactcagtctttaatctgagaggccacagtgcaattttattttatttttctcatgatgaggttttcttaacttaaaagaacatgtatataaacatgcttgcattatatttgtaaatttatgtgatggcaaagaaggagagcataggaaaccacacagacttgggcagggtacagacactcccacttggcatcattcacagcaagtcactggccagtggctggatctgtgaggggctctctcatgatagaaggctatggggatagatgtgtggacacattggacctttcctgaggaagagggactgttcttttgtcccagaaaagcagtggctccattggtgttgacatacatccaacattaaaagccacccccaaatgcccaagaaaaaaagaaagacttatcaacatttgttccatgagcagaaaactggagctctggcctcagtgttacagctaaataatctttaattaaggcaagtcactttcttcttcttaaagctgttttctagtttgagaaatgatgggattttagcagccagtcttgaaggtctctttcagtatcaacattctaagatgctgggacttactgtgtcatcaaatgtgcggttaagattctctgggatattgatactgtttgtgtttttagttgggagatctgagagacctggctttggcaagagcagatgtcattccatatcacctttctcaatgaaagtctcattctatcctctctccaaacccgttttccaacatttgttaatagttacgtctctcctgatgtagcacttaagcttcatttagttattatttctttcttcactttgcacacatttgcatccacatattagggaagaggaatccataagtagctgaaatatctattctgtattattgtgttaacattgagaataagccttggaattagatatggggcaatgactgagccctgtctcacccatggattactccttactgtagggaatggcagtatggtagagggataaatagggggcggggagggatagtcatggatccaagaagtccttagaaatagtggcagggaacaggtgtggaagctcatgcctgtaattataaccttcagctactaagacaggtgtggtggctcacgcctgtgattataatcttcagttactaagacagagtccatgagagtgttaatgggacattttctttagataagatgttttatatgaagaaactgtatcaaagggggaagaaaatgtatttaacaggtgaatcaaatcaggaatcttgtctgagctactggaatgaagttcacaggtcttgaagacca

SEQ ID NO: 161 - DNA, 4392 bp, Homo sapiens
gccgccgagcggagccagcccctcccctacccggagcagcccgctggggccgtcccgagcggcgacacactaggagtcccggccggccagccagggcagccgcggtcccgggactcggccgtgagtgctgcgggacggatggtggcggcggggcgcgggccagcgcgggcgccgtgagccggagctgcgcgcggggcatgcggctgcggcccccggccctcggcccccgcgctccggccccagccccggccgccggcccccgcggagtgcagcgaccgcgccgccgctgagggaggcgccccaccatgccgcgggccccggcgccgctgtacgcctgcctcctggggctctgcgcgctcctgccccggctcgcaggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgatactctctgtgtgtttctttctttctgagcggacttaaaatggtgcccccagtggggattgaagcggccgtgtacttcctcagggatgggacacaggctggtctgatactccagactgcagcttgtcaagtaagcatgaggtgctcggggcagtgagggctgtgcaagggggaacactgagcagatacctttggccccttccagcttttactgacagagagttccaggctagacaccataaaaaccaccccttgttctgaggggctgaggctggaaatagattgtacagacaagcaagggttgagtggtggttcccacacgaagtcatctcttaatcatcattagcaatagcagttcccttccaaggcctcccctcactcccgaaacacttacgtcccatgcaggcccaatgcaaaaaaacacatttgagcttttttcccgcagggccatgaagtccccttaagttcccatatctaagatggttgactgaccctctccccttatgtacagaagaggaaactgattctcagagaggggaagtggcttgcccgagtgtttgttaggaggttactgaatgacaaactgttcctaagaccccatctcatgctggccagagggccagcctcctcattcctgcttgctcttagaaaatctttcactgatcattttttgtcactggaataacttcaaggttattatgctttcattccaaatggatctgtcctcagctctggacccaattccccttacttcattttggcaaacactaagtcaaatagtgaaatgcctgtcactacatagaacctattacctggggcaaatacgaacagattgagtttccttcatcttgtgtaaatatgatgaaacagagacctggtaacttggtgacactgttaaaccctttttgggataaagccaaatgtaaatgaaaacattaaacagataaattgtggtgttgagacttttctgaattgagaaaaataaatgtaattttggaagaaaaaaaaaaaaaaa

SEQ ID NO: 162 - DNA, 5756 bp, Homo sapiens
aaatcttccccaccctggggagtgtcacttcctcctctgccgtctcccagatcagtacacaaaggctgctgctgccgccagaggaaggactgctctgcacgcacctatgtggaaactaaagcccagagagaaagtctgacttgccccacagccagtgagtgactgcagcagcaccagaatctggtctgtttcctgtttggctcttctaccactacggcttgggatctcgggcatggtggctttgccaatggtccttgttttgctgctggtcctgagcagaggtgagagtgaattggacgccaagatcccatccacaggggatgccacagaatggcggaatcctcacctgtccatgctggggtcctgccagccagccccctcctgccagaagtgcatcctctcacaccccagctgtgcatggtgcaagcaactgaacttcaccgcgtcgggagaggcggaggcgcggcgctgcgcccgacgagaggagctgctggctcgaggctgcccgctggaggagctggaggagccccgcggccagcaggaggtgctgcaggaccagccgctcagccagggcgcccgcggagagggtgccacccagctggcgccgcagcgggtccgggtcacgctgcggcctggggagccccagcagctccaggtccgcttccttcgtgctgagggatacccggtggacctgtactaccttatggacctgagctactccatgaaggacgacctggaacgcgtgcgccagctcgggcacgctctgctggtccggctgcaggaagtcacccattctgtgcgcattggttttggttcctttgtggacaaaacggtgctgccctttgtgagcacagtaccctccaaactgcgccacccctgccccacccggctggagcgctgccagtcaccattcagctttcaccatgtgctgtccctgacgggggacgcacaagccttcgagcgggaggtggggcgccagagtgtgtccggcaatctggactcgcctgaaggtggcttcgatgccattctgcaggctgcactctgccaggagcagattggctggagaaatgtgtcccggctgctggtgttcacttcagacgacacattccatacagctggggacgggaagttgggcggcattttcatgcccagtgatgggcactgccacttggacagcaatggcctctacagtcgcagcacagagtttgactacccttctgtgggtcaggtagcccaggccctctctgcagcaaatatccagcccatctttgctgtcaccagtgccgcactgcctgtctaccaggagctgagtaaactgattcctaagtctgcagttggggagctgagtgaggactccagcaacgtggtacagctcatcatggatgcttataatagcctgtcttccaccgtgacccttgaacactcttcactccctcctggggtccacatttcttacgaatcccagtgtgagggtcctgagaagagggagggtaaggctgaggatcgaggacagtgcaaccacgtccgaatcaaccagacggtgactttctgggtttctctccaagccacccactgcctcccagagccccatctcctgaggctccgggcccttggcttctcagaggagctgattgtggagttgcacacgctgtgtgactgtaattgcagtgacacccagccccaggctccccactgcagtgatggccagggacacctacaatgtggtgtatgcagctgtgcccctggccgcctaggtcggctctgtgagtgctctgtggcagagctgtcctccccagacctggaatctgggtgccgggctcccaatggcacagggcccctgtgcagtggaaagggtcactgtcaatgtggacgctgcagctgcagtggacagagctctgggcatctgtgcgagtgtgacgatgccagctgtgagcgacatgagggcatcctctgcggaggctttggtcgctgccaatgtggagtatgtcactgtcatgccaaccgcacgggcagagcatgcgaatgcagtggggacatggacagttgcatcagtcccgagggagggctctgcagtgggcatggacgctgcaaatgcaaccgctgccagtgcttggacggctactatggtgctctatgcgaccaatgcccaggctgcaagacaccatgcgagagacaccgggactgtgcagagtgtggggccttcaggactggcccactggccaccaactgcagtacagcttgtgcccataccaatgtgaccctggccttggcccctatcttggatgatggctggtgcaaagagcggaccctggacaaccagctgttcttcttcttggtggaggatgacgccagaggcacggtcgtgctcagagtgagaccccaagaaaagggagcagaccacacgcaggccattgtgctgggctgcgtagggggcatcgtggcagtggggctggggctggtcctggcttaccggctctcggtggaaatctatgaccgccgggaatacagtcgctttgagaaggagcagcaacaactcaactggaagcaggacagtaatcctctctacaaaagtgccatcacgaccaccatcaatcctcgctttcaagaggcagacagtcccactctctgaaggagggagggacacttacccaaggctcttctccttggaggacagtgggaactggagggtgagaggaagggtgggtctgtaagaccttggtaggggactaattcactggcgaggtgcggccaccaccctacttcattttcagagtgacacccaagagggctgcttcccatgcctgcaaccttgcatccatctgggctaccccacccaagtatacaataaagtcttacctcagaccacaaaaaaaaaaaaaaatcttccccaccctggggagtgtcacttcctcctctgccgtctcccagatcagtacacaaaggctgctgctgccgccagaggaaggactgctctgcacgcacctatgtggaaactaaagcccagagagaaagtctgacttgccccacagccagtgagtgactgcagcagcaccagaatctggtctgtttcctgtttggctcttctaccactacggcttgggatctcgggcatggtggctttgccaatggtccttgttttgctgctggtcctgagcagaggtgagagtgaattggacgccaagatcccatccacaggggatgccacagaatggcggaatcctcacctgtccatgctggggtcctgccagccagccccctcctgccagaagtgcatcctctcacaccccagctgtgcatggtgcaagcaactgaacttcaccgcgtcgggagaggcggaggcgcggcgctgcgcccgacgagaggagctgctggctcgaggctgcccgctggaggagctggaggagccccgcggccagcaggaggtgctgcaggaccagccgctcagccagggcgcccgcggagagggtgccacccagctggcgccgcagcgggtccgggtcacgctgcggcctggggagccccagcagctccaggtccgcttccttcgtgctgagggatacccggtggacctgtactaccttatggacctgagctactccatgaaggacgacctggaacgcgtgcgccagctcgggcacgctctgctggtccggctgcaggaagtcacccattctgtgcgcattggttttggttcctttgtggacaaaacggtgctgccctttgtgagcacagtaccctccaaactgcgccacccctgccccacccggctggagcgctgccagtcaccattcagctttcaccatgtgctgtccctgacgggggacgcacaagccttcgagcgggaggtggggcgccagagtgtgtccggcaatctggactcgcctgaaggtggcttcgatgccattctgcaggctgcactctgccaggagcagattggctggagaaatgtgtcccggctgctggtgttcacttcagacgacacattccatacagctggggacgggaagttgggcggcattttcatgcccagtgatgggcactgccacttggacagcaatggcctctacagtcgcagcacagagtttgactacccttctgtgggtcaggtagcccaggccctctctgcagcaaatatccagcccatctttgctgtcaccagtgccgcactgcctgtctaccaggagctgagtaaactgattcctaagtctgcagttggggagctgagtgaggactccagcaacgtggtacagctcatcatggatgcttataatagcctgtcttccaccgtgacccttgaacactcttcactccctcctggggtccacatttcttacgaatcccagtgtgagggtcctgagaagagggagggtaaggctgaggatcgaggacagtgcaaccacgtccgaatcaaccagacggtgactttctgggtttctctccaagccacccactgcctcccagagccccatctcctgaggctccgggcccttggcttctcagaggagctgattgtggagttgcacacgctgtgtgactgtaattgcagtgacacccagccccaggctccccactgcagtgatggccagggacacctacaatgtggtgtatgcagctgtgcccctggccgcctaggtcggctctgtgagtgctctgtggcagagctgtcctccccagacctggaatctgggtgccgggctcccaatggcacagggcccctgtgcagtggaaagggtcactgtcaatgtggacgctgcagctgcagtggacagagctctgggcatctgtgcgagtgtgacgatgccagctgtgagcgacatgagggcatcctctgcggaggctttggtcgctgccaatgtggagtatgtcactgtcatgccaaccgcacgggcagagcatgcgaatgcagtggggacatggacagttgcatcagtcccgagggagggctctgcagtgggcatggacgctgcaaatgcaaccgctgccagtgcttggacggctactatggtgctctatgcgaccaatgcccaggctgcaagacaccatgcgagagacaccgggactgtgcagagtgtggggccttcaggactggcccactggccaccaactgcagtacagcttgtgcccataccaatgtgaccctggccttggcccctatcttggatgatggctggtgcaaagagcggaccctggacaaccagctgttcttcttcttggtggaggatgacgccagaggcacggtcgtgctcagagtgagaccccaagaaaagggagcagaccacacgcaggccattgtgctgggctgcgtagggggcatcgtggcagtggggctggggctggtcctggcttaccggctctcggtggaaatctatgaccgccgggaatacagtcgctttgagaaggagcagcaacaactcaactggaagcaggacagtaatcctctctacaaaagtgccatcacgaccaccatcaatcctcgctttcaagaggcagacagtcccactctctgaaggagggagggacacttacccaaggctcttctccttggaggacagtgggaactggagggtgagaggaagggtgggtctgtaagaccttggtaggggactaattcactggcgaggtgcggccaccaccctacttcattttcagagtgacacccaagagggctgcttcccatgcctgcaaccttgcatccatctgggctaccccacccaagtatacaataaagtcttacctcagaccacaaaaaaaaaaaa

SEQ ID NO: 163 - DNA, 3875 bp, Homo sapiens
agctgttcttggctgacttcacatcaaaactcctatactgacctgagacagaggcagcagtgatacccacctgagagatcctgtgtttgaacaactgcttcccaaaacggaaagtatttcaagcctaaacctttgggtgaaaagaactcttgaagtcatgattgcttcacagtttctctcagctctcactttggtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacagaagaagccaagaactgggctccaggtgaacccaacaataggcaaaaagatgaggactgcgtggagatctacatcaagagagaaaaagatgtgggcatgtggaatgatgagaggtgcagcaagaagaagcttgccctatgctacacagctgcctgtaccaatacatcctgcagtggccacggtgaatgtgtagagaccatcaataattacacttgcaagtgtgaccctggcttcagtggactcaagtgtgagcaaattgtgaactgtacagccctggaatcccctgagcatggaagcctggtttgcagtcacccactgggaaacttcagctacaattcttcctgctctatcagctgtgataggggttacctgccaagcagcatggagaccatgcagtgtatgtcctctggagaatggagtgctcctattccagcctgcaatgtggttgagtgtgatgctgtgacaaatccagccaatgggttcgtggaatgtttccaaaaccctggaagcttcccatggaacacaacctgtacatttgactgtgaagaaggatttgaactaatgggagcccagagccttcagtgtacctcatctgggaattgggacaacgagaagccaacgtgtaaagctgtgacatgcagggccgtccgccagcctcagaatggctctgtgaggtgcagccattcccctgctggagagttcaccttcaaatcatcctgcaacttcacctgtgaggaaggcttcatgttgcagggaccagcccaggttgaatgcaccactcaagggcagtggacacagcaaatcccagtttgtgaagctttccagtgcacagccttgtccaaccccgagcgaggctacatgaattgtcttcctagtgcttctggcagtttccgttatgggtccagctgtgagttctcctgtgagcagggttttgtgttgaagggatccaaaaggctccaatgtggccccacaggggagtgggacaacgagaagcccacatgtgaagctgtgagatgcgatgctgtccaccagcccccgaagggtttggtgaggtgtgctcattcccctattggagaattcacctacaagtcctcttgtgccttcagctgtgaggagggatttgaattacatggatcaactcaacttgagtgcacatctcagggacaatggacagaagaggttccttcctgccaagtggtaaaatgttcaagcctggcagttccgggaaagatcaacatgagctgcagtggggagcccgtgtttggcactgtgtgcaagttcgcctgtcctgaaggatggacgctcaatggctctgcagctcggacatgtggagccacaggacactggtctggcctgctacctacctgtgaagctcccactgagtccaacattcccttggtagctggactttctgctgctggactctccctcctgacattagcaccatttctcctctggcttcggaaatgcttacggaaagcaaagaaatttgttcctgccagcagctgccaaagccttgaatcagatggaagctaccaaaagccttcttacatcctttaagttcaaaagaatcagaaacaggtgcatctggggaactagagggatacactgaagttaacagagacagataactctcctcgggtctctggcccttcttgcctactatgccagatgcctttatggctgaaaccgcaacacccatcaccacttcaatagatcaaagtccagcaggcaaggacggccttcaactgaaaagactcagtgttccctttcctactctcaggatcaagaaagtgttggctaatgaagggaaaggatattttcttccaagcaaaggtgaagagaccaagactctgaaatctcagaattccttttctaactctcccttgctcgctgtaaaatcttggcacagaaacacaatattttgtggctttctttcttttgcccttcacagtgtttcgacagctgattacacagttgctgtcataagaatgaataataattatccagagtttagaggaaaaaaatgactaaaaatattataacttaaaaaaatgacagatgttgaatgcccacaggcaaatgcatggagggttgttaatggtgcaaatcctactgaatgctctgtgcgagggttactatgcacaatttaatcactttcatccctatgggattcagtgcttcttaaagagttcttaaggattgtgatatttttacttgcattgaatatattataatcttccatacttcttcattcaatacaagtgtggtagggacttaaaaaacttgtaaatgctgtcaactatgatatggtaaaagttacttattctagattaccccctcattgtttattaacaaattatgttacatctgttttaaatttatttcaaaaagggaaactattgtcccctagcaaggcatgatgttaaccagaataaagttctgagtgtttttactacagttgttttttgaaaacatggtagaattggagagtaaaaactgaatggaaggtttgtatattgtcagatattttttcagaaatatgtggtttccacgatgaaaaacttccatgaggccaaacgttttgaactaataaaagcataaatgcaaacacacaaaggtataattttatgaatgtctttgttggaaaagaatacagaaagatggatgtgctttgcattcctacaaagatgtttgtcagatatgatatgtaaacataattcttgtatattatggaagattttaaattcacaatagaaactcaccatgtaaaagagtcatctggtagatttttaacgaatgaagatgtctaatagttattccctatttgttttcttctgtatgttagggtgctctggaagagaggaatgcctgtgtgagcaagcatttatgtttatttataagcagatttaacaattccaaaggaatctccagttttcagttgatcactggcaatgaaaaattctcagtcagtaattgccaaagctgctctagccttgaggagtgtgagaatcaaaactctcctacacttccattaacttagcatgtgttgaaaaaaaagtttcagagaagttctggctgaacactggcaacaacaaagccaacagtcaaaacagagatgtgataaggatcagaacagcagaggttcttttaaaggggcagaaaaactctgggaaataagagagaacaactactgtgatcaggctatgtatggaatacagtgttattttctttgaaattgtttaagtgttgtaaatatttatgtaaactgcattagaaattagctgtgtgaaataccagtgtggtttgtgtttgagttttattgagaattttaaattataacttaaaatattttataatttttaaagtatatatttatttaagcttatgtcagacctatttgacataacactataaaggttgacaataaatgtgcttatgttta

SEQ ID NO: 164 - DNA, 3249 bp, Homo sapiens
caagcttagcctggccgggaaacgggaggcgtggaggccgggagcagcccccggggtcatcgccctgccaccgccgcccgattgctttagcttggaaattccggagctgaagcggccagcgagggaggatgaccctctcggcccgggcaccctgtcagtccggaaataactgcagcatttgttccggaggggaaggcgcgaggtttccgggaaagcagcaccgccccttggcccccaggtggctagcgctataaaggatcacgcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcaaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttccagagacggggtctcgcaacattgcccagacttcctttgtgttagttaataaagctttctcaactgccaaa

SEQ ID NO: 165 - DNA, 2741 bp, Homo sapiens
acctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgccgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcggatctctgtgtcattgggcgcctgcctggggtctccatccctgacgttcccccactcccactccctctctctccctctctgcctcctcctgcctgtctgcactattcctttgcccggcatcaaggcacaggggaccagtggggaacactactgtagttagatctatttattgagcaccttgggcactgttgaagtgccttacattaatgaactcattcagtcaccatagcaacactctgagatgcagggactctgataacacccattttaaaggtgaggaaacaagcccagagaggttaagggaggagttcctgcccaccaggaacctgctttagtgggggatagtgaagaagacaataaaagatagtagttcaggccaggcggggtggctcacgcctgtaatcctagcacttttgggaggcagagatgggaggattacttgaatccaggcatttgagaccagcctgggtaacatagtgagaccctatctctacaaaacacttttaaaaaatgtacacctgtggtcccagctactctggaggctaaggtgggaggatcacttgatcctgggaggtcaaggctgcag

SEQ ID NO: 166 - DNA, 1546 bp, Homo sapiens
gggactgagcatggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgtcctgcacagcccgacctccccggagcctcccgacaccacctccccggagtctcccgacaccacctccccggagtctcccgacaccacctcccaggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctcgtccaaacctgcgggtgaccagctgcccgcggctctgtggaccagcagtgcggtgctgggactgctgctcctggccttgcccacctatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgttcacagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatgataaaaaaaaaa

SEQ ID NO: 167 - DNA, 3220 bp, Homo sapiens
aaacttttttccctggctctgccctgggtttccccttgaagggatttccctccgcctctgcaacaagaccctttataaagcacagactttctatttcactccgcggtatctgcatcgggcctcactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaagtcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaaaacttgctgcctgaagaacagtaactgccatcaagatgagagaactggaggagttccttgatctgtatatacaataacataatttgtacatatgtaaaataaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcaggttttgtaaagatgccgggttttatatttttatagacaaataataagcaaagggagcactgggttgactttcaggtactaaatacctcaacctatggtataatggttgactgggtttctctgtatagtactggcatggtacggagatgtttcacgaagtttgttcatcagactcctgtgcaactttcccaatgtggcctaaaaatgcaacttctttttattttcttttgtaaatgtttaggtttttttgtatagtaaagtgataatttctggaattagaaaaaaaaaaaaaaaaaaa

SEQ ID NO: 168 - DNA, 8742 bp, Homo sapiens
acgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaacttgaagttcatctatttgatataagacaccttcgggggaaataattcctgtgaatattctttttcaattcagcaaacatttgaaaatctatgatgtgcaagtctaattgttgatttcagtacaagattttctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccattgtaattcttcccttcttccctccacctttccttcattgaataaacctctgttcaaagagattgcctgcaagggaaataaaaatgactaagatattaaaagtatttgaatagtaaaaaaaaaaaaaaaaaaa

SEQ ID NO: 169 - DNA, 1678 bp, Homo sapiens
gagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccacgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgagtttaaa

SEQ ID NO: 170 - DNA, 8605 bp, Homo sapiens
aattcgccaactgaaaaagtgggaaaggatgtctggaggcgaggcgtcccattacagaggaaggagctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtggatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgttattttgctttgaattgttgagtctgaatttcaccaaagccaatcatttgaacaaagcggggaatgttgggataggaaaggtaagtagggatagtggtcaagtgggaggggtggaaaggagactaaagactgggagagagggaagcactttttttaaataaagttgaacacacttgggaaaagcttacaggccaggcctgtaatcccaacactttgggaggccaaggtgggaggatagcttaaccccaggagtttgagaccagcctgagcaacatagtgagaacttgtctctacagaaaaaaaaaaaaaaaaaaatttaattaggcaagcgtggtagtgcgcacctgtcgtcccagctactcaggaggctgaggtaggaaaatcactggagcccaggagttagaggttacagtgagctatgatcacactactgcactccagcctgggcaacagagggagaccctgtctctaaataaaaaaagaaaagaaaaaaaaagcttacaacttgagattcagcatcttgctcagtatttccaagactaatagattatggtttaaaagatgcttttatactcattttctaatgcaactcctagaaactctatgatatagttgaggtaagtattgttaccacacatgggctaagatccccagaggcagactgcctgagttcaattcttggctccaccattcccaagttccctaacctctctatgcctcagtttcctcttctgtaaagtagggacactcatacttctcatttcagaacatttttgtgaagaataaattatgttatccatttgaggcccttagaatggtacccggtgtatattaagtgctagtacatgttagctatcatcattatcactttatatgagatggactggggttcatagaaacccaatgacttgattgtggctactactcaataaataatagaatttggatttaaaaaaaa

SEQ ID NO: 171 - DNA, 1616 bp, Homo sapiens
ctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgcctaaaaaaaaaaaaaaaaaaaaaaaaaaaaaaaaaa

SEQ ID NO: 172 - DNA, 4592 bp, Homo sapiens
tagaagggagcgggagggggctccgggcgccgcgcagcagacctgctccggccgcgcgcctcgccgctgtcctccgggagcggcagcagtagcccgggcggcgagggctgggggttcctcgagactctcagaggggcgcctcccatcggcgcccaccaccccaacctgttcctcgcgcgccactgcgctgcgccccaggacccgctgcccaacatggattttctcctggcgctggtgctggtatcctcgctctacctgcaggcggccgccgagttcgacgggaggtggcccaggcaaatagtgtcatcgattggcctatgtcgttatggtgggaggattgactgctgctggggctgggctcgccagtcttggggacagtgtcagcctgtgtgccaaccacgatgcaaacatggtgaatgtatcgggccaaacaagtgcaagtgtcatcctggttatgctggaaaaacctgtaatcaagatctaaatgagtgtggcctgaagccccggccctgtaagcacaggtgcatgaacacttacggcagctacaagtgctactgtctcaacggatatatgctcatgccggatggttcctgctcaagtgccctgacctgctccatggcaaactgtcagtatggctgtgatgttgttaaaggacaaatacggtgccagtgcccatcccctggcctgcagctggctcctgatgggaggacctgtgtagatgttgatgaatgtgctacaggaagagcctcctgccctagatttaggcaatgtgtcaacacttttgggagctacatctgcaagtgtcataaaggcttcgatctcatgtatattggaggcaaatatcaatgtcatgacatagacgaatgctcacttggtcagtatcagtgcagcagctttgctcgatgttataacatacgtgggtcctacaagtgcaaatgtaaagaaggataccagggtgatggactgacttgtgtgtatatcccaaaagttatgattgaaccttcaggtccaattcatgtaccaaagggaaatggtaccattttaaagggtgacacaggaaataataattggattcctgatgttggaagtacttggtggcctccgaagacaccatatattcctcctatcattaccaacaggcctacttctaagccaacaacaagacctacaccaaagccaacaccaattcctactccaccaccaccaccacccctgccaacagagctcagaacacctctaccacctacaaccccagaaaggccaaccaccggactgacaactatagcaccagctgccagtacacctccaggagggattacagttgacaacagggtacagacagaccctcagaaacccagaggagatgtgttcattccacggcaaccttcaaatgacttgtttgaaatatttgaaatagaaagaggagtcagtgcagacgatgaagcaaaggatgatccaggtgttctggtacacagttgtaattttgaccatggactttgtggatggatcagggagaaagacaatgacttgcactgggaaccaatcagggacccagcaggtggacaatatctgacagtgtcggcagccaaagccccagggggaaaagctgcacgcttggtgctacctctcggccgcctcatgcattcaggggacctgtgcctgtcattcaggcacaaggtgacggggctgcactctggcacactccaggtgtttgtgagaaaacacggtgcccacggagcagccctgtggggaagaaatggtggccatggctggaggcaaacacagatcaccttgcgaggggctgacatcaagagcgtcgtcttcaaaggtgaaaaaaggcgtggtcacactggggagattggattagatgatgtgagcttgaaaaaaggccactgctctgaagaacgctaacaactccagaactaacaatgaactcctatgttgctctatcctctttttccaattctcatcttctctcctcttctcccttttatcaggcctaggagaagagtgggtcagtgggtcagaaggaagtctatttggtgacccaggtttttctggcctgcttttgtgcaatcccaatgaacagtgataccctccttgaaatacaggggcatcgcagacacatcaaagccatctgtgggtgttgccttccatcctgtgtctctttcaggaaggcattcagcatgcgtgagccataccatcctccatcctgattacaaggtgctccttgtagcaaattatgagagtgagttacgggagcagtttttaaaagaaatctttgcagatggctatgatgttatgtgttcggtgttgtaccatgagtagtattgacttcccttgagatatgatgtacaatgtgcttgtgaaattgacttaccctcttcacttaagttagttctggcctgacctgaactctgacttttactgccattcactttataaaataagggtgtgtaacatatcaagatacatttatttttatctgttttttttttcctgttaaagacaattatgtagagtgggcacgtaatccctccttagtagtattgtgttttgtgtaaatgtgctattgatattaagtatttacatgttccaaatatttacagactctagttgcaaggtaaagggcagcttgtgatctcaaaaaaatacatggtgaaatgtcatccagttccatgaccttatattggcagcagtaggaaattggcagaagtgttgggttgtggtaacggagtgatgaatttttttttaatggccttgagtttgatctctgcaaaggataggaaacctttaggaagacaagaaactgcagttaatttagaactgtcactgtttcaagttacactttaaaaccacagcttttaccatcataacatggctctggtaatatgtaggaagctttataaaagttttggttgattcagaaaaaggatcctgttgcagagtgagaggaagcatagggggaaactccattggaacagattttcacacaacgttttaaattgatataagtttaggcagttgtagttcataacttatgttgctcatgttgtgctgtgtcaggatgggataggaagcaagtcccatgcttagaggcatgggatgtgttggaacgggatttacacacactggaggagcagggcaagttggaattctaagatccatgaacccccaactgtatttcctccctgcatattttaccaatatattaaaaaacaatgtaacttttaaaaggcatcattcctgaggtttgtcttaatttctgattaagtaatcagaatattttctgctatttttgccaggaatcacaaagatgattaaagggttggaaaaaaagatctatgatggaaaattaaaggaactgggattattgagcctggagaagagaagactgaggggcaaaccattgatggttttcaagtatatgaagggttggcacagagagggtggcgaccagctgttctccatatgcactaagaatagaacaagaggaaactggcttagactagagtataagggagcatttcttggcaggggccattgttagaatacttcataaaaaaagaagtgtgaaaatctcagtatctctctctctttctaaaaaattagataaaaatttgtctatttaagatggttaaagatgttcttacccaaggaaaagtaacaaattatagaatttcccaaaagatgttttgatcctactagtagtatgcagtgaaaatctttagaactaaataatttggacaaggcttaatttaggcatttccctcttgacctcctaatggagagggattgaaaggggaagagcccaccaaatgctgagctcactgaaatatctctcccttatggcaatcctagcagtattaaagaaaaaaggaaactatttattccaaatgagagtatgatggacagatattttagtatctcagtaatgtcctagtgtggcggtggttttcaatgtttcttcatgttaaaggtataagcctttcatttgttcaatggatgatgtttcagatttttttttttttaagagatccttcaaggaacacagttcagagagattttcatcgggtgcattctctctgcttcgtgtgtgacaagttatcttggctgctgagaaagagtgccctgccccacaccggcagacctttccttcacctcatcagtatgattcagtttctcttatcaattggactctcccaggttccacagaacagtaatattttttgaacaataggtacaatagaaggtcttctgtcatttaacctggtaaaggcagggctggagggggaaaataaatcattaagcctttgagtaacggcagaatatatggctgtagatccatttttaatggttcatttcctttatggtcatataactgcacagctgaagatgaaaggggaaaataaatgaaaattttacttttcgatgccaatgatacattgcactaaactgatggaagaagttatccaaagtactgtataacatcttgtttattatttaatgttttctaaaataaaaaatgttagtggttttccaaatggcctaataaaaacaattatttgtaaataaaaacactgttagtaata

SEQ ID NO: 173 - DNA, 3538 bp, Homo sapiens
gaatcattaacttaatttgactatctggtttgtggatgcgtttactctcatgtaagtcaacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgtgacatcccccgctgcacaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttcccctgcaaaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgctggcctgacaatgaactactgcaggaatccagatgccgataaaggcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattgtgggaagcctcaagtggagccgaagaaatgtcctggaagggttgtaggggggtgtgtggcccacccacattcctggccctggcaagtcagtcttagaacaaggtttggaatgcacttctgtggaggcaccttgatatccccagagtgggtgttgactgctgcccactgcttggagaagtccccaaggccttcatcctacaaggtcatcctgggtgcacaccaagaagtgaatctcgaaccgcatgttcaggaaatagaagtgtctaggctgttcttggagcccacacgaaaagatattgccttgctaaagctaagcagtcctgccgtcatcactgacaaagtaatcccagcttgtctgccatccccaaattatgtggtcgctgaccggaccgaatgtttcatcactggctggggagaaacccaaggtacttttggagctggccttctcaaggaagcccagctccctgtgattgagaataaagtgtgcaatcgctatgagtttctgaatggaagagtccaatccaccgaactctgtgctgggcatttggccggaggcactgacagttgccagggtgacagtggaggtcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctggaacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttgatttgagtaaattttggttttggtcttcaacattttcatgctctttgttcaccccaccaatttttaaatgggcagatggggggatttagctgcttttgataaggaacagctgcacaaaggactgagcaggctgcaaggtcacagaggggagagccaagaagttgtccacgcatttacctcatcagctaacgagggcttgacatgcatttttactgtctttattcctgacactgagatgaatgttttcaaagctgcaacatgtatggggagtcatgcaaaccgattctgttattgggaatgaaatctgtcaccgactgcttgacttgagcccaggggacacggagcagagagctgtatatgatggagtgaaccggtccatggatgtgtaacacaagaccaactgagagtctgaatgttattctggggcacacgtgagtctaggattggtgccaagagcatgtaaatgaacaacaagcaaatattgaaggtggaccacttatttcccattgctaattgcctgcccggttttgaaacagtctgcagtacacacggtcacaggagaatgacctgtgggagagatacatgtttagaaggaagagaaaggacaaaggcacacgttttaccatttaaaatattgttaccaaacaaaaatatccattcaaaatacaatttaacaatgcaacagtcatcttacagcagagaaatgcagagaaaagcaaaactgcaagtgactgtgaataaagggtgaatgtagtctcaaatcctcaaa

SEQ ID NO: 174 - DNA, 3863 bp, Homo sapiens
atttaagagccaactgtcttgtctttcccgagtccgtttgaggaagtccccgaggcgcacagagcaagcccacgcgagggcacctctggaggggagcgcctgcaggaccttgtaaagtcaaaaatgtcagaaacttccaggaccgcctttggaggcagaagagcagttccacccaataactctaatgcagcggaagatgacctgcccacagtggagcttcagggcgtggtgccccggggcgtcaacctgcaagagtttcttaatgtcacgagcgttcacctgttcaaggagagatgggacactaacaaggtggaccaccacactgacaagtatgaaaacaacaagctgattgtccgcagagggcagtctttctatgtgcagattgacttcagtcgtccatatgaccccagaagggatctcttcagggtggaatacgtcattggtcgctacccacaggagaacaagggaacctacatcccagtgcctatagtctcagagttacaaagtggaaagtggggggccaagattgtcatgagagaggacaggtctgtgcggctgtccatccagtcttcccccaaatgtattgtggggaaattccgcatgtatgttgctgtctggactccctatggcgtacttcgaaccagtcgaaacccagaaacagacacgtacattctcttcaatccttggtgtgaagatgatgctgtgtatctggacaatgagaaagaaagagaagagtatgtcctgaatgacatcggggtaattttttatggagaggtcaatgacatcaagaccagaagctggagctatggtcagtttgaagatggcatcctggacacttgcctgtatgtgatggacagagcacaaatggacctctctggaagagggaatcccatcaaagtcagccgtgtggggtctgcaatggtgaatgccaaagatgacgaaggtgtcctcgttggatcctgggacaatatctatgcctatggcgtccccccatcggcctggactggaagcgttgacattctattggaataccggagctctgagaatccagtccggtatggccaatgctgggtttttgctggtgtctttaacacatttttacgatgccttggaataccagcaagaattgttaccaattatttctctgcccatgataatgatgccaatttgcaaatggacatcttcctggaagaagatgggaacgtgaattccaaactcaccaaggattcagtgtggaactaccactgctggaatgaagcatggatgacaaggcctgaccttcctgttggatttggaggctggcaagctgtggacagcaccccccaggaaaatagcgatggcatgtatcggtgtggccccgcctcggttcaagccatcaagcacggccatgtctgcttccaatttgatgcaccttttgtttttgcagaggtcaacagcgacctcatttacattacagctaagaaagatggcactcatgtggtggaaaatgtggatgccacccacattgggaaattaattgtgaccaaacaaattggaggagatggcatgatggatattactgatacttacaaattccaagaaggtcaagaagaagagagattggccctagaaactgccctgatgtacggagctaaaaagcccctcaacacagaaggtgtcatgaaatcaaggtccaacgttgacatggactttgaagtggaaaatgctgtgctgggaaaagacttcaagctctccatcaccttccggaacaacagccacaaccgttacaccatcacagcttatctctcagccaacatcaccttctacaccggggtcccgaaggcagaattcaagaaggagacgttcgacgtgacgctggagcccttgtccttcaagaaagaggcggtgctgatccaagccggcgagtacatgggtcagctgctggaacaagcgtccctgcacttctttgtcacagctcgcatcaatgagaccagggatgttctggccaagcaaaagtccaccgtgctaaccatccctgagatcatcatcaaggtccgtggcactcaggtagttggttctgacatgactgtgacagttgagtttaccaatcctttaaaagaaaccctgcgaaatgtctgggtacacctggatggtcctggagtaacaagaccaatgaagaagatgttccgtgaaatccggcccaactccaccgtgcagtgggaagaagtgtgccggccctgggtctctgggcatcggaagctgatagccagcatgagcagtgactccctgagacatgtgtatggcgagctggacgtgcagattcaaagacgaccttccatgtgaatgcacaggaagctgagatgaaccctggcatttggcctcttgtagtcttggctaaggaaattctaacgcaaaaatagctcttgctttgacttaggtgtgaagacccagacaggactgcagagggctccagagtggagatcccacatatttcaaaaacatgcttttccaaacccaggctattcggcaaggaagttagtttttaatctctccaccttccaaagagtgctaagcattagctttaattaagctctcatagctcataagagtaacagtcatcatttatcatcacaaatggctacatctccaaatatcagtgggctctcttaccagggagatttgctcaatacctggcctcatttaaaacaagacttcagattccccactcagccttttgggaataatagcacatgatttgggctctagaattccagtcccctttctcggggtcaggttctaccctccatgtgagaatatttttcccaggactagagcacaacataatttttatttttggcaaagccagaaaaagatctttcattttgcacctgcagccaagcaaatgcctgccaaattttagatttaccttgttagaagaggtggccccatattaacaaattgcatttgtgggaaacttaaccacctacaaggagataagaaagcaggtgcaacactcaagtctattgaataatgtagttttgtgatgcattttatagaatgtgtcacactgtggcctgatcagcaggagccaatatcccttactttaaccctttctgggatgcaatactaggaagtaaagtgaagaatttatctctttagttagtgattatatttcacccatctctcaggaatcatctcctttgcagaatgatgcaggttcaggtcccctttcagagatataataagcccaacaagttgaagaagctggcggatctagtgaccagatatatagaaggactgcagccactgattctctcttgtccttcacatcacccatgttgagacctcagcttggcactcaggtgctgaagggtaatatggactcagccttgcaaatagccagtgctagttctgacccaaccacagaggatgctgacatcatttgtattatgttccaaggctactacagagaaggctgcctgctatgtatttgcaaggctgatttatggtcagaatttccctctgatatgtctagggtgtgatttaggtcagtagactgtgattcttagcaaaaaatgaacagtgataagtatactgggggcaaaatcagaatggaatgctctggtctatataaccacatttctaagcctttgagactgttcctgagccttcagcactaacctatgagggtgagctggtcccctctatatatacatcatacttaactttactaagtaatctcacagcatttgccaagtctcccaatatccaattttaaaatgaaatgcattttgctagacagttaaactggcttaacttagtatattattattaattacaatgtaatagaagcttaaaataaagttaaactgattatatttgca

SEQ ID NO: 175 - DNA, 8838 bp, Homo sapiens
gtggcagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaagatgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcaccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgccccccgacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgactgtggagtaccccttcagcgaggcacagtccaaaggggacatcctgcagcgggtgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgcgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtctacaaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaactgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgcaaaaggc

SEQ ID NO: 176 - DNA, 2627 bp, Homo sapiens
gcctacctcttccaggctgcgtggccggggcgtcatctcgcgcttccaactgccctgtaaccaccaactgccattattccggctgggacccaggacttcaagccatgtggcgcgtcttgtttctgctcagcgggctcggcgggctgcggatggacagtaattttgatagtttacctgtgcaaattacagttccggagaaaatacggtcaataataaaggaaggaattgaatcgcaggcatcctacaaaattgtaattgaagggaaaccatatactgtgaatttaatgcaaaaaaactttttaccccataattttagagtttacagttatagtggcacaggaattatgaaaccacttgaccaagattttcagaatttctgccactaccaagggtatattgaaggttatccaaaatctgtggtgatggttagcacatgtactggactcaggggcgtactacagtttgaaaatgttagttatggaatagaacccctggagtcttcagttggctttgaacatgtaatttaccaagtaaaacataagaaagcagatgtttccttatataatgagaaggatattgaatcaagagatctgtcctttaaattacaaagcgtagagtataatcatatggggtctgatacaactgttgtcgctcaaaaagttttccagttgattggattgacgaatgctatttttgtttcatttaatattacaattattctgtcttcattggagctttggatagatgaaaataaaattgcaaccactggagaagctaatgagttattacacacatttttaagatggaaaacatcttatcttgttttacgtcctcatgatgtggcatttttacttgtttacagagaaaagtcaaattatgttggtgcaacctttcaagggaagatgtgtgatgcaaactatgcaggaggtgttgttctgcaccccagaaccataagtctggaatcacttgcagttattttagctcaattattgagccttagtatggggatcacttatgatgacattaacaaatgccagtgctcaggagctgtctgcattatgaatccagaagcaattcatttcagtggtgtgaagatctttagtaactgcagcttcgaagactttgcacattttatttcaaagcagaagtcccagtgtcttcacaatcagcctcgcttagatccttttttcaaacagcaagcagtgtgtggtaatgcaaagctggaagcaggagaggagtgtgactgtgggactgaacaggattgtgcccttattggagaaacatgctgtgatattgccacatgtagatttaaagccggttcaaactgtgctgaaggaccatgctgcgaaaactgtctatttatgtcaaaagaaagaatgtgtaggccttcctttgaagaatgcgacctccctgaatattgcaatggatcatctgcatcatgcccagaaaaccactatgttcagactgggcatccgtgtggactgaatcaatggatctgtatagatggagtttgtatgagtggggataaacaatgtacagacacatttggcaaagaagtagagtttggcccttcagaatgttattctcaccttaattcaaagactgatgtatctggaaactgtggtataagtgattcaggatacacacagtgtgaagctgacaatctgcagtgcggaaaattaatatgtaaatatgtaggtaaatttttattacaaattccaagagccactattatttatgccaacataagtggacatctctgcattgctgtggaatttgccagtgatcatgcagacagccaaaagatgtggataaaagatggaacttcttgtggttcaaataaggtttgcaggaatcaaagatgtgtgagttcttcatacttgggttatgattgtactactgacaaatgcaatgatagaggtgtatgcaataacaaaaagcactgtcactgtagtgcttcatatttacctccagattgctcagttcaatcagatctatggcctggtgggagtattgacagtggcaattttccacctgtagctataccagccagactccctgaaaggcgctacattgagaacatttaccattccaaaccaatgagatggccatttttcttattcattcctttctttattattttctgtgtactgattgctataatggtgaaagttaatttccaaaggaaaaaatggagaactgaggactattcaagcgatgagcaacctgaaagtgagagtgaacctaaagggtagtctggacaacagagatgccatgatatcacttcttctagagtaattatctgtgatggatggacacaaaaaaatggaaagaaaagaatgtacattacctggtttcctgggattcaaacctgcatattgtgattttaatttgaccagaaaatatgatatatatgtataatttcacagataatttacttatttaaaaatgcatgataatgagttttacattacaaatttctgtttttttaaagttatcttacgctatttctgttggttagtagacactaattctgtcagtaggggcatggtataaggaaatatcataatgtaatgaggtggtactatgattaaaagccactgttacatttcaaaaaaaaaaaaaaa

SEQ ID NO: 177 - DNA, 3249 bp, Homo sapiens; identical to SEQ ID NO: 164

SEQ ID NO: 178 - DNA, 5927 bp, Homo sapiens
tcgtcggagcagacgggagtttctcctcggggtcggagcaggaggcacgcggagtgtgaggccacgcatgagcggacgctaaccccctccccagccacaaagagtctacatgtctagggtctagacatgttcagctttgtggacctccggctcctgctcctcttagcggccaccgccctcctgacgcacggccaagaggaaggccaagtcgagggccaagacgaagacatcccaccaatcacctgcgtacagaacggcctcaggtaccatgaccgagacgtgtggaaacccgagccctgccggatctgcgtctgcgacaacggcaaggtgttgtgcgatgacgtgatctgtgacgagaccaagaactgccccggcgccgaagtccccgagggcgagtgctgtcccgtctgccccgacggctcagagtcacccaccgaccaagaaaccaccggcgtcgagggacccaagggagacactggcccccgaggcccaaggggacccgcaggcccccctggccgagatggcatccctggacagcctggacttcccggaccccccggaccccccggacctcccggaccccctggcctcggaggaaactttgctccccagctgtcttatggctatgatgagaaatcaaccggaggaatttccgtgcctggccccatgggtccctctggtcctcgtggtctccctggcccccctggtgcacctggtccccaaggcttccaaggtccccctggtgagcctggcgagcctggagcttcaggtcccatgggtccccgaggtcccccaggtccccctggaaagaatggagatgatggggaagctggaaaacctggtcgtcctggtgagcgtgggcctcctgggcctcagggtgctcgaggattgcccggaacagctggcctccctggaatgaagggacacagaggtttcagtggtttggatggtgccaagggagatgctggtcctgctggtcctaagggtgagcctggcagccctggtgaaaatggagctcctggtcagatgggcccccgtggcctgcctggtgagagaggtcgccctggagcccctggccctgctggtgctcgtggaaatgatggtgctactggtgctgccgggccccctggtcccaccggccccgctggtcctcctggcttccctggtgctgttggtgctaagggtgaagctggtccccaagggccccgaggctctgaaggtccccagggtgtgcgtggtgagcctggcccccctggccctgctggtgctgctggccctgctggaaaccctggtgctgatggacagcctggtgctaaaggtgccaatggtgctcctggtattgctggtgctcctggcttccctggtgcccgaggcccctctggaccccagggccccggcggccctcctggtcccaagggtaacagcggtgaacctggtgctcctggcagcaaaggagacactggtgctaagggagagcctggccctgttggtgttcaaggaccccctggccctgctggagaggaaggaaagcgaggagctcgaggtgaacccggacccactggcctgcccggaccccctggcgagcgtggtggacctggtagccgtggtttccctggcgcagatggtgttgctggtcccaagggtcccgctggtgaacgtggttctcctggccctgctggccccaaaggatctcctggtgaagctggtcgtcccggtgaagctggtctgcctggtgccaagggtctgactggaagccctggcagccctggtcctgatggcaaaactggcccccctggtcccgccggtcaagatggtcgccccggacccccaggcccacctggtgcccgtggtcaggctggtgtgatgggattccctggacctaaaggtgctgctggagagcccggcaaggctggagagcgaggtgttcccggaccccctggcgctgtcggtcctgctggcaaagatggagaggctggagctcagggaccccctggccctgctggtcccgctggcgagagaggtgaacaaggccctgctggctcccccggattccagggtctccctggtcctgctggtcctccaggtgaagcaggcaaacctggtgaacagggtgttcctggagaccttggcgcccctggcccctctggagcaagaggcgagagaggtttccctggcgagcgtggtgtgcaaggtccccctggtcctgctggtccccgaggggccaacggtgctcccggcaacgatggtgctaagggtgatgctggtgcccctggagctcccggtagccagggcgcccctggccttcagggaatgcctggtgaacgtggtgcagctggtcttccagggcctaagggtgacagaggtgatgctggtcccaaaggtgctgatggctctcctggcaaagatggcgtccgtggtctgactggccccattggtcctcctggccctgctggtgcccctggtgacaagggtgaaagtggtcccagcggccctgctggtcccactggagctcgtggtgcccccggagaccgtggtgagcctggtccccccggccctgctggctttgctggcccccctggtgctgacggccaacctggtgctaaaggcgaacctggtgatgctggtgctaaaggcgatgctggtccccctggccctgccggacccgctggaccccctggccccattggtaatgttggtgctcctggagccaaaggtgctcgcggcagcgctggtccccctggtgctactggtttccctggtgctgctggccgagtcggtcctcctggcccctctggaaatgctggaccccctggccctcctggtcctgctggcaaagaaggcggcaaaggtccccgtggtgagactggccctgctggacgtcctggtgaagttggtccccctggtccccctggccctgctggcgagaaaggatcccctggtgctgatggtcctgctggtgctcctggtactcccgggcctcaaggtattgctggacagcgtggtgtggtcggcctgcctggtcagagaggagagagaggcttccctggtcttcctggcccctctggtgaacctggcaaacaaggtccctctggagcaagtggtgaacgtggtccccctggtcccatgggcccccctggattggctggaccccctggtgaatctggacgtgagggggctcctggtgccgaaggttcccctggacgagacggttctcctggcgccaagggtgaccgtggtgagaccggccccgctggaccccctggtgctcctggtgctcctggtgcccctggccccgttggccctgctggcaagagtggtgatcgtggtgagactggtcctgctggtcccgccggtcctgtcggccctgttggcgcccgtggccccgccggaccccaaggcccccgtggtgacaagggtgagacaggcgaacagggcgacagaggcataaagggtcaccgtggcttctctggcctccagggtccccctggccctcctggctctcctggtgaacaaggtccctctggagcctctggtcctgctggtccccgaggtccccctggctctgctggtgctcctggcaaagatggactcaacggtctccctggccccattgggccccctggtcctcgcggtcgcactggtgatgctggtcctgttggtccccccggccctcctggacctcctggtccccctggtcctcccagcgctggtttcgacttcagcttcctgccccagccacctcaagagaaggctcacgatggtggccgctactaccgggctgatgatgccaatgtggttcgtgaccgtgacctcgaggtggacaccaccctcaagagcctgagccagcagatcgagaacatccggagcccagagggcagccgcaagaaccccgcccgcacctgccgtgacctcaagatgtgccactctgactggaagagtggagagtactggattgaccccaaccaaggctgcaacctggatgccatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgagtatggcggccagggctccgaccctgccgatgtggccatccagctgaccttcctgcgcctgatgtccaccgaggcctcccagaacatcacctaccactgcaagaacagcgtggcctacatggaccagcagactggcaacctcaagaaggccctgctcctccagggctccaacgagatcgagatccgcgccgagggcaacagccgcttcacctacagcgtcactgtcgatggctgcacgagtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctccctcccacccaaccaactttccccccaacccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttaccaaaaaaaaaaaaaaaaaaagaataaataaataactttttaaaaaaggaagcttggtccacttgcttgaagacccatgcgggggtaagtccctttctgcccgttgggcttatgaaaccccaatgctgccctttctgctcctttctccacaccccccttggggcctcccctccactccttcccaaatctgtctccccagaagacacaggaaacaatgtattgtctgcccagcaatcaaaggcaatgctcaaacacccaagtggcccccaccctcagcccgctcctgcccgcccagcacccccaggccctgggggacctggggttctcagactgccaaagaagccttgccatctggcgctcccatggctcttgcaacatctccccttcgtttttgagggggtcatgccgggggagccaccagcccctcactgggttcggaggagagtcaggaagggccacgacaaagcagaaacatcggatttggggaacgcgtgtcaatcccttgtgccgcagggctgggcgggagagactgttctgttccttgtgtaactgtgttgctgaaagactacctcgttcttgtcttgatgtgtcaccggggcaactgcctgggggcggggatgggggcagggtggaagcggctccccattttataccaaaggtgctacatctatgtgatgggtggggtggggagggaatcactggtgctatagaaattgagatgcccccccaggccagcaaatgttcctttttgttcaaagtctatttttattccttgatatttttctttttttttttttttttttgtggatggggacttgtgaatttttctaaaggtgctatttaacatgggaggagagcgtgtgcggctccagcccagcccgctgctcactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatgacccaaacataa

SEQ ID NO: 179 - DNA, 4662 bp, Homo sapiens
tcagtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtctcctcttggctctgccaggagccggagccctgccaccctggctttgacgccgagagctacacgttcacggtgccccggcgccacctggagagaggccgcgtcctgggcagagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagagagtttccctacgtataccctggtggttcaagctgctgaccttcaaggtgaggggttaagcacaacagcaacagctgtgatcacagtcactgacaccaacgataatcctccgatcttcaatcccaccacgggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacatatcggatttggagagacactgccaactggctggagattaatccggacactggtgccatttccactcgggctgagctggacagggaggattttgagcacgtgaagaacagcacgtacacagccctaatcatagctacagacaatggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaacccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaattctgattctgctgctcttgctgtttcttcggaggagagcggtggtcaaagagcccttactgcccccagaggatgacacccgggacaacgtttattactatgatgaagaaggaggcggagaagaggaccaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaaaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcctcccatcttggcctcccagagtattgggattacagacatgagccactgcacctgcccagctccccaactccctgccattttttaagagacagtttcgctccatcgcccaggcctgggatgcagtgatgtgatcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccattaaaaaaaaaaaaaaaaaaaaaaaaaaa

SEQ ID NO: 180 - DNA, 9657 bp, Homo sapiens
cggggccagggcagcgcggactcgcgtcccgtggagcgttccaggcgggcgcgcggctttctccccagacccaccgagtggcggcggaggcgagatgcgcgggggcgtgctcctggtcttgctgctgtgtgtcgccgcgcagtgccggcagagaggcctgtttcctgccattctcaatcttgccagcaatgctcacatcagcaccaatgccacctgtggcgagaaggggccggagatgttctgcaaacttgtggagcatgtgccaggtcggcccgtccgaaacccacagtgccggatctgtgatggcaacagcgcaaaccccagagaacgccatccaatatcacatgccatagatggcaccaataactggtggcaaagtcccagcattcagaatgggagagaatatcactgggtcacaatcactctggacttaagacaggtctttcaagttgcatatgtcatcattaaagctgccaatgcccctcgacctggaaactggattttggagcgttctctggatggcaccacgttcagcccctggcagtattatgcagtcagcgactcagagtgtttgtctcgttacaatataactccaagacgagggccacccacctacagggctgatgatgaagtgatctgcacctcctattattccagattggtgccacttgagcatggagagattcatacatcactcatcaatggcagaccaagcgctgacgatctttcacccaagttgttggaattcacttctgcacgatatattcgccttcgcttgcaacgcattagaacgctcaatgcagatctcatgacccttagccaccgggaacctaaagaactggatcctattgttaccagacgctattattattcaataaaggacatttctgttggaggcatgtgtatctgctatggccatgctagtagctgcccatgggatgaaactacaaagaaactgcagtgtcaatgtgagcataatacttgcggggagagctgtaacaggtgctgtcctgggtaccatcagcagccctggaggccgggaaccgtgtcctccggcaatacatgtgaagcatgtaattgtcacaataaagccaaagactgttactatgatgaaagtgttgcaaagcagaagaaaagtttgaatactgctggacagttcagaggaggaggggtttgcataaattgcttgcagaacaccatgggaatcaactgtgaaacctgtattgatggatattatagaccacacaaagtgtctccttatgaggatgagccttgccgcccctgtaattgtgaccctgtggggtccctcagttctgtctgtattaaggatgacctccattctgacttacacaatgggaagcagccaggtcagtgcccatgtaaggaaggttatacaggagaaaaatgtgatcgctgccaacttggctataaggattacccgacctgtgtctcctgtgggtgcaacccagtgggcagtgccagtgatgagccctgcacagggccctgtgtttgtaaggaaaacgttgaggggaaggcctgtgatcgctgcaagccaggattctataacttgaaggaaaaaaacccccggggctgctccgagtgcttctgctttggcgtttctgatgtctgcagcagcctctcttggcctgttggtcaggtaaacagtatgtccgggtggctggtcaccgacttgatcagtcccaggaagatcccgtctcagcaagatgcactaggcgggcgccatcaggtcagcatcaacaacaccgcggtcatgcagagactggctcccaagtactactgggcagcccccgaggcctaccttggaaataagctgactgcgtttggcggattcctgaaatacacggtgtcctacgatattccggtagagacggtagacagtaacctcatgtcgcatgctgacgtcatcattaagggaaacggactcactttaagcacacaggctgagggtctgtcattgcagccttatgaagagtacctaaacgtggttagacttgtgcctgaaaacttccaagattttcacagcaaaaggcagattgatcgtgaccagctgatgactgtccttgccaatgtgacacatcttttgatcagagccaactacaattctgcaaaaatggctctttacaggttggagtccgtctctctggacatagccagctctaatgccatcgacctggtggtggccgctgatgtggagcactgtgaatgtccgcaaggctacacagggacctcctgtgagtcgtgcctctctggctattaccgcgtggatggaatactctttggaggaatttgtcaaccctgtgaatgccacggccatgcagctgagtgtaatgttcacggcgtttgcattgcgtgtgcgcacaacaccaccggcgtccactgtgagcagtgcttgcccggcttctacggggagccttcccgagggacacctggggactgccagccctgcgcctgccctctcaccatagcctccaacaatttcagccccacctgccacctcaatgatggagatgaagtggtctgtgactggtgtgccccgggctactcaggagcttggtgtgagagatgtgcagatggttactatggaaacccaacagtgcctggcgaatcttgtgttccctgtgactgcagcggcaacgtggacccctcggaggctggtcactgtgactcagtcaccggggagtgcctgaagtgcctggggaacacagatggcgcccactgtgaaaggtgtgctgacgggttctatggggacgctgtgacagccaagaactgccgcgcctgtgaatgccatgtgaaaggctcccattctgccgtgtgccatcttgagaccgggctctgtgactgcaaaccaaacgtgactggacagcagtgtgaccagtgcttgcatggctattatgggctggactcaggccatggctgccggccctgcaactgcagcgtggcaggctccgtgtcagatggctgcacggatgaaggccagtgtcactgtgtcccaggtgtggcagggaaaaggtgtgacaggtgtgcccatggcttctacgcctaccaggatggtagctgtacaccctgtgactgcccacacactcagaatacctgcgacccagaaactggagagtgtgtctgcccccctcacacacagggtgtgaagtgtgaagaatgtgaggatgggcactggggctacgatgcggaggtggggtgccaggcctgcaattgcagtctcgtggggtcgactcatcatcggtgcgatgtggtcaccggccattgccagtgcaagtcaaaatttggtggccgggcctgcgatcagtgttccttgggttacagagactttcccgactgtgttccctgtgactgtgacctgagggggacgtcgggggacgcctgcaacctggagcagggtctctgcggctgtgtggaggaaaccggggcctgcccttgcaaggaaaatgtctttggtcctcagtgcaacgaatgtcgagagggcaccttcgctctccgcgcagacaaccccctgggctgcagcccgtgcttctgctccgggctgtcccacctctgctcagagctggaggactacgtgaggaccccagtaacgctgggctccgatcagcctcttctgcgtgtggtttctcagagtaacttgaggggcacgaccgagggggtttactaccaggcccccgacttcctgctggatgccgccaccgtccggcagcacatccgtgcagagccgttttactggcggctgccgcagcagttccaaggagaccagctcatggcctatggtggcaaactgaagtacagcgtggccttctattctttggatggcgtcggcacctccaattttgagcctcaagttctcatcaaaggtggtcggatcagaaagcaagtcatttacatggatgcaccagccccagagaatggagtgagacaggaacaagaagtagcaatgagagagaatttttggaaatattttaactctgtttctgaaaaacctgtcacgcgagaggattttatgtctgtcctcagcgatattgagtacatcctcatcaaggcatcgtatggtcaaggattacagcagagcagaatctcagacatttcaatggaggttggcagaaaggctgaaaagctgcacccagaagaagaggttgcatctcttttagagaattgtgtctgtcctcctggcactgtgggattctcatgtcaggactgcgcccctgggtaccacagagggaagctcccagcagggagtgacaggggaccacgccctctggttgctccttgtgttccctgcagttgcaacaaccacagtgacacctgtgaccccaacaccgggaagtgtctgaactgtggcgataacacagcaggtgaccattgtgatgtgtgtacttctggctactacgggaaggtgactggctcagcaagtgactgtgctctgtgtgcctgtcctcacagccctcctgccagttttagtcccacttgtgtcttggaaggggaccacgatttccgttgtgacgcctgtctcctgggctatgaaggaaaacactgtgaaaggtgctcctcaagctattatgggaaccctcaaacaccaggtggcagttgccagaagtgtgactgcaacccgcacggctctgtccacggtgactgtgaccgcacatctgggcagtgcgtttgcaggctgggggcctcggggctccggtgcgatgagtgtgaaccgaggcacattctgatggaaacagattgtgtttcctgtgatgatgagtgtgtaggtgtgctgctgaatgacttggatgagattggtgatgccgttctttctctgaacctcactggcattatccctgtcccatatggaattttgtcaaacctggaaaatacaactaaatatctccaggaatctttattaaaagaaaatatgcaaaaggacctgggaaaaattaagcttgaaggtgttgcagaagaaacggacaacctgcaaaagaagctcactaggatgttagcgagtacccaaaaggtgaatagggcaactgagagaatcttcaaggagagtcaagacctggccatagccattgagaggctgcagatgagcatcacagaaattatggaaaagacaactttaaatcagactttggatgaagatttcctactacccaattctactcttcagaacatgcaacagaatggtacatctttgctagaaatcatgcagataagagacttcacacagttgcaccaaaatgccacccttgaactcaaggctgctgaagatttattgtcacaaattcaggaaaattaccagaagccgctggaagaattggaggtattgaaagaagcagcaagccacgtcctttcaaagcacaacaatgaactaaaggcggctgaggcgctcgtgagggaagctgaggcaaagatgcaggaaagcaaccacctgctgctcatggtcaatgctaatctgagagaattcagtgataaaaagctgcatgttcaagaagaacaaaatctgacctcagagctcattgtccaaggaagaggattgatagatgctgctgctgcacaaacagatgctgtacaagatgctctagagcacttagaggatcaccaggataagctacttttatggtctgccaaaatcaggcaccacatagatgacctggtcatgcacatgtcccaaaggaacgcagtcgacctggtctacagagctgaggaccatgccgctgagttccagagactagcagatgttctgtacagtggccttgaaaacatcagaaatgtgtccctgaatgccaccagtgcagcctatgtccattacaacatccagagcctgattgaagaatcggaggaactggccagagatgctcacaggactgtgactgagacgagcctgctctcagaatcccttgtttctaacgggaaagcggccgtgcagcgcagctccagatttctaaaagaaggcaacaacctcagcaggaagcttccaggtattgcattggaactgagtgaattgagaaataagacaaacagatttcaagagaatgctgttgaaattaccaggcaaaccaatgaatcactcttgatacttagagcaattcctaaaggtataagagacaagggagccaaaaccaaagagctggccacgtctgcaagccagagcgcggtgagcacgctgagggacgtggcggggctgagccaggagctgctgaacacatctgccagcctgtccagggtcaacaccacattacgagagacacaccagcttctgcaggactccaccatggccactctgttggctggaagaaaagtcaaagacgtggaaattcaagccaaccttttgtttgatcggttgaagcctttgaagatgttagaggagaatctgagcagaaacctatcagaaattaaactgttgatcagccaggcccgcaaacaagcagcttctattaaagtcgccgtgtctgcagacagagattgcatccgggcctaccagcctcagatttcctctaccaactacaataccttaacactaaatgttaagacacaggaacccgataatcttctcttctacctcggtagcagcaccgcttctgatttccttgcagtggagatgcggcgagggagagtggccttcctgtgggacctgggctccgggtccacacgcttggagtttccagactttcccattgatgacaacagatggcacagtatccatgtagccagatttggaaacattggttcactgagtgtaaaggaaatgagctcaaatcaaaagtcaccaacaaaaacaagtaaatcccctgggacagctaatgttctggatgtaaacaattcaacactcatgtttgttggaggtcttggaggacaaatcaagaaatctcctgctgtgaaggttactcattttaaaggctgcttgggggaggccttcctgaatggaaaatccataggcctatggaactatattgaaagggaaggcaagtgccgtgggtgcttcggaagctcccagaatgaagacccttccttccattttgacgggagtgggtactctgtcgtggagaagtcacttccggctaccgtgacccagataatcatgctttttaataccttttcacctaatggacttcttctctacctgggttcatacggcacaaaagactttttatccatcgagctgtttcgtggcagagtgaaggttatgactgacctgggttcaggacccattacccttttgacagacagacgttataacaatggaacctggtacaaaattgccttccagcgaaaccggaagcaaggagtgctagcagttatcgatgcctataacaccagtaataaagaaaccaagcagggcgagactccgggagcatcttctgacctcaaccgcctagacaaggacccgatttatgtgggtggattaccaaggtcaagagttgtaaggagaggtgtcaccaccaaaagctttgtgggctgcatcaagaacctggaaatatccagatcaacctttgacttactcagaaattcctatggagtgagaaaaggctgtttactggagcccatccggagtgttagcttcctgaaaggcggctacattgaattgccacccaaatctttgtcaccagaatcagaatggctggtaacatttgccaccacgaacagcagtggcatcatcctggctgccctcggcggggatgtggagaagcggggtgatcgtgaggaagcacacgtgcccttcttttccgtcatgctgatcggaggcaacattgaggtacatgtcaatcctggggatgggacaggcctgagaaaagctctcctgcacgctcccacgggtacctgcagtgatggacaagcgcattccatctccttggtcaggaatcggagaattatcactgtccaattggatgagaacaatcctgtggaaatgaagttgggcacattagtagaaagcaggacgataaatgtgtccaatctgtacgtcgggggaattccagagggagaggggacgtcactgctcacaatgagaagatcgttccatggctgtatcaaaaacctgatcttcaatttggaacttttggatttcaacagtgcagttggccatgagcaagtcgacctggacacctgctggctgtcagaaaggcctaagctggctcccgatgcagaggacagcaagctcttgccagagccccgggcttttccagaacagtgtgtggtggatgcagctctggagtacgttcccggcgctcaccagtttggtctcacacaaaacagccatttcatcttgccttttaatcagtcggctgtcagaaagaagctctcggttgagctaagcatccgcacgttcgcctccagcggcctgatttactacatggctcatcagaaccaagcagactacgctgtgctccagctgcacgggggccgcctccacttcatgtttgaccttggcaaaggcagaacaaaggtctctcaccctgcactgctcagtgatggcaagtggcacacggtcaagacagactatgttaaaagaaaaggcttcataactgtcgacggccgagagtctcccatggtgactgtggtgggagatggaaccatgctggatgtggagggtttgttctacctaggaggcctgccctcccagtaccaggccaggaaaattggaaatatcacccacagcatccctgcctgcattggggatgtgacggttaacagcaaacagctggacaaggacagcccggtgtctgccttcacggtgaacaggtgctacgcagtggcccaggaaggaacatactttgacggaagcggatatgcagctcttgtcaaagagggctacaaagtccagtcagatgtgaacatcacactggagtttcgaacctcctcgcagaatggcgtcctcctggggatcagcactgccaaagtggatgccattggactagagcttgtggacggcaaggtcttgttccatgtcaacaatggtgctggcaggataacagctgcatatgagcccaaaaccgccactgtgctctgtgatggaaaatggcacactcttcaagctaacaaaagcaaacaccgtatcactctgattgttgacgggaacgcagttggcgctgaaagtccacacacccagtctacctcagtggacaccaacaatcccatttatgttggtggctatcctgctggtgtgaagcaaaaatgcctgcgcagccagacctcgttccgcgggtgtttgaggaagctagctctgattaagagcccgcaggtgcagtcctttgacttcagcagagcgttcgaactgcacggagttttccttcattcctgtcctgggaccgagtcctgaacttcaagcagaatcctcagttggaatcattgctaatattttgaggagaagtgtatgtgtgaattaagaatctcttcagttcatatttcatttccaactcaggttaagtgtttctggggagagatgttgtgtttacgttacactaaaaccacatgtgcaacaaatacctccattaaatggtctaaaatgtaaattgaattccctggctctctttttaaacgtatttttaaaaaaatctttatacacattgaatgttctgttgattacttgatagtattttatgtttttcattttgagctttttaaaaaagtatcaatacagatgataacagatca

SEQ ID NO: 181 - DNA, 2637 bp, Homo sapiens
cgcccctcgccttctgcccgggcgctcgcagccgagcgcggccggggaagggctctcctcccagcgccgagcactgggccctggcagacgccccaagattgttgtgaggagtctagccagttggtgagcgctgtaatctgaaccagctgtgtccagactgaggccccatttgcattgtttaacatacttagaaaatgaagtgttcatttttaacattcctcctccaattggtttaatgctgaattactgaagagggctaagcaaaaccaggtgcttgcgctgagggctctgcagtggctgggaggaccccggcgctctccccgtgtcctctccacgactcgctcggcccctctggaataaaacacccgcgagccccgagggcccagaggaggccgacgtgcccgagctcctccgggggtcccgcccgcgagctttcttctcgccttcgcatctcctcctcgcgcgtcttggacatgccaggaataaaaaggatactcactgttaccattctggctctctgtcttccaagccctgggaatgcacaggcacagtgcacgaatggctttgacctggatcgccagtcaggacagtgtttagatattgatgaatgccgaaccatccccgaggcctgccgaggagacatgatgtgtgttaaccaaaatggcgggtatttatgcattccccggacaaaccctgtgtatcgagggccctactcgaacccctactcgaccccctactcaggtccgtacccagcagctgccccaccactctcagctccaaactatcccacgatctccaggcctcttatatgccgctttggataccagatggatgaaagcaaccaatgtgtggatgtggacgagtgtgcaacagattcccaccagtgcaaccccacccagatctgcatcaatactgaaggcgggtacacctgctcctgcaccgacggatattggcttctggaaggccagtgcttagacattgatgaatgtcgctatggttactgccagcagctctgtgcgaatgttcctggatcctattcttgtacatgcaaccctggttttaccctcaatgaggatggaaggtcttgccaagatgtgaacgagtgtgccaccgagaacccctgcgtgcaaacctgcgtcaacacctacggctctttcatctgccgctgtgacccaggatatgaacttgaggaagatggcgttcattgcagtgatatggacgagtgcagcttctctgagttcctctgccaacatgagtgtgtgaaccagcccggcacatacttctgctcctgccctccaggctacatcctgctggatgacaaccgaagctgccaagacatcaacgaatgtgagcacaggaaccacacgtgcaacctgcagcagacgtgctacaatttacaagggggcttcaaatgcattgaccccatccgctgtgaggagccttatctgaggatcagtgataaccgctgtatgtgtcctgctgagaaccctggctgcagagaccagccctttaccatcttgtaccgggacatggacgtggtgtcaggacgctccgttcccgctgacatcttccaaatgcaagccacgacccgctaccctggggcctattacattttccagatcaaatctgggaatgagggcagagaattttacatgcggcaaacgggccccatcagtgccaccctggtgatgacacgccccatcaaagggccccgggaaatccagctggacttggaaatgatcactgtcaacactgtcatcaacttcagaggcagctccgtgatccgactgcggatatatgtgtcgcagtacccattctgagcctcgggctggagcctccgacgctgcctctcattggcaccaagggacaggagaagagaggaaataacagagagaatgagagcgacacagacgttaggcatttcctgctgaacgtttccccgaagagtcagccccgacttcctgactctcacctgtactattgcagacctgtcaccctgcaggacttgccacccccagttcctatgacacagttatcaaaaagtattatcattgctcccctgatagaagattgttggtgaattttcaaggccttcagtttatttccactattttcaaagaaaatagattaggtttgcgggggtctgagtctatgttcaaagactgtgaacagcttgctgtcacttcttcacctcttccactccttctctcactgtgttactgctttgcaaagacccgggagctggcggggaaccctgggagtagctagtttgctttttgcgtacacagagaaggctatgtaaacaaaccacagcaggatcgaagggtttttagagaatgtgtttcaaaaccatgcctggtattttcaaccataaaagaagtttcagttgtccttaaatttgtataacggtttaattctgtcttgttcattttgagtatttttaaaaaatatgtcgtagaattccttcgaaaggccttcagacacatgctatgttctgtcttcccaaacccagtctcctctccattttagcccagtgttttctttgaggaccccttaatcttgctttctttagaatttttacccaattggattggaatgcagaggtctccaaactgattaaatatttgaagagaaaaa

SEQ ID NO: 182 - protein, 77 aa, Homo sapiens
VPLSRTVRCTCISISNQPVNPRSLEKLEIIPASQFCPRVEIIATMKKKGEKRCLNPESKAIKNLLKAVSKERSKRSP

SEQ ID NO: 183 - protein, 368 aa, Homo sapiens
MVLEVSDHQVLNDAEVAALLENFSSSYDYGENESDSCCTSPPCPQDFSLNFDRAFLPALYSLLFLLGLLGNGAVAAVLLSRRTALSSTDTFLLHLAVADTLLVLTLPLWAVDAAVQWVFGSGLCKVAGALFNINFYAGALLLACISFDRYLNIVHATQLYRRGPPARVTLTCLAVWGLCLLFALPDFIFLSAHHDERLNATHCQYNFPQVGRTALRVLQLVAGFLLPLLVMAYCYAHILAVLLVSRGQRRLRAMRLVVVVVVAFALCWTPYHLVVLVDILMDLGALARNCGRESRVDVAKSVTSGLGYMHCCLNPLLYAFVGVKFRERMWMLLLRLGCPNQRGLQRQPSSSRRDSSWSETSEASYSGL

SEQ ID NO: 184 - protein, 415 aa, Homo sapiens
MELRKYGPGRLAGTVIGGAAQSKSQTKSDSITKEFLPGLYTAPSSPFPPSQVSDHQVLNDAEVAALLENFSSSYDYGENESDSCCTSPPCPQDFSLNFDRAFLPALYSLLFLLGLLGNGAVAAVLLSRRTALSSTDTFLLHLAVADTLLVLTLPLWAVDAAVQWVFGSGLCKVAGALFNINFYAGALLLACISFDRYLNIVHATQLYRRGPPARVTLTCLAVWGLCLLFALPDFIFLSAHHDERLNATHCQYNFPQVGRTALRVLQLVAGFLLPLLVMAYCYAHILAVLLVSRGQRRLRAMRLVVVVVVAFALCWTPYHLVVLVDILMDLGALARNCGRESRVDVAKSVTSGLGYMHCCLNPLLYAFVGVKFRERMWMLLLRLGCPNQRGLQRQPSSSRRDSSWSETSEASYSGL

SEQ ID NO: 185 - protein, 97 aa, Homo sapiens
MKVSAALLWLLLIAAAFSPQGLAGPASVPTTCCFNLANRKIPLQRLESYRRITSGKCPQKAVIFKTKLAKDICADPKKKWVQDSMKYLDQKSPTPKP

SEQ ID NO: 186 - protein, 374 aa, Homo sapiens
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRSLFHIALGCRIAPLQKPVCGGPGVRPGKNVKVTTQGLLDGRGKGKSIGRAPEASLQDKEGA

SEQ ID NO: 187 - protein, 360 aa, Homo sapiens
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRRYLSVFFRKHITKRFCKQCPVFYRETVDGVTSTNTPSTGEQEVSAGL

SEQ ID NO: 188 - protein, 355 aa, Homo sapiens
MTTSLDTVETFGTTSYYDDVGLLCEKADTRALMAQFVPPLYSLVFTVGLLGNVVVVMILIKYRRLRIMTNIYLLNLAISDLLFLVTLPFWIHYVRGHNWVFGHGMCKLLSGFYHTGLYSEIFFIILLTIDRYLAIVHAVFALRARTVTFGVITSIVTWGLAVLAALPEFIFYETEELFEETLCSALYPEDTVYSWRHFHTLRMTIFCLVLPLLVMAICYTGIIKTLLRCPSKKKYKAIRLIFVIMAVFFIFWTPYNVAILLSSYQSILFGNDCERSKHLDLVMLVTEVIAYSHCCMNPVIYAFVGERFRKYLRHFFHRHLLMHLGRYIPFLPSEKLERTSSVSPSTAEPELSIVF

SEQ ID NO: 189 - protein, 355 aa, Homo sapiens; identical to SEQ ID NO: 188

SEQ ID NO: 190 - protein, 373 aa, Homo sapiens
MPFGIRMLLRAHKPGRSEMTTSLDTVETFGTTSYYDDVGLLCEKADTRALMAQFVPPLYSLVFTVGLLGNVVVVMILIKYRRLRIMTNIYLLNLAISDLLFLVTLPFWIHYVRGHNWVFGHGMCKLLSGFYHTGLYSEIFFIILLTIDRYLAIVHAVFALRARTVTFGVITSIVTWGLAVLAALPEFIFYETEELFEETLCSALYPEDTVYSWRHFHTLRMTIFCLVLPLLVMAICYTGIIKTLLRCPSKKKYKAIRLIFVIMAVFFIFWTPYNVAILLSSYQSILFGNDCERSKHLDLVMLVTEVIAYSHCCMNPVIYAFVGERFRKYLRHFFHRHLLMHLGRYIPFLPSEKLERTSSVSPSTAEPELSIVF

SEQ ID NO: 191 - protein, 352 aa, Homo sapiens [sequence omitted]

SEQ ID NO: 192 - protein, 374 aa, Homo sapiens; identical to SEQ ID NO: 186

SEQ ID NO: 193 - protein, 360 aa, Homo sapiens; identical to SEQ ID NO: 187

SEQ ID NO: 194 - protein, 76 aa, Homo sapiens
QPDSVSIPITCCFNVINRKIPIQRLESYTRITNIQCPKEAVIFKTKRGKEVCADPKERWVRDSMKHLDQIFQNLKP

SEQ ID NO: 195 - protein, 97 aa, Homo sapiens
QPKVPEWVNTPSTCCLKYYEKVLPRRLVVGYRKALNCHLPAIIFVTKRNREVCTNPNDDWVQEYIKDPNLPLLPTRNLSTVKIITAKNGQPQLLNSQ

SEQ ID NO: 196 - protein, 369 aa, Homo sapiens
MTPTDFTSPIPNMADDYGSESTSSMEDYVNFNFTDFYCEKNNVRQFASHFLPPLYWLVFIVGALGNSLVILVYWYCTRVKTMTDMFLLNLAIADLLFLVTLPFWAIAAADQWKFQTFMCKVVNSMYKMNFYSCVLLIMCISVDRYIAIAQAMRAHTWREKRLLYSKMVCFTIWVLAAALCIPEILYSQIKEESGIAICTMVYPSDESTKLKSAVLTLKVILGFFLPFVVMACCYTIIIHTLIQAKKSSKHKALKVTITVLTVFVLSQFPYNCILLVQTIDAYAMFISNCAVSTNIDICFQVTQTIAFFHSCLNPVLYVFVGERFRRDLVKTLKNLGCISQAQWVSFTRREGSLKLSSMLLETTSGALSL

SEQ ID NO: 197 - protein, 357 aa, Homo sapiens
MADDYGSESTSSMEDYVNFNFTDFYCEKNNVRQFASHFLPPLYWLVFIVGALGNSLVILVYWYCTRVKTMTDMFLLNLAIADLLFLVTLPFWAIAAADQWKFQTFMCKVVNSMYKMNFYSCVLLIMCISVDRYIAIAQAMRAHTWREKRLLYSKMVCFTIWVLAAALCIPEILYSQIKEESGIAICTMVYPSDESTKLKSAVLTLKVILGFFLPFVVMACCYTIIIHTLIQAKKSSKHKALKVTITVLTVFVLSQFPYNCILLVQTIDAYAMFISNCAVSTNIDICFQVTQTIAFFHSCLNPVLYVFVGERFRRDLVKTLKNLGCISQAQWVSFTRREGSLKLSSMLLETTSGALSL

SEQ ID NO: 198 - protein, 127 aa, Homo sapiens
QGVFEDCCLAYHYPIGWAVLRRAWTYRIQEVSGSCNLPAAIFYLPKRHRKVCGNPKSREVQRAMKLLDARNKVFAKLHHNTQTFQAGPHAVKKLSSGNSKLSSSKFSNPISSSKRNVSLLISANSGL

SEQ ID NO: 199 - protein, 126 aa, Homo sapiens
QGVFEDCCLAYHYPIGWAVLRRAWTYRIQEVSGSCNLPAAIFYLPKRHRKVCGNPKSREVQRAMKLLDARNKVFAKLHHNTQTFQGPHAVKKLSSGNSKLSSSKFSNPISSSKRNVSLLISANSGL

SEQ ID NO: 200 - protein, 350 aa, Homo sapiens
  MOD_RES (31)..(31): Any naturally occurring amino acid
MSNITDPQMWDFDDLNFTGMPPADEDYSPCXLETETLNKYVVIIAYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRHLVKFVCLGCWGLSMNLSLPFFLFRQAYHPNNSSPVCYEVLGNDTAKWRMVLRILPHTFGFIVPLFVMLFCYGFTLRTLFKAHMGQKHRAMRVIFAVVLIFLLCWLPYNLVLLADTLMRTQVIQESCERRNNIGRALDATEILGFLHSCLNPIIYAFIGQNFRHGFLKILAMHGLVSKEFLARHRVTSYTSSSVNVSSNL

SEQ ID NO: 201 - protein, 360 aa, Homo sapiens
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRYLVKFICLSIWGLSLLLALPVLLFRRTVYSSNVSPACYEDMGNNTANWRMLLRILPQSFGFIVPLLIMLFCYGFTLRTLFKAHMGQKHRAMRVIFAVVLIFLLCWLPYNLVLLADTLMRTQVIQETCERRNHIDRALDATEILGILHSCLNPLIYAFIGQKFRHGLLKILAIHGLISKDSLPKDSRPSFVGSSSGHTSTTL

SEQ ID NO: 202 - protein, 107 aa, Homo sapiens
MARAALSAAPSNPRLLRVALLLLLLVAAGRRAAGASVATELRCQCLQTLQGIHPKNIQSVNVKSPGPHCAQTEVIATLKNGRKACLNPASPIVKKIIEKMLNSDKSN

SEQ ID NO: 203 - protein, 107 aa, Homo sapiens
MARATLSAAPSNPRLLRVALLLLLLVAASRRAAGAPLATELRCQCLQTLQGIHLKNIQSVKVKSPGPHCAQTEVIATLKNGQKACLNPASPMVKKIIEKMLKNGKSN

SEQ ID NO: 204 - protein, 73 aa, Homo sapiens
ASVVTELRCQCLQTLQGIHLKNIQSVNVRSPGPHCAQTEVIATLKNGKKACLNPASPMVQKIIEKILNKGSTN

SEQ ID NO: 205 - protein, 101 aa, Homo sapiens
MSSAAGFCASRPGLLFLGLLLLPLVVAFASAEAEEDGDLQCLCVKTTSQVRPRHITSLEVIKAGPHCPTAQLIATLKNGRKICLDLQAPLYKKIIKKLLES

SEQ ID NO: 206 - protein, 114 aa, Homo sapiens
MSLLSSRAARVPGPSSSLCALLVLLLLLTQPGPIASAGPAAAVLRELRCVCLQTTQGVHPKMISNLQVFAIGPQCSKVEVVASLKNGKEICLDPEAPFLKKVIQKILDGGNKEN

SEQ ID NO: 207 - protein, 77 aa, Homo sapiens
GPVSAVLTELRCTCLRVTLRVNPKTIGKLQVFPAGPQCSKVEVVASLKNGKQVCLDPEAPFLKKVIQKILDSGNKKN

SEQ ID NO: 208 - protein, 130 aa, Homo sapiens
MSLRLDTTPSCNSARPLHALQVLLLLSLLLTALASSTKGQTKRNLAKGKEESLDSDLYAELRCMCIKTTSGIHPKNIQSLEVIGKGTHCNDFQVEVIATLKDGRKICLDPDAPRIKKIVQKKLAGDESAD

SEQ ID NO: 209 - protein, 79 aa, Homo sapiens
EGAVLPRSAKELRCQCIKTYSKPFHPKFIKELRVIESGPHCANTEIIVKLSDGRELCLDPKENWVQRVVEKFLKRAENS

SEQ ID NO: 210 - protein, 75 aa, Homo sapiens
EGAVLPRSAKELRCQCIKTYSKPFHPKFIKELRVIESGPHCANTEIIVKLSDGRELCLDPKENWVQRVVEKFLKR

SEQ ID NO: 211 - DNA, 4794 bp, Homo sapiens
cggccgggcgcacccgcggggccctgggctcgctggcttgcgcgcagctgagcggggtgtaggttggaagggccagggccccctggggcgcaagtgggggccggcgccatggaacccccgaccgtcccctcggaaaggagcctgtctctgtcactgcccgggccccgggagggccaggccaccctgaagcctcccccgcagcacctgtggcggcagcctcggacccccatccgtatccagcagcgcggctactccgacagcgcggagcgcgccgagcgggagcggcagccgcaccggcccatagagcgcgccgatgccatggacaccagcgaccggcccggcctgcgcacgacccgcatgtcctggccctcgtccttccatggcactggcaccggcagcggcggcgcgggcggaggcagcagcaggcgcttcgaggcagagaatgggccgacaccatctcctggccgcagccccctggactcgcaggcgagcccaggactcgtgctgcacgccggggcggccaccagccagcgccgggagtccttcctgtaccgctcagacagcgactatgacatgtcacccaagaccatgtcccggaactcatcggtcaccagcgaggcgcacgctgaagacctcatcgtaacaccatttgctcaggtgctggccagcctccggagcgtccgtagcaacttctcactcctgaccaatgtgcccgttcccagtaacaagcggtccccgctgggcggccccacccctgtctgcaaggccacgctgtcagaagaaacgtgtcagcagttggcccgggagactctggaggagctggactggtgtctggagcagctggagaccatgcagacctatcgctctgtcagcgagatggcctcgcacaagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctccactcctcccctcactcccctgctcccccgaccacctcctcctctgcctcaaagactcttgtcctcttgtccctcctgagaaaaaagaaaacgaaaagtggggtttttttctgttttctttttttcccctttccccctgcccccacccacggggcctttttttggaggtgggggctggggaatgaggggctgaggtcccggaagggattttatttttttgaattttaattgtaacatttttagaaaaagaacaaaaaaagaaaaaaaaaagaaagaaacacagcaactgtagatgctcctgttcctggttcccgctttccacttccaaatccctcccctcaccttcccccactgccccccaagttccaggctcagtcttccagccgcctggggagtctctacctgggcccaagcaggtgtggggcctccttctgggcttttcttctgaatttagaggatttctagaacgtggtcaggaatagccattctaggcggggctggggccagggtggggggcagtcactgtgggaggtcccagctccagcccccctctggtttgctgcctcctctcccctctaaaaaagtcttccgcttgattttgcacaatcccggcgatactcctggcgatactgactagaaagtcagggagctgggggagctgttcactttaggatacgggggtggtatggaagggagcgttcacaccgccagcctcgggcctgggatttgaggagggccctagacctcctccactctccatcccctttcccttccactttgggttcactttgaattttctccgttttttggggcagtggctctgatccactcacccccccgccccccgccccacttctagctgcttctcctcttgtttctgccttaataattcccacggccacaggcaagggggttgcagtggccgcctgcaccttggatgaggcagggccaggcgcccagaacccccatcctggccgcacccccctttccagggtcctccggaccccaccttccacactctgatcacagcccccctaccttttgccctaggaggaagcaataatggtgtataccctcattctcattcctgggcagcccttccttccaccctggcaccaaaataatttctcctccatccgtaccttgcctagcctctccctctcccccagctagtccctgagcaatacggcagacagatgcaagaccatttttctccaagccatgggggactgtttggaaggaaagccccctctctccctcctcccctcgccctcggcctggttctgcagctggaccgacctcattcatcgcctgccccctacccaattctgagcacacggtactgtagcccccagttcctccctagccttccatccctctgtccaccccagggggaggtaaccccgcactcacactcccttgatgctgtctgtacagggttcatattttgtagcgaaagtcgtttttgtcccagccggcgatcggagtgggccttttctttctttttgttcattctttacctttttttcttttctttctttcttttttgtacatactgtaaggttggtttgtaaattattctacggaggcaaaaagggaaaataaaaacttgcccttccctggctgacccagtcgggaaggtagggaaggaggtctcccgttgggagagtctctgttcctgctgtattatacaaactgtaccatagtcctgggaaaagggtggactcaccgctgttgttttatgggaagtcgtgtcatcctaggggttggggctgggcagagcctgtcccctccccccttctccaggagccagggggtgactggagagacagacccacccccaagcagggctcctctccccagggtgagcacaggacctctgtaagctgcttgtgtattgtccactttgacgatcagtcattcggtccgttgatcaataatccttcgatcttgtctccaattaaaccgaggctttcaccgataaaaaaaaaaaaaaa

SEQ ID NO: 212 - DNA, 4608 bp, Homo sapiens
atggcgcggccgcgcggcctaggccgcatcccggagctgcaactggtggccttcccggtggcggtggcggctgaggacgaggcgttcctgcccgagcccctggccccgcgcgcgccccgccgcccgcgttcgccgccctcctcgcccgtcttcttcgccagcccgtccccaactttccgcagacgccttcggcttctccgcagctgccaggatttgggccgccaggcttgggctggggctggcttcgaggcagagaatgggccgacaccatctcctggccgcagccccctggactcgcaggcgagcccaggactcgtgctgcacgccggggcggccaccagccagcgccgggagtccttcctgtaccgctcagacagcgactatgacatgtcacccaagaccatgtcccggaactcatcggtcaccagcgaggcgcacgctgaagacctcatcgtaacaccatttgctcaggtgctggccagcctccggagcgtccgtagcaacttctcactcctgaccaatgtgcccgttcccagtaacaagcggtccccgctgggcggccccacccctgtctgcaaggccacgctgtcagaagaaacgtgtcagcagttggcccgggagactctggaggagctggactggtgtctggagcagctggagaccatgcagacctatcgctctgtcagcgagatggcctcgcacaagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctccactcctcccctcactcccctgctcccccgaccacctcctcctctgcctcaaagactcttgtcctcttgtccctcctgagaaaaaagaaaacgaaaagtggggtttttttctgttttctttttttcccctttccccctgcccccacccacggggcctttttttggaggtgggggctggggaatgaggggctgaggtcccggaagggattttatttttttgaattttaattgtaacatttttagaaaaagaacaaaaaaagaaaaaaaaaagaaagaaacacagcaactgtagatgctcctgttcctggttcccgctttccacttccaaatccctcccctcaccttcccccactgccccccaagttccaggctcagtcttccagccgcctggggagtctctacctgggcccaagcaggtgtggggcctccttctgggcttttcttctgaatttagaggatttctagaacgtggtcaggaatagccattctaggcggggctggggccagggtggggggcagtcactgtgggaggtcccagctccagcccccctctggtttgctgcctcctctcccctctaaaaaagtcttccgcttgattttgcacaatcccggcgatactcctggcgatactgactagaaagtcagggagctgggggagctgttcactttaggatacgggggtggtatggaagggagcgttcacaccgccagcctcgggcctgggatttgaggagggccctagacctcctccactctccatcccctttcccttccactttgggttcactttgaattttctccgttttttggggcagtggctctgatccactcacccccccgccccccgccccacttctagctgcttctcctcttgtttctgccttaataattcccacggccacaggcaagggggttgcagtggccgcctgcaccttggatgaggcagggccaggcgcccagaacccccatcctggccgcacccccctttccagggtcctccggaccccaccttccacactctgatcacagcccccctaccttttgccctaggaggaagcaataatggtgtataccctcattctcattcctgggcagcccttccttccaccctggcaccaaaataatttctcctccatccgtaccttgcctagcctctccctctcccccagctagtccctgagcaatacggcagacagatgcaagaccatttttctccaagccatgggggactgtttggaaggaaagccccctctctccctcctcccctcgccctcggcctggttctgcagctggaccgacctcattcatcgcctgccccctacccaattctgagcacacggtactgtagcccccagttcctccctagccttccatccctctgtccaccccagggggaggtaaccccgcactcacactcccttgatgctgtctgtacagggttcatattttgtagcgaaagtcgtttttgtcccagccggcgatcggagtgggccttttctttctttttgttcattctttacctttttttcttttctttctttcttttttgtacatactgtaaggttggtttgtaaattattctacggaggcaaaaagggaaaataaaaacttgcccttccctggctgacccagtcgggaaggtagggaaggaggtctcccgttgggagagtctctgttcctgctgtattatacaaactgtaccatagtcctgggaaaagggtggactcaccgctgttgttttatgggaagtcgtgtcatcctaggggttggggctgggcagagcctgtcccctccccccttctccaggagccagggggtgactggagagacagacccacccccaagcagggctcctctccccagggtgagcacaggacctctgtaagctgcttgtgtattgtccactttgacgatcagtcattcggtccgttgatcaataatccttcgatcttgtctccaattaaaccgaggctttcaccgataaaaaaaaaaaaaaa

SEQ ID NO: 213 - DNA, 4503 bp, Homo sapiens
atgcgctccggtgcagcgccccgggcccggccccggccccctgccctggcactgccccccacgggccccgagtccctgacccacttccccttcagcgatgaggacacccgtcggcaccctccgggcagatctgtcagcttcgaggcagagaatgggccgacaccatctcctggccgcagccccctggactcgcaggcgagcccaggactcgtgctgcacgccggggcggccaccagccagcgccgggagtccttcctgtaccgctcagacagcgactatgacatgtcacccaagaccatgtcccggaactcatcggtcaccagcgaggcgcacgctgaagacctcatcgtaacaccatttgctcaggtgctggccagcctccggagcgtccgtagcaacttctcactcctgaccaatgtgcccgttcccagtaacaagcggtccccgctgggcggccccacccctgtctgcaaggccacgctgtcagaagaaacgtgtcagcagttggcccgggagactctggaggagctggactggtgtctggagcagctggagaccatgcagacctatcgctctgtcagcgagatggcctcgcacaagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctccactcctcccctcactcccctgctcccccgaccacctcctcctctgcctcaaagactcttgtcctcttgtccctcctgagaaaaaagaaaacgaaaagtggggtttttttctgttttctttttttcccctttccccctgcccccacccacggggcctttttttggaggtgggggctggggaatgaggggctgaggtcccggaagggattttatttttttgaattttaattgtaacatttttagaaaaagaacaaaaaaagaaaaaaaaaagaaagaaacacagcaactgtagatgctcctgttcctggttcccgctttccacttccaaatccctcccctcaccttcccccactgccccccaagttccaggctcagtcttccagccgcctggggagtctctacctgggcccaagcaggtgtggggcctccttctgggcttttcttctgaatttagaggatttctagaacgtggtcaggaatagccattctaggcggggctggggccagggtggggggcagtcactgtgggaggtcccagctccagcccccctctggtttgctgcctcctctcccctctaaaaaagtcttccgcttgattttgcacaatcccggcgatactcctggcgatactgactagaaagtcagggagctgggggagctgttcactttaggatacgggggtggtatggaagggagcgttcacaccgccagcctcgggcctgggatttgaggagggccctagacctcctccactctccatcccctttcccttccactttgggttcactttgaattttctccgttttttggggcagtggctctgatccactcacccccccgccccccgccccacttctagctgcttctcctcttgtttctgccttaataattcccacggccacaggcaagggggttgcagtggccgcctgcaccttggatgaggcagggccaggcgcccagaacccccatcctggccgcacccccctttccagggtcctccggaccccaccttccacactctgatcacagcccccctaccttttgccctaggaggaagcaataatggtgtataccctcattctcattcctgggcagcccttccttccaccctggcaccaaaataatttctcctccatccgtaccttgcctagcctctccctctcccccagctagtccctgagcaatacggcagacagatgcaagaccatttttctccaagccatgggggactgtttggaaggaaagccccctctctccctcctcccctcgccctcggcctggttctgcagctggaccgacctcattcatcgcctgccccctacccaattctgagcacacggtactgtagcccccagttcctccctagccttccatccctctgtccaccccagggggaggtaaccccgcactcacactcccttgatgctgtctgtacagggttcatattttgtagcgaaagtcgtttttgtcccagccggcgatcggagtgggccttttctttctttttgttcattctttacctttttttcttttctttctttcttttttgtacatactgtaaggttggtttgtaaattattctacggaggcaaaaagggaaaataaaaacttgcccttccctggctgacccagtcgggaaggtagggaaggaggtctcccgttgggagagtctctgttcctgctgtattatacaaactgtaccatagtcctgggaaaagggtggactcaccgctgttgttttatgggaagtcgtgtcatcctaggggttggggctgggcagagcctgtcccctccccccttctccaggagccagggggtgactggagagacagacccacccccaagcagggctcctctccccagggtgagcacaggacctctgtaagctgcttgtgtattgtccactttgacgatcagtcattcggtccgttgatcaataatccttcgatcttgtctccaattaaaccgaggctttcaccgataaaaaaaaaaaaaaa

SEQ ID NO: 214 - DNA, 4276 bp, Homo sapiens
tccgcagcctcctcctgggacccttgccctgcccccctcccatgggcacggaccccccaccgcctccacccactgccgcgggggggcccgttggggcccagggctggcgggccatgtaaccagggctgctgctgggagcgcggaggggaagggagcccccagccctgctgggccggcccaggcccctccgcggctcccccttccactacccacctgcccggcaccccctccccagtggttgttaaccccgggactccccaagcccagcctctgtgtgcagcagccccaggcgggctaagtctccaagatgcccttggtggatttcttctgcgagacctgctctaagccttggctggtgggctggtgggaccagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctccactcctcccctcactcccctgctcccccgaccacctcctcctctgcctcaaagactcttgtcctcttgtccctcctgagaaaaaagaaaacgaaaagtggggtttttttctgttttctttttttcccctttccccctgcccccacccacggggcctttttttggaggtgggggctggggaatgaggggctgaggtcccggaagggattttatttttttgaattttaattgtaacatttttagaaaaagaacaaaaaaagaaaaaaaaaagaaagaaacacagcaactgtagatgctcctgttcctggttcccgctttccacttccaaatccctcccctcaccttcccccactgccccccaagttccaggctcagtcttccagccgcctggggagtctctacctgggcccaagcaggtgtggggcctccttctgggcttttcttctgaatttagaggatttctagaacgtggtcaggaatagccattctaggcggggctggggccagggtggggggcagtcactgtgggaggtcccagctccagcccccctctggtttgctgcctcctctcccctctaaaaaagtcttccgcttgattttgcacaatcccggcgatactcctggcgatactgactagaaagtcagggagctgggggagctgttcactttaggatacgggggtggtatggaagggagcgttcacaccgccagcctcgggcctgggatttgaggagggccctagacctcctccactctccatcccctttcccttccactttgggttcactttgaattttctccgttttttggggcagtggctctgatccactcacccccccgccccccgccccacttctagctgcttctcctcttgtttctgccttaataattcccacggccacaggcaagggggttgcagtggccgcctgcaccttggatgaggcagggccaggcgcccagaacccccatcctggccgcacccccctttccagggtcctccggaccccaccttccacactctgatcacagcccccctaccttttgccctaggaggaagcaataatggtgtataccctcattctcattcctgggcagcccttccttccaccctggcaccaaaataatttctcctccatccgtaccttgcctagcctctccctctcccccagctagtccctgagcaatacggcagacagatgcaagaccatttttctccaagccatgggggactgtttggaaggaaagccccctctctccctcctcccctcgccctcggcctggttctgcagctggaccgacctcattcatcgcctgccccctacccaattctgagcacacggtactgtagcccccagttcctccctagccttccatccctctgtccaccccagggggaggtaaccccgcactcacactcccttgatgctgtctgtacagggttcatattttgtagcgaaagtcgtttttgtcccagccggcgatcggagtgggccttttctttctttttgttcattctttacctttttttcttttctttctttcttttttgtacatactgtaaggttggtttgtaaattattctacggaggcaaaaagggaaaataaaaacttgcccttccctggctgacccagtcgggaaggtagggaaggaggtctcccgttgggagagtctctgttcctgctgtattatacaaactgtaccatagtcctgggaaaagggtggactcaccgctgttgttttatgggaagtcgtgtcatcctaggggttggggctgggcagagcctgtcccctccccccttctccaggagccagggggtgactggagagacagacccacccccaagcagggctcctctccccagggtgagcacaggacctctgtaagctgcttgtgtattgtccactttgacgatcagtcattcggtccgttgatcaataatccttcgatcttgtctccaattaaaccgaggctttcaccgataaaaaaaaaaaaaaa

SEQ ID NO: 215 - DNA, 4704 bp, Homo sapiens
cgtcacgccccaggagaggcaataggaggccctggccctgccgacatggccaccgcagtcccaacggcgcgctaggttggcgagatgaagaggagtcgcagtgccctgtccgtggcagggaccggggacgagaggtcgagggagacccccgaatccgaccgtgccaacatgctgggggccgacctgcgtcgccctcgccgccgcctctcgtccggtcctggcctgggctgggcccagcctgagccctcggaccctggggtccctctgccgccacggcccaccaccctgccgctgctgatcccaccgcggatttccatcaccagggccgagaacgacagcttcgaggcagagaatgggccgacaccatctcctggccgcagccccctggactcgcaggcgagcccaggactcgtgctgcacgccggggcggccaccagccagcgccgggagtccttcctgtaccgctcagacagcgactatgacatgtcacccaagaccatgtcccggaactcatcggtcaccagcgaggcgcacgctgaagacctcatcgtaacaccatttgctcaggtgctggccagcctccggagcgtccgtagcaacttctcactcctgaccaatgtgcccgttcccagtaacaagcggtccccgctgggcggccccacccctgtctgcaaggccacgctgtcagaagaaacgtgtcagcagttggcccgggagactctggaggagctggactggtgtctggagcagctggagaccatgcagacctatcgctctgtcagcgagatggcctcgcacaagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctccactcctcccctcactcccctgctcccccgaccacctcctcctctgcctcaaagactcttgtcctcttgtccctcctgagaaaaaagaaaacgaaaagtggggtttttttctgttttctttttttcccctttccccctgcccccacccacggggcctttttttggaggtgggggctggggaatgaggggctgaggtcccggaagggattttatttttttgaattttaattgtaacatttttagaaaaagaacaaaaaaagaaaaaaaaaagaaagaaacacagcaactgtagatgctcctgttcctggttcccgctttccacttccaaatccctcccctcaccttcccccactgccccccaagttccaggctcagtcttccagccgcctggggagtctctacctgggcccaagcaggtgtggggcctccttctgggcttttcttctgaatttagaggatttctagaacgtggtcaggaatagccattctaggcggggctggggccagggtggggggcagtcactgtgggaggtcccagctccagcccccctctggtttgctgcctcctctcccctctaaaaaagtcttccgcttgattttgcacaatcccggcgatactcctggcgatactgactagaaagtcagggagctgggggagctgttcactttaggatacgggggtggtatggaagggagcgttcacaccgccagcctcgggcctgggatttgaggagggccctagacctcctccactctccatcccctttcccttccactttgggttcactttgaattttctccgttttttggggcagtggctctgatccactcacccccccgccccccgccccacttctagctgcttctcctcttgtttctgccttaataattcccacggccacaggcaagggggttgcagtggccgcctgcaccttggatgaggcagggccaggcgcccagaacccccatcctggccgcacccccctttccagggtcctccggaccccaccttccacactctgatcacagcccccctaccttttgccctaggaggaagcaataatggtgtataccctcattctcattcctgggcagcccttccttccaccctggcaccaaaataatttctcctccatccgtaccttgcctagcctctccctctcccccagctagtccctgagcaatacggcagacagatgcaagaccatttttctccaagccatgggggactgtttggaaggaaagccccctctctccctcctcccctcgccctcggcctggttctgcagctggaccgacctcattcatcgcctgccccctacccaattctgagcacacggtactgtagcccccagttcctccctagccttccatccctctgtccaccccagggggaggtaaccccgcactcacactcccttgatgctgtctgtacagggttcatattttgtagcgaaagtcgtttttgtcccagccggcgatcggagtgggccttttctttctttttgttcattctttacctttttttcttttctttctttcttttttgtacatactgtaaggttggtttgtaaattattctacggaggcaaaaagggaaaataaaaacttgcccttccctggctgacccagtcgggaaggtagggaaggaggtctcccgttgggagagtctctgttcctgctgtattatacaaactgtaccatagtcctgggaaaagggtggactcaccgctgttgttttatgggaagtcgtgtcatcctaggggttggggctgggcagagcctgtcccctccccccttctccaggagccagggggtgactggagagacagacccacccccaagcagggctcctctccccagggtgagcacaggacctctgtaagctgcttgtgtattgtccactttgacgatcagtcattcggtccgttgatcaataatccttcgatcttgtctccaattaaaccgaggctttcaccgataaaaaaaaaaaaaaa

What is claimed is:

1. A method of formulating a pharmaceutical composition comprising an immune modulator, the method comprising:
   (a) topically administering a dose of an immune modulator to a predetermined site in a small intestine or a predetermined site in a colon of a mammal;
   (b) selecting an immune modulator whose topical administration in step (a) has been determined to result in:
      (i) a decrease in the level of one or more of T cells, B cells, natural killer (NK) cells, macrophages, M cells, and dendritic cells, in MALT, GALT, Peyer's patches, mesenteric lymph nodes, paraaortic lymph nodes, or any of the other tissues originating from the endoderm, and/or
      (ii) a decrease in the level of one or more of IL-1, IL-2, IL-6, IL-8, IL-12, IL-18, interferon-kappa, TGF-β, tumor necrosis factor, and GM-CSF, in MALT, GALT, Peyer's patches, mesenteric lymph nodes, paraaortic lymph nodes, or any of the other tissues originating from the endoderm, in the mammal, each as compared to the corresponding level in a control mammal systemically administered the same dose or a therapeutically effective dose of the immune modulator; and
   (c) formulating a pharmaceutical composition comprising the selected immune modulator.

2. The method of claim 1, wherein the immune modulator is administered to a predetermined site in the proximal portion of the small intestine.

3. The method of claim 1, wherein the immune modulator is administered to a predetermined site in the distal portion of the small intestine.

4. The method of claim 1, wherein the immune modulator is an antisense nucleic acid.

5. The method of claim 1, wherein the immune modulator is a peptide or an antibody.

6. The method of claim 1, wherein the immune modulator is selected from the group consisting of: IL-12/IL-23 inhibitors, TNFα inhibitors, IL-6 receptor inhibitors, CD40/CD40L inhibitors, IL-1 inhibitors, IL-13 inhibitors, IL-10 receptor agonists, integrin inhibitors, TGF-beta inhibitors, and FGF receptor agonists.

7. The method of claim 1, wherein the tissue originating from the endoderm is selected from the group consisting of: the stomach, the colon, the liver, the pancreas, the urinary bladder, the epithelial parts of the trachea, the lungs, the pharynx, the thyroid, the parathyroid, the small intestine, and the gallbladder.

8. The method of claim 1, wherein the topical administration is performed using an ingestible device.

9. The method of claim 1, wherein the topical administration is performed using a surgical procedure or an endoscopic procedure.

10. A method of formulating a pharmaceutical composition comprising an immune modulator, the method comprising:

(a) administering a dose of an immune modulator into gastrointestinal tissue at a predetermined site in a small intestine and/or a predetermined site in a colon of a mammal (b) selecting an immune modulator whose topical administration in step (a) has been determined to result in
   (i) a decrease in the level of one or more of one or more of T cells, B cells, natural killer (NK) cells, macrophages, M cells, dendritic cells, and any of the other effector cells described herein or known in the art, in MALT, GALT, Peyer's patches, mesenteric lymph nodes, paraaortic lymph nodes, or any of the other tissues originating from the endoderm, and/or
   (ii) a decrease in the level of one or more of IL-1, IL-2, IL-6, IL-8, IL-12, IL-18, interferon-kappa, TGF-β, tumor necrosis factor, and GM-CSF, in MALT, GALT, Peyer's patches, mesenteric lymph nodes, paraaortic lymph nodes, or any of the other tissues originating from the endoderm, in the mammal, each as compared to the corresponding level in a control mammal systemically administered the same dose or a therapeutically effective dose of the immune modulator at a site not in the small intestine or colon; and (c) formulating a pharmaceutical composition comprising the selected immune modulator.

11. The method of claim 1 or claim 10, wherein the means for systemically administering the same dose or a therapeutically effective dose of the immune modulator at a site not in the small intestine or colon is selected from the group consisting of subcutaneous, intravenous, and oral administration of the immune modulator.

12. A method of formulating a pharmaceutical composition comprising an immune modulator, the method comprising:
   (a) administering a dose of an immune modulator into gastrointestinal tissue at a predetermined site in a small intestine and/or a predetermined site in a colon of a mammal
   (b) selecting an immune modulator whose topical administration in step (a) has been determined to result in the method of claim 1, wherein release of the formulation from the device (a) to the small intestine or (b) to the large intestine provides one or more of the following pharmacodynamic effects:
      (i) decreased immune response in diseased tissue, lymph nodes or lymph tissues;
      (ii) decreased T cells measured in diseased tissue, lymph nodes or lymph tissues;
      (iii) increased T cells in peripheral circulation as measured in blood, plasma or serum;
      (iv) changed anatomical features, including suppressed or reduced development, aggregation, or accumulation of one or more of intestinal lymphoid tissues, isolated lymphoid follicles (ILFs), intestinal lymphoid aggregates, or hepatic lymphoid aggregates;
      (v) decreased differentiation of immune cells in the diseased tissue;
      (vi) decreased levels of inflammatory cytokine levels in the diseased tissue; or
      (vii) improved efficacy of treatment using one or more clinical assessments of a treatment, such as endoscopic scoring for IBD, or evidence of hepatic steatosis by imaging or by histology for NAFLD; and
   (c) formulating a pharmaceutical composition comprising the selected immune modulator.

13. A pharmaceutical composition prepared by the method of claim 1, 10, or 12.

14. The pharmaceutical composition of claim 13, wherein the pharmaceutical composition is useful for the treatment of an inflammatory disease or condition that arises in a tissue originating from the endoderm in a subject.

15. The pharmaceutical composition of claim 14, wherein the inflammatory disease or condition originating from the endoderm is selected from the group consisting of: gastritis, Celiac disease, hepatitis, alcoholic lever disease, fatty liver disease (hepatic steatosis), non-alcoholic fatty liver disease (NASH), cirrhosis, primary schlerosing cholangitis, pancreatitis, interstitial cystitis, asthma, chronic obstructic pulmonary disease, pulmonary fibrosis, pharyngitis, thyroiditis, hyperthyroidism, parathyroiditis, nephritis, Hashimoto's disease, Addison's disease, Graves' disease, Sjogren syndrome, type 1 diabetes, pelvic inflammatory disease, auditory canal inflammation, tinnitus, vestibular neuritis, otitis media, auditory canal inflammation, tracheitis, cholestatic liver disease, primary biliary sclerosis, liver parenchyma, an inherited metabolic disorder of the liver, Byler syndrome, cerebrotendinous, xanthomatosis, Zellweger's syndrome, neonatal hepatitis, cystic fibrosis, ALGS (Alagilles syndrome), PFIC (progressive familial intrahepatic cholestasis), autoimmune hepatitis, primary biliary cirrhosis (PBC), liver fibrosis, NAFLD, portal hypertension, general cholestasis, such as in jaundice due to drugs or during pregnancy, intra- and extrahepatic cholestasis, such as hereditary forms of cholestasis, such as PFIC1, gall stones and choledocholithiasis, malignancy causing obstruction of the biliary tree, symptoms (scratching, pruritus) due to cholestasis/jaundice, chronic autoimmune liver disease leading to progressive cholestasis, and pruritus of cholestatic liver disease, duodenal ulcers, enteritis (radiation-, chemotherapy-, or infection-induced enteritis), diverticulitis, pouchitis, cholecystitis, and cholangitis.

\* \* \* \* \*